United States Patent 6,812,339 (POLYMORPHISMS IN KNOWN GENES ASSOCIATED WITH HUMAN DISEASE, METHODS OF DETECTION AND USES THEREOF) - sequence listing, part 12

SEQ ID NO: 12065 - DNA, 108440 bp, Human
gtggagcagggagaccctgaagcccagggcgagggctgccgggttgccctggatagccaatgtttgctcaggctggggagacccggagacggtggctggggtgtcctcagcccgggagagctgagtcagccgcgccccgcacacagcatacttaggagccaaggacttggacctcgcttctcgccggtccgcgagacgagtattaggattgggatttgaagggacctcataaagcgcatcgcagcctggggcgaggtggggggcggggaagcacacccgaaaccgcgctggcgaccgaggcagccggggcatgccctcgccgagcctcgccgtccccataggtgagatgtccggtggcgctgggtcccggatagattgtgttcccggggctctctctgggttctgcaggcgacccccaactccccccgcgcgccctccagggtcctgacttttctccttgtatctccacagccgcacggttgtttatggagctttgggcgggggctgagcccgcggtcgtgcccccagcccgctgcccaggccatgccgccccatctgcgcgcggagcctcggctgccgggcctccggggctgagccgggagcgccgtgaggaggaggcgccggcggcggatcaggagcgggagccgtggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatcaggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtggtaagtcttgctctgagatttgcccagaactcatgctgatttcagcagacttttgatgccctatgcatccctttttcttaactttctacacagtcatgaaaactcagaccagggccctgggacagtcacagtgaataattctgtccaggtgtgtttgctgaggtggaagcagaggcactgaccatgcattttagcttggacagtgaatctgagtctttctactatttccatgcatatcttaaaaaacaagttttaaaagtatttcatgtaggtcaccacgcttcttgggaaaataatattcataaatgtcaccaaaaacttctggactaatccccaaagatagtgaactgagctactgagtgtagtttttgtctgatcaggtgaaacacttaactctgtgtttcattcaggccaaagaaaattgacaaggatatcatcaaattaagttagcctctactaataagccaggaaaatgagtgatgtgaatctatgacaggaccctgaaacctgtagatgtggttgtggccagtcaactgggtgaggaatcactgagcctcagtaagttaagccagaccattgcaatatttgtgtggtcagtgtaaccaaggtgcagtttgatgtatgaattaaatgaaaaccatactttgagctaagcagatggtttcttcagtatcataggcacctgagtgttatctccggagtaggtacctcctaatggatgtacatgtcagttggtacaggttgacatttcaggtatgttttcacgtgcctctggtttgggtcatcacactgacatcttgttctggttatggcagtagacaggagtttatttctattacatggttaatcgaacttgtaggctgcttttactcttaggaggatcagagtatcttacagaagacataggagttgaagctagcacttctgaaaaggtctgggctttctcttagcttttccagagagcatggggaatttcctagttcagtgtgccaggggtggttgtgctatattgggggaaagtctgcattttattatagtaggtagccttccgatttcatcttgaatatcaaatactcttcactgtacctcaataactttctccaccacgactgggagctttatgtttctactctgcattcttcactaaggtattttggaccacaaaacatactcctctctgattccctattcacgaatcacagtctggatttttgaagaccaggcattccttttcatgaaactctgctttttgctgatgatctggaggcaaatgtgtatgcaaaatcgccccaatcagcctggcattttgtggctaggacagggcccctgggcattatgcacctgctgtcaggcataggcgcaccacctttagagggggaagcggtccacctggaaggggatggtggtcaagggcaggtgggaaatacttctttctgaaggcatgggccagatttctctttctgcccagcagttagaggtctactgaataagagatggtcccccgtcccatccctcccagttgcttttgaactcctgaagcatagctgaaacagccaaagtcactttaacttgttccctgactgtccattcaccctttctagtggtagattagcaacttctattggctggttgtcaaaacagtttgtgtcccgatgtttgaaaacggctcttgtctagaagagaattaacagggagatcaataacgacaggtgacttttttttccatttgccagaacgatgccatttgagaaaccagagggttaagtggtgtttttaagttagtgaacatatccagaggtagaaacgaggccagcctgttgtccagtctacctcccacctttaaacaggttttcagacacccgcagagcagagccagggaaaaatcccctgccggctttgctctctgaatcacatgagactggtgggaagtggggtgggtgtgtgtgtgtgtgtgtaggggggtaagggtgggtaaccaactggaaattatgggatcctagggacttttgagctttggttgagtgcttgcacgataagcaaagttttcttcttgtacagattgttacgctggagccttatctgtgacacccaaacatcagctcattgggtcaaaaatcacttgattacctgcaatagatattttgtctacagaaggccagacatcttgatggagtgagtcttttggctgggcctttctgtgtttgatagataaaagccccaccagctctgtctgaggttctaccaaactgatgtagcattctcttttctggactttgctgtgtctgtccagctactgcacaacgctatagctgcacactctcatgcttgctcacacttgcttacacttgccctcacacatgccctcacacatgctcacacttaccctcctatgctcacacaggttcccccttgctcaccccactcacacaggtctgaaatggcatgttcagcgttccagtcacataaccaacccctggccctcagacccacactagacactgagattgtttctgtgctgccctaccttcccacagagttaagcctttcgggcctcctgtggcgctttcttcatccttgctgaggaatgagtgtgtatgacttggtgtgcaggcagggggtgacagtatatctgcttagtagggatcagacacttgaaatttgctcagaaatagttgcattacacgcccagtgtgcaatggctgaaattcaggcacattcatgcttactgttctctgagatctgaacaaaatcaaattgcactgagcaaggatagtgctcaatcttttgttctttctgacaactaaaaattaaccagcggttgtttacttccctatataattctgtttaagagaatctggaccattgagacaccaggcttaaaatgttgtattaagatataaaagtaccttactttaaaaatagatttttattgatttatttcaaaattgttctgtcagttatatgtacaaaaaaaaaaaaaacaaaagaacgctgggcacggtggctcatgcctgtaatcccagcactttcggaggccaaggcgggtggatcacttgaggtcaggagttcaaaaccagcctggccaacatggtgaaaccccgtctctactaaaaatacaaaaattagctggcgtggtcgcgggcgcctgtaatcccagctacttgggaggctaaggcaggagaattgcttgaacactggaggtagaggttgcaatgaggcgagattgtaccactgcactgcagcctgggctacagagtgagactccgtttcaaaacaaaacaaaaaacaaaaacaaaaaacactggcctaattacctgtggggtgtataaagaagtgtaatacaaaacccttggcttcatggtgcttactgttttttaaaggccattggaattttgtttccttcgctttttttttttttttttttgatgttgactagttttgttgtcttttttttttctgagtgaaaaacgaactcatacacatagtaaaaaatccaaacagtttaacatggttttatgtggttttgaaaagtgtgtaaaaattttagtttggggtaaaccaaactaaaatttaaaagcctagaggggcactttaaaaaatgcatctgttggtgaatacttttaagtggaaaattcttttctagatgagaatgttgaaagctcagatttgtggggttatgagctcaggttgcatatgctgttttctgaagatggggtacccttcttctctcaggtacatggagaggatctttctggcaagggctcagcagctttgagatctgggaggaccccgagtcatttattttgggttctgggtatgactgatctgtttggggatgaggaaataaacactcagaaagtcaaagggaaccaaggacacactcatgggctctgcttctctagcttagttttctcctctgaaaatgtgggtattgtatgggaatgatctcatggggtcatctagttctgtctgtgactatgtaattgaagacatctgatttaaagcctagtgtttgtattagggtatcagaaaatgcgacaagacttcttaggtgtgggtttccggcactgaggccaaaactgggcacttttacttttgtgcttttgcttgagaccaattgattgatctgcctatcttctatctctttgccataagaaaggctctttgtaatttcatactgaaaaagtatcatcaaaataaatcatcagtaccatacctaagattatcattaataattagtctggtggtagagacagctggtaggatgccagaacattaacctgaacagtaaaagattcattctgtttaaaaacaaaaagcagggcattgtcccccctcagatactgaagtctagaaactgaggccttgcccacacagagccaaaacatcacttcaaagaccttgtcttatcaaagataaaagtattcagccagcttaaaacattttcaagtaaaggtgaggtatacagacaaagagagattgattctaagcgttgctacttatcatgcaaatgcttagactttgcaaaacatacagctcaagactcacccgcttttaggtactacaagaaaacattaaaccagtcagtcggtgtttttagagaaatatatttgaggtgttacataagtcattttcagaatttttgtttttaagtgctgaattgctacagagtcacttttctgattttgttggcacatacctgttaaatgcagttccagattagattagtactggctagtttatttatattcctaggagtattgacaacattgtttaggcttattttattttgtcaggtctcaatttagttatctaaaggtagaattttaaggtatttaatggaaagaattttatatcttggtggaaaaaaaactacagactttggataatcaggaggtggttcagaattaacttgggaagtcttctaaagcatgttgtgatcgcagcctcagggtagaaggttctgtggattttggtgggagaggagaccttgggatggtaggtttatgcatatggtactctcaactccatgacaaggccttgctgtgatttttcttttcctcactgggtagaattggcatcatgaaagatgtatttttcagccatcaggggagctcattgttaacaaaagtcacaccaaacccaactatgaactctttggtaatttgaaaagtggagtggcagctgcctgtttgggattttgtattaccagttctaagatggttgcccttcctgtgttaacttaccaaaccaagtgacgatggtgctacaggcagtcccaaacaacatggagcagaaacaatcagcatctccttcagacccatgggtctggtccatctgactgtggagggctaccttggtgatctggaagaatctgctgacctggtcccttgaccttgtagtcaaatttgactagctaaagttctgccagacagctcttcattttctcactgggcccccttcattcaccccaactttctggtgaagacagcagccctgatccatttttccaggagtaaactattatcttaaatacagttcaagtctccttggttgacagacaccataaatatatatgatctcattaggaagttaggcctctgtgcttcctattaaaaaataacaaaaactaggccaggtgtggtggttcatgcctgtaatcccagcactttgggaggctgaggtggatggatcacctgaggtcaggagttcgaaaccagcctagtcaacatggtgaaacctcgtctactaaaaatactaaatctactaaaaatacgaaagttagccgggcatggtggcacacacctgtaatcccagctactcaggaggctgagacaggagaaccacttgaacccaggagttggaggttgcagtgagccgagattgcaccattgcactccagcctgggtgacagagcaagactctgtctcaaaaacaaaaacaaaaacaaaacaaaaacttttcgatagcttccataattaacagtatcgaaatctgggtctgggacaggctttagagctcatttccttttttttttttttttttgaggtggagtctcgctctgtcacccaggctggagtgcagtggcatgatatcggctcactgcaacctctgcctcccggattcaagcaattctcccgcctcagccttccgaatagctgggactacaggcgcatgccaccatgcccggataatttttgtatttttagtagaaatgggttttcaccatgttggccaggatggtctctatctcttgatcttgtgatactcccatctcggcctcccaaagtgctgggattacaggcgtgagccaccgcgcctggcctcatttcctttaatatccacattttacagaggaggaaagcaagggtggaaaatagtcaataccattacaggacccatggttacacccttcaactaacaaacttcctcagtggataagctccttactcgcctttgcagatccacctcagctttgaacacagtgcatgcttttaaagcatttgttaaaggaatgggtgaatgaatgaaggagagaaaaaatccctgctgcattatctacccataaaagaaatacagaaccatctggaaggtgaagaacaaagaaagggaatcaagccctgggaatgcaagtttgttgcttattcctgtgactgctgccacagggataagggtgctaggcttgggtttaggagacttgggtgaaattccagtctacacatggctagcaagctctctgaaaaatggggagagtaagtgtgacctcatggagtggtgagcgttcaattatgtcatgtttataaaagtgcctagcactgtacctggtacatagtaggggtgtagtagtagtggtttccttttgttcagttgcagggttggggattactttaaggcttagactcaaagcgataggaatgaattgcttggtcagcagaagtgcacactgcacaccagcctcaagggacaaggtcaaccacgacacgtttgcaaagtgtttgtgcggggaagaccactctgatgtttcttacttaaaggcagggtcttccaactttgtctgatacggaatgacttgttacaatcatttcacaggcaagccaacactcaggcttttgactaacttgtctggcgtgtttctcaacaactccattaagaattcactgttagaaatctgatcttttctcctctgttgagctttacttgggcattttattgatttgatatcacttagtagaaacccattcaacaaaaggtatctcttcaggccactagtcaatacagcattttttatttgctgagatttttacttctattttgccccacatcagctggtaagttttataagtaagcaaaaagtaggagctatagacaataaggaagcagaatgaacctctgcaattcatatttatgtatgatttcacttggagtgggaggagatgttttttttccccatctttgaataagtagaaaaacatctcacgtaacctggggtggtggtggtgaattttcagctgaagggaatccttcctcgtgaagctcactgctatcctgttaatctagcattttacttttgtggtaagattctgggtggaaagggaaaatgaaatgatacagcatctcaaacataggca[450 bp omitted]aatctctcttggtatgctgctgagttggtgggacctgggcaattacaagggaggtcactgcacccccaggcagttcccagcaagtgttttttccaatttcactgacattctttccgggctcaactcaatttgttttcaacttctctatggcaattgatgactgactgtgtaattcagcaggatctcctgtgaagtgcttcttccccagttgaataggagctggtgtttgtctaagcctctgcttatgcatgaggtataatgctttttatatgttatataatgctcttacgcgttagctatctgaatgatagatttaataaaatatacctcataatattatggggaaaggatgacgactgttatagagaggaacttgggagtatcacttctgtaatccttatctaacctgaatctgttagcaggaaactgaaaaggcctgtgtatgacaatgagataaacaattttaatctcttagcaatgtcaagtggaaaatctaactacctgccagtagtttaagaaatggctaagagattttgttgggcacaaataatcctgagacccagattgctgagccaagggtaggaaaattggttttgctatgtgttacagctgggaagtgagaaggtcactgtttgacaaactactaaaaaaaccttatggattaaacattcgccagtgtaggggacattttgaatgtgttataattgatattttagtctatatgcggccgctgaacgctttttcttttacaaaaaaaaaaaatttatgaatttgagacagagtctcactctgtcgcccaggcaggagtgcagttgtgtgatcacagctcactgcagcctcgatctctccagctcaagagatcctcacacctcagcctcccgagtagctgggactacaggctcgtaccatcatgcctggcttattttttattttttagtagagacatctcttgctatgttgcccaggctggtctcgaattcctgagctcaagcgatccttccaccttggcctcccaatccgccttggcctcccaaagtgttgggattacagctgggagccactgagcctggccttctctttttcttaacctttctccttcatcatcatcatagtcatcacagcattaaacactcattaatattgaccatctggctaattgcaagtagttgaggagactcaagacctcctctgagaatgttttttgtgcttaacaagtgaacgtgcttgaaagacttgtgactctcagatccagcacttgacctcattgggcctctttggacttgggtatcctcaatctgtaaaatgggtatattgatagtcttcctacctcatgtggtctttgtgagtccaaataagacgtgtatacagtcatttggggacagtgaattatttcctgcctaaatgagtttttaattatgagtacgatgactttgcttttttacaaaaagaggatggacaagggcaagcactcactcatgaagagtattctgaccttgttgcttgaaaagaaattgctaaggactatgttaaaagcaatctctgcgtccacagcagagccagttctgaggtggacggagcagtgaggtcgggttgggatgaggagatattctggataacgccccggtttcacttcagccgcagcatcgtctcctcttgcctgtgtgaccatctcggccattgtagactgtggacgcagcctcctccggctgtggtttgcccattcgtcagtgggcatgcagatgtaacagacaccagggaaggctggagtgagcaaggagggggccccaaagcaggggtctcatgctccctgaacagggctgccagctgctgaatcatgatagggagactgcactgcactctagagtttgagggtacttaatgggggcatggacttttccagtaccttgagtggttttctcttctgtgtcatggaaagtgaa[450 bp omitted]tgtggaacagggagtaaaggaactggatttgggcaacagcctctagggaaggagtctggggtaaaggtcttgaggaatttgctccctctgttagaagtggtagatcaaagagactgttctggatccagaggctcacggaggctggaatgaaagagggcacccctgccccagtacttgatttggagcgttggattctgcacaaattgatgctcagcagttgcacagtgcagagcccagtcagctgcactgttgctatgctctcgggaggaccccgattgaccagaaggacatggtcaggagagctcggcaggggtttttctgcttagtacacgttatagagtcttagctatggaagagctctagggggaggggaagaaccctgaggtgtagtcctgggttgagtctaaactctgttacttcctatctgtgtgaccctagagaaaactttctgctcctcagttgcatcatctgtgaaatgtgactgataatacccaccttaaggctgtgagccttaaacaaggtaatgtgggaaatgcctagcacagcgtctggacatactaaatgctcgatacaatagcatggacctcagaggcagctgtggtgtcatttgttagtattttatgccgaacctgcgacctccaccattctctttgattgggtgagagtgaataagggtgtctgaggcagtgttgctgacttcttcccttggaagaggagaagtcatggggtctgggagctctttgacattgaggtttgtaggaagtgtgtgctgggggaggcttgctctgctgagcacagaagcaagatggtctgctggggagtgtggagcccgagccagccagacctgaacccacaccctcactctgtcctagaccttggcgtgggctgaacatctctgagtctcagtgtcctcatctctaacatgaggataatgagcctctctcagggggtgctgtgaagatgaaaggagataatgcagctcaagtaccgggtgcagaacaggggtggaatagaggacacccctccaccagttgtgaagagcgtttttaagtggatgccctaatcgccttcaccaattggctcgagtcacgttgtcccaagtacagctaattgtcgaagatgatgacaaaacaggcagcaggatttatttttccagggaggttctttagttgcaggagaggcctcactttgttactagggattggaacttgaagtttaaaaaaacaatcccctgtattcagctgccggcaagaggtgtcaggttacacaccctggggaccagcctctttttattctgttttgtaggtggaaactggctgaggtcatccagacacaaaatgcccagcatttggggtgtgaaagcctctgtcccttccctcccttccccttgttcctctgctttcttggtgcatcttttagagtcactgtagctcataagagagccaatgaaatatatacatatatatctctctatacacacacacccacacacacgtgtgtgtgtagaacaacactactctgtatcggtgtggcttttcttaccaaggaggtctctggacgtgtgtgatttaattagtcttcgtctcttctctgtgccgcatctggtgccaggccaggcacgtgcttattaacacaggctctctctgagattaaggagatgttttatcttactgcacacccagtgaggcccgtcacgtgtccattcacagggactcaggtccaggtggctctggggtctctgaagtacactgtgcgtcaccctggcctcctcttgaagtgagccacagagaacctacccaggacttcccaagtcacaaggccatactgtgcccttgtcatctgggctgggatggtggagtggaaggaaaagccagtcaggtgactggacggagctgatgaaccccgagcacaccagctcacttccaagtcccaggagggcctactggaacccatgcaggatccgggctggatggctacaggttccatctgagcagcacggactggcgtcaccacagccctgggcatcctgcctgccaaaccctggtctctactctgctacacacaggatgtgtgaaatggaactctctccttcctttcagctgtaatgggtggggggcagggggagcaggtagcctgcagggttgacccctgggggtttgcatcttttctgtccaggatgatctattcaaaccttttctagccccaggacccattaggcatctgtacagagcttccaggctctgaatgtgcagttttgagacgttgcccctttctagacatatgtgtctcaggctcagcctgccctaacacctccccaagccccagtttctttctgccctttgcaggatgaagggactgatgtctgggaggattgaaaccacgaaaggagcttgttagcacgtggcagtgttgacctcaggggtggtctgatggcgaatgtgctggacagtaactcccttattgccccaacctggaaatatacacagaatggtaattagtttcgatctcagggtaaagccatatggagcagcgtctgggatgctgtttaccttgcggtattacactgtacattaaaaatcagctgctctctcctgagagccgagccgtctcccgcctctgcagactgctggttaaccccaagaagctgaacggagccctgcaggttctgggtccttcctggcatcctgtctttggcattttgaactggcctagattttctggtcagtcaccattggcctcaaataccacattcccaggggaaggcaggagagtctcctaggagttggagtggcaaggagccccaaggatccatgttgtgcttgaagggcgagtgccctgaatgtaccaggtggcaggttgctaggaaccttgagcctggcctctgactgtagtttgggaacactgactttgcaaagaagacttgagcaacttcagaaaatagtttatggctgggtgcggtggctcatgactataaccccagcactttgagaggctgaggtgggtggattacctgaggtcaggagttcgattccagcctggccaacatggtgaaatcccgtatctactaaaaatacaaaatcagctgggtgtggtggtgcgcgcctgtaatcccagctaatcctgaggctgaggcaggagaatcgcttgaacccgggaggcgggagttgcaatgagcccagattgtgccactgcactccagcctgggccacaagaacaaaactccatctcaagaaaaaaaaaaagaaagaaaagaaaagaaaaaaaggccaggtgcggtggctcacgcctgtaatcccagcactttgggaggctgaggcaggtggatcacctgaggtcaggagttccagaccaccctgaccaacatggtgaaaccccgtctctactaaatacaaaatattagccaggcgtggtggcgtacgcctgtaatcccagctacttgggaggctgaggcaggagaattgcttgaacctgggaggcagaggttgcagtgagctgagattgcaccactgcactccagcctgtgcaataagagcgaaaccccgtctcaaaaaaaaaagaaaatagttcagtatgaccccatgaccagatgtcataaaagggaacataagttccccataaaggtatttaaaagtcagttgcccaaaggataggatggaggagtcctggctcatcaatatttcttttatttctttttttttttttttttttttgagacagagttttgttcttgttgcccaggctggagtgcaatggcgagatcttgactcactgcaacctccgcctcctgggttcaagcgattctcctgcctcagcctcctgagtagctgggattacaggcatgtgccaccacgcctggctaattttgtattttttttttagtagagacggggtttctccatgttggtcaggttgggctcgaactcccgacctcaggtgatccacccacctcggcctcccaaagtgctgggattataggcgtgaaccactgcgcccggccaatattttattttattttttgagatggagtcttgatctgtcgcccaggctggggtgcactggcatgatctcagctcattgcaacctctgctgcccgggttcaagcgattcttctgcctcagcctcctgagtagctgggattacagacaggtgccaccatgcctggctaattttgtgtttttagtagagatggggtttcagcatcttggccaggctgatcttgaaccgcgtgatctgcccgtctcggcctcccaaagtgctgggattataggcatgagccaccacgcccggccgcgcccggccaatatttcttttgaaattcactgggagttataattttactaccagttcaatatgaattaacaggtggtacggctgtaaaaaatactaaacagtcttaggatgcacaataataataaaaataatagcagcaatgatttcagaagtgcctattatgtgccaggcatgttccgtcaaatactttatgtaatttttgcagggcattcattattttcctccttttagagatgaggatgagacatataaattgttagtcccaagcccacagctgatcaatggcaggactgggattttaactcatctgaatctcccaagttcctaccctgtcctctctgccacccatcagctgtcgcctggagaacagaggaaggtggctttgaatttagttctgggccttgtgctttagggggactggggactaactgaactgaatgcagaggtggatgggtggagcaatggggcctctgaaccacagccctgggaggtggctgagggaattaggattggttgttgccgtggaaatactggaccccgggggaaagagagtgtgttcacataggtcccctggagtaccgttttagtctagttaaaaattttctacttgaggaggtggaactaagagtggattcttttccttataaatgaatgggcctttgtttaaaaaagggatgtaatagatgcaactgcagcaaaagtgagctcctggagctgcctccttaggctgatgaactggaagagaactcttaaccctaaagggcaggaaaaggttaaagctcctcattgctgcagacatagcagggcaataagcccctgatagcagaaaaggggagcaccccaaggcactcactctgtaatccgggtccccagggactcagcctgcctcccacagggagaagggcagatctgcccacgggaaagagggtttcagcagatacagagcatggatctgcacgtgtccagatgcctcaggccacccagagagagcatcgtgggcctctgtgctgcgtggggcttgctaggtactgctatactgtgaagcacccaggcagcctggagctgcacggcctgcgcatgagtccaacaggtacaagctgttgtgggcttataatgtcagcacctaagcaggaattgaatgcaatcgagttgagttacctgcctccaggtaaattaagttaaatcctcatttaaattaggagacatgggtgagggcctaaaggggccaggacacagaatgcccaggctttcaataggtgatattctcaataggtgatagaggtgaagggtgtggcacctccctggaaaggagcacagctgcggtcaccaagtgaggctgtggcctccatcgtaaaggccatgtggggcggcaagtgaccgaccacagggcacggtaagtcagcagggagcgaccaccaggattccttaccaaagttggattcctcagtctctgctatgctaccctcagagattcagattcaattttttgttttgttttgtcccgctctattgcccaggctggagggcagtggtgtgatcttggctcactggaacctctgcctcctgggttcaagtgattctagtgcctcagcctcccgagtagctgggattacaggcgtacgccaccacaactggctactttttttgtgttttttagtagagacggggtttcaccatgttgcccaggctgatctcaaactcctggcctctaagtgatctgcctgcctcggcctcccaaagtgctgagattacaggcacgagccatcgtgccggcccccgattcactttttaggaggggacatctgtgtcatttccaggtctggctattttgaataaagcagctgtgaacattcgtgtacacatttttgtgtgatgtaagccttcatttatttgtgataaatgctcaggagtgcagttgctgggtcgtacagtagttgcacattcatttcatattttacgaaactgccacactgctctccagagtggcttcaccattttacatcccacagcagtgtatgagtgctgcagcttctccacatccttgccagcgttttatttagtagctaagtagctacttttattttagccactctggtaggtatgcaggtatgcaaggccatctcattgtaggttctttctgtgtcttgttttgttttgttttttttgagacagggtcttgttctgtagcttgcccgggttggggtgcagggggcaatcatggctcactgcagccctgacttcctagattcaagggatcctcccgccttagcctcccaagtagcgatttataggacaacaggtatgcagcaccatgcccagctaattttaaaattattttgtagagatggggtcttgctgtgtcgccaaggctggtctcaagtctcctggcctcccaaagtgctgagattatgggagtgagccaccacgccagccttcattgcagttttaacttgcttttctctttttttttttttttttgagaagtcttgctctgtcgctcaggctggagtgcagtggtgcgatcttggctcactgcaagctccgcctcctggtttcaagtgattctcctgcctcagcctcccaagtagctgggactacaggtgcccgccaccacacctggctaatttttgtatttttagtagagacgaggtttcactatgttggccaggctggtcttgaatttctgaccttgtgatccgcctgcctcggcctcccaaagtgttggggattacaggcgtgagccaccacgcccggccaacttgcttttctctaatggctggcgatgttaattttttcactggcttatttaccgtctccttctgtggaatgatctggcttagaaaatgaacaattccacagaggtgctataaaaacgggcagggtgtcaaaagccttggcctcctgtttgggctttgcctctcagggcttcaggtgaaggtgtttggtcatctctgaggtcgcttcctgctcccagtgtcctctgactccaggatagagtcatgccccttggcgggcagcccggtgggagctgtggtgtgtaggaggcccggacggcggcccctgcccacatgccatcacctcccagctccgtctccacaggagcttacccaggctgactcacaggtgctgtattatttaaggaaagttgtttattgattgttggggcctggaaataaaaagaaaaacaaagaagcagatgcagagtgtctccttgccacctccctctgggcgcctccgagatggtggctgaggaccaggccccactctgggtgaggcttcctttccgccactggtgcttccctttgtctctctgcagcctgggcctgtgctttgggtttagttttgcaacatagtcatgctgaaggtcccagagatgcttcccctttttattgtaattaagccaaaaaagaaacatggggtatgtaatttagaactactcataaccacagagatggaaggaattttctctttaaagctagcactagatttcaccttgcaccctaggccacttgcccatgtccttgccatcttttaactcctgtctcaggagggggcagcagaaagtagtcttgagagttaatgggattgctactagtttgagtacctgcgggaggatttggtctccatcgagaaacaggggaagatgtcatctgcttaagaaggtatttatgtttgtttttctgcccggtgatatacatgaacccggtagtgtgtgaaataaagcatcttagtcctcatttcagtgaatcagaagaaactaaaaggcatggttatttctccctcggtatgatgaagtctatataatatttgcaaaatctcctttggtgaatttgtataaacaatctatcacaaagaaagtattgttttctatatgggcttaaaggatttttggaaaatgggcagaggattttcccatgtattccctgagcctggggaatggaaatcatctcatggagacagatgaccacaggctttccacccagtccccgtggcccactagaattgtccagcatgtttcagtggttatttgattgggctcaagaccaaagttggaactgaatcaaatgatggtttggttcagaatatttttccgttttggtacgttttgaaaacctaggtttgatgctggttgcagttgttcaacagattttttaaaaaaaactttgagtacaacacacactgaggccttttgcgggtggaggtagggaaagcatcaggataaatagctaatgcatgtgggacttaatacctaggtgatgggttataggtgcagcaaaccaccatggcacttgtttacctatgtaacaaaactgcacatcctgcatatttatcctagaacttcaaataaaataaaaacattttaaaaagaaaataaaaagagaagatttttagaaaaaaataaagaaaaagattttagagccacagaatctctttttagagtatgggaagaacagaaattctctgggtagagcaatttttgacagaagatgatttgggtttatatgagatatacaaaactattcttacgcatttttactgcatgccacaacttgggatttcttagtattttccacatcaaccacactactttaagtcgtctggttagaagtgtatgaacatgttataagctcagaaaatggcatgtaaaagcaatagagggccaggtgcggtggctcacgcctgtagtgccagcactttgggaggccgaggtgggcagattgcctgaggtcaggagtttgagaccagcctggccaacttggcaaaacctcatctctactaaaaatacaaaaattagccgggcattatgacgggcacctgtagtcctagctactcaggaggctaaggcaagagaatcacttgaacctgggaggcggaggtttcagtgagccgagatcttgtcactgcactccagtctgggcgacagagcgagacttcatctcaaaaataaatacataaaaataaaagcaatagagtattacagtgtgaatcaggaaatcttgcacgttttgaaggtttcaaatgacttggtttaataaagaaagaaaacttgtaatacctagaaaattgacgttgaatgggaaaaataaaacaaaatattgctatacaaaaacctcttgttacattcctgactcaatctgatatttgtgtttggtttatttgaatacataaaatatattatggccattggtgagtagttagttcattttgattcaagttacttctccagatggcatcattgttataaaatttaatttccgtgaacttacattcttccaggatggttgtgtgtgttgatcttctggtttcttaaatcttctgggtcagagttactatacttgcatttgtgcttcgcaatgaactagaataaatactttctattaaaaccagcagaggttttgctaaagagaatgcacgcacaggccttgtctttttggtgcaaggtagagggttttatctactacctgcgactaactagctttcagaaaagagtgaactaacgctttacccatggagttcacaaacgttcatggtgtactggcagtagggatacatgtacaagcatagcttagttcctaccttctagggattcgaagtttagtagaggaggcagattgtaatacctaatacctattatgcttttattatgtggtagtcattgaaggagaagttaagtgacatgtctaaaatcatagtaatagaagagtcaggctatgaaccaagatattcttagagtttctcatcgttggcatttagggacagatacttttcagttgtgtggggctgctctgtgtactgtaggatgtttagcagtatctctggtcagtagcacctccccccatttgtgacaaccagatgtctccagacattgccaaatgtcccccatggggagaatcgcccctgattgaaaagcactgctctagagcctgctcttgtgcccaccactctgtactgtcttcccagatgagtgaatgctatgggagagaataagcatgtttacagtgtgaagtcccaattcctgctgacagcagaggacagatgccaacactacctagggtggtggagaagagaaatattctcagatatggtgccattggagttgaattttgaagggattcacgtagtcagagaaaaaggaagactatctggagtaaagggatgtgtgtgcacaaaagcatggcagcaggaggaagcagggcaaccttgaggatgacaggtagttttctatagaccctttaatttactcttcagtgctgttctcttgtttcctctgttcaaacagcaagccagggttacagcagctcttcatgtcattcttacttcaaatcaaaggtgttgtgttagtcaggatgagctaggttatgttgcagtaacaaacagccccagaattggcagcagaaaacaagaaaggtttattttctgctcatgccacatacctgatctgggtcagctgtggtctcatggtgctggttactgtacagagggaatgagaacatggtgaatcacatactgacttgtaaagctacattccagacaagcaacacttaccacttctgctcacatttaattggccaggtaagtctgctgtcctcacctaattttaaggggccaagagagtagagtcctaccatgtgcccaggagaactagaaatatttggggacagcactcaggtgtaccatagatgtcagaggctcatacctgaaatgttcaagcacacacaactcattgtctgctctctgagagcctcctagcttggctttcaagaagggccctttgccatagacggtcaagattttaaaaaatatcaattatctgagtaagtcaaggaaagtccttgtgggaccaggtcacaagccctcagtttttagagtcaggatgttggggtgggagtgatagaactgattgaagtcaatatagcctggatgtggtagattgttttatgtggaggggtagttgttcaggacactgattgttatctgaacacccaggatgctttctttggctgtcactgtagtaaaaagaacagttttaaagcctgagccaagtgtcaagcagcaggagggtgtccttcgtgaactctgaatttatggggctgagtctgagagcgaagagatgccaacagtagcgactgagaacattctggatgattttagtaaaccccgaacaaattccttatacaccaaggagcattctccttgttagaaattcctccagaccacgactctggccctggccctggggtgaggagatagggtgcctggccgtagtggatctaaaacgggatgacaccggaaacctgtggggaggacgccgtccttgtcgccccttgacagagggggcacagaggccttagagaaacaaaaataaaaatagcaattgtttgccacttccctccctaataaagtgttctctccaaacctggtttccactctatttctgaactgtttcgccccatggtgtgtaggaagccagggtaaatgtgggagtgggaggaaggggacacaggcagcaactcaaaggaaggcagaattagtagccgtctgggaaccgggggcgggggcattctagaaatgcgaagaggtcgaatagccagctgggtccggagtctcctcacctctggtgtcttagcggagcatgagtgtgtatgtatgtgtgtgtatatgtgtgtatatttatttgcgcatatgcacgtgtgtatgtgtgtgtgcatgcatgtgtgtatatgggtaagtgtgcagtgtgtgtttacgtgcatgcatgcatgtatgggtgtagatatgtgggtgtgtagataagtgtgggtgggcacatgcgtacacccactggaggggtgcgatggaagttgtgtgcagctgcgtgagcgttactgaccatcctgtggtttgctgatagctgcttaatctgggttgtgtgtttcctccctccccaagcagacactcagggtgctccgtgatgcaccgggacgctaatattttcacacctgcaatctgtattgttcttttctccttcggagagcaatattgcccttctgggtgcttaagcaggaaacacaggaccagataatttaagaggagccttaatgctcagggccagaacagacagacgggcctgaacaaggtcacaggccgtccagggagtgcagggctagggcaatgccagcccacttccttccagccgagcgctcccttcacggtgaccaccttcccttcaacgtctttgtttcccggctgtaaaatgggcatgttgcatacagctatgtaggaagtgtttgcaagtgcccaggctctgggaatttgagtaaagaaggccctttgtcagtggcgcacacagcctcggctttcttcaccttgtcagttgtccattcaggtggagtagctatgaacacccacttacccttcacgtatcctaggatcaggactgtgcctgcagtgaccacgaaggctggggagccagatggctatggacctcacgagggcctgccagttcccaggaagggggtctgggctgccaggacagggggcagcagcaggactcagagagaggggttgcctcgcagtgagccctgcccatctctcgtgcggtgggaaggtggtttaaaccctgcccttaccccatgctctgaggtctccggaagacacaggtgctatatataaaactaagactattatctcactcttgctaagtttccaccctcgcggcttactgtacaccaccggggagaacatttcctgaagcccttctcccggagctctgaggccagggtgagggacgccttctgagagagaaaaccttccccgcagggaggccttttgcagaacagggaggagaataaaaatgtccaggcaaatgcccaacctcaccctagtgagcttcccactagctgagctggggaccaacatggtaccagcctacagggaagcccctcatcttcccccttttgccttttaacatggagtctctgggtcagggatggacacggtggtgagggatgctaagtatgagcagacaccctagtgggttcagctcaaactccagaggggatggggatgggcaacactcctgaggaacttctgttcagcactcgtcatcgccaggacaaatgatgggaggtccaggttgggaggtttccatttaagcgttggttccttgcaatttccctgggtagttttttcaaacaacccatgattgtcattttcggtcggacgatccccattgtttgggactgtccagcacactgaaggtcactgagcatctgggcatctgggccttggagcactatttgccattgtgcaacatacacaacacacacacacacacacacactctctctctctctctctctctctctctctctctctctttcaaaacaccctctagggctggaggcaggtactgcatctggttaggaaccactgcaaggaattatttaccttggcaacatctcaagaggatatcgaactggagtcaaaggattttggggaggtggagtaggaaggaggtagaggatgttaggctgagaaatgtcctgtcagcttggacatggtgttggccaaatttttttaagtgaagaattttcattttttttgtcctatttatgagcacccaattgactgagcaccctcagttaattggagaatcttgtgcattttgtttggctttgttttcattctttcttaataagaatgtcttaataagatgtctcttaataagcactattacctgtggggccagcttcatgaatgcagttgcacaggccgcatgctcagaagggccctgcttttggggttgaatgcctggcccattgctgccttgaaattcttaataattctttgagttggtgtttgtaagtgaagtccagtgggacaatgaagcatgaattctctgggctccagtcccacctgacttccttctccccacccctggcaactactgactcttctgatcccatcaggggcctgggtgaaggttcagggagggatagagttggcgtcactggtgtcccaaggcagggtgtggtggccatccctaccccaggctggcagggccaaaaagtggacaactgcatgagaatccagctcactccagatccaaataccaagcgtgtcccagcatgagtgtgtaatcgctttgggtctgcccaggcaggtgtgtgggaagaggggacctctctgctcctggcccagcacctggtagaggacggcagtagacgcttaagagtggccagagtcaaggggcgggatcccagcatcttgtgagactctgcactcattaaacagcaaataagaaacactgtatcaagttgagagaaaccctgcagaagaaaggaaggaaacggtttattttagtacgttttatggcacttttttcctgctttttgaacaagggcgctgcatttttactttgcactgggccctgaaacttacgtagctggcccctacttgcttacttcattgctatctgcagtttctgtttattttctgtctcccgtttctaaaaagaaataactagttaaaagggctcaccatgaacacaggtgcttccatttgtttccccctttctgttcttctgagggacattatcaccagccaatcaccagctgccccaccccagacttcttttccaatgctacctgttagcacggcaccttctgaaggaggccgtgagtcaggggagaggagacaggggcagggaagacagatttatctgtcactgggatgtggctgaattttgtggtgggtgggttgtgaatcttcccattagggagtgatttcttcccaggtagttatgagctagtgctggccccaggcaggatgctgtcaggatactagacagggaaccataaagcaaggttgcaagaaatgaggctctgctctcatcagcaagctttactaagggactctcttcaagcagggagatagtgctgcaccaaacaagttaagcactgtccttgggcaggagtatcatgccgtaagacatggcccaagagagaatgacagtgaggaaacctaattgcaggtcaggtgggcctgtagacagggacaggtgagggctaggccctgcccactgccgcttctcaccgttggtccccagtcatggaagtttcatatttagacaaaggaaggtcagggaagtatcacgtcttctgctttacctaggaagttcttgttggggggaagttggatgtcaggagccactgtgcctgcctctaccctagtcccctccacagcctgctgcatagtttccaagtgtcccaggaccgcagtgacacccaccccacccatacattttaagtgttagccacttcttgtctgttactataaaatgcacatcagacattcctagacccatcggagacctggagaggccagacactggacatcctcctaccactgggccagacacacccacggcagcccagacaggcagcccagggcaggggaggccatctctgtttctggatgttgctagcctggtgcctcgccagggagggggtgcagccagaataaaggcatgagacatactcatgctaaaaagtcacttgttgtttatctaaaatccaaacgtaactgggcatcctgtactttttctggcagctctaacccagaaggcagttttgtcacagcctttgtgaaatgggtgaatccagaaaggagacagctggtggcccagaggcctctggaggtcccctattgaggggccagacgtctggggctctgctgcccactgctgccacctgcttgctgtaccatctggagttgttctgaggcctggtgtaactcgtgttcaccagtgtcttcttccgtctcccttaggctctcccccagaatggaatacagtgaggggcctggcagaatactggcctagggcagcatggcctgccaggcctgcatcagaaagctgctcaggcttgctgcctcacgagttaagatgctgtcagctgcaagtatcagaaaactgcaacccagtagagttgaacaataaagaaaacacattctttcaccttgatcagtaagtcccagcacaggcagttctagcattggctaattcatcagcatagcagagttactgaaagacctgtgtcctctgcatctctctgccctgtctcacaacgtgttgactcatctttcctcgtggttgccagatgggtgctacagggcctcgtgtcctgtgtggaaatgataatatcccttggaggaaaaaggggatggctcttcatggtgtctaaggccgagacatctttttcagaaggctcccagcagatatcccctgtgtctcattgaccagaatgtctcgagttactcgtgcctaagtcagcctctggcatgggagtggcttataacaattagtattgactctgggagtagctccaaagagcatacatttgggtgggtctcagttaggtcccttgagctgttattctaccaacggtttgaggcaggtttgatttattttttgttctttttggtttttaacaaaaacttaaacattacagagaaagaagctaatgataaccatgactaaataatgataaccacgactaaatgaatgatttaactcattctaggtatttacaatcgttgtaaatccaatttggtctttgatcaattgcctaattttgttttacataattgcaatctgattgtactagttttatcttttattgttttaacgtcatttcatacagtaatcaactgtgtggtctgattcctgagtgtgaactttgagctactacatcatttacatcatcttactcctacctttggtgggtagtttccatattttgttgcagttattgccatatgcagccatgagtatttttgttaaaatgacctcttttcttctccctttagtgacttcttgggaagtgttcccctcagtggtactgctggggcaacgtccaataccaagaatgatgtatagcatatttcatcttcctacactactctctggaaagactgagccaattacggggtcatctgtaaagtctaagtgctgcagtttccctacgaccattggattttgtttgtagtttgatattgtcttactgtcccttgaagttgtaatttgtaattctttagttttcaagagggactctacatgtttccttgtgatgatggccttgagttactcatgtgtacactgcctatttatccccattgagcccccactgcccgaacatgttgatggcattttatatagtaagctgtcagttacttaatgtacaaatattcttccattccatgtttttctcttaaaattttactttattggccaggcgcagtggctcacatctgtaatcccagcactttaggaggccaaggcgggcggatcacctgaggtcaagagattgagaccagcctggccaacatggtgaaaccccgtctctactaaaaaatacaaaaattagccaggtgtagtggtgggcacctgtaatcccagctacttgggaggctgaggcaggagaattgcttgaacctgagaggcggaggttgcggtgagccgagatagcaccactgcactccagcctgggcgaaagagctaaactccatctcaaaaataaataaataaataaaaaataaaaaaagattgtactttatttggcaataatgtttttattctgaattattctactaggtccctttatttccttgtgaaattgttcttaattgcgctggcctggaaatagagcccatatggtactggagggtgatggtttttcataatttttcttatgcaaccacccttagtgatgagtccctagaggattgaactgtgcctcattctgtggactggactttttggaaacccctttttgagcccccaggaagaaatttggctgagagctgatgcctggatgctagccagctggctgctggccatatccagccaccccagtcccctggccatctgtgcacctcggcaacagagtggcgactgacacacccaggcccagaaagccagacagactggcggctggaaacttcatggaatccttgtaattagaaatggaaaagacctgttagctcgagtggtatcctcctcctcctcccacaggccccaaccagctttagaaggtgacatataatttgccctgtcacctggagcactcaactgagttttctgggtcttatctgtgaaatccaagagctggaccaaatcagtgttttttaaccccttttgggtcttatgccattttggaaagtggtagaaagccacacaccctttttccagagagaggcacatttcacaggccatgttgccctttcaggacattgataacaagaagcctgtctagatcctagcccacagtcttcaggtttggaacccaaagacttgttgatctctgaagtccctctcagctcagaaaacccacattctagaaagttttctgtcaagaaccctaggtatggaaatggataaaagggagtctcttgtacttaacttggaggaaaccactgtccagcccaatgggtttcactatcaagtatttttatttattgttttatcatttattattttccaggattgagttcaacttgtggtaccacgttctttcccatcatcttaatctttctaaatttcgtactgcctttgatttaaacaattgaactcttacaggtttgtggagtggaaatgggatttacttggttttgaccttcacctcacaggagggggatcatctttctggcaattcccagcagatactagcctctgcctgctgaccctcagcctcctcttccagccctttagcagcttggaataagaggcaacaaactggttgggttgatgtttatgtgaacatatgggtgcttgggagttggaagatgtgaggggaatcccttctgatggctctacaagtgctttcccagcactctgggcttgcatggttcccagggacttcagagtttctaattcctcaaatgacctgcctgacagggagtcctaagaaatgattcgggcctcaaagatctgtcctcaggggtcaggagaaaacatgcagtataagttgatatagctggagaggggatgcctgcaacctccaactgtggaggccagcctagcctcccggaatggggtggaggcagtcacagatacaagtctccttggtgggaaattgaaggtattcaggcccgtatgtgcccataggcacatctgcatatttggatttgacccaggaagcttggggaaggagggagaaaatcagaagctttgacatcattttttttttttttttttgagatggcgttttgctcttgttgcccaggctggaatgcaatggtgcgatcttggctcaccgcaacctctgcctcccaggttcaagtgattctcctgcttcagcctcccgagtagctgggtttacaggcacgcgtcaccacgcccggctcattttgtatttttagcagagatgaggtttctccatgttggtcaggctggtctcgaactcccgacctcaggtgacctgcccgccttggcctcccaaagtgctgggattacaggtgtgagccactgtgcctgaccgacatcaagttgtatgtttctggactctcctctcttcctctggccatcagaatgttctcacatcaaaaatgtgagatgagggataaaggaattagcacctaaatgttttacataatgttaggataattttgctctgtgggagagtggcctgaatgtggggagcctttgagtaactgacctataacttttcttaggcccttctggttttatcccagttactgatgctgttcttatctcctatctattctggaattcatctctgaacatttaatacatttggccaagcaagagcaatgctgtgattcttttaaaaagtacaagcttttgccagtacttctttcaagttgtaaattttatgaggagtttgttccactgtgcaaaggagcctctgactttaagaaaagtcattccagctcaagatttcaaatgaagtcgaggctgtgtgtagtcacaggttttctcatgtcatcggtagagataaaagcctcttagttttagactgggcacagcattgttgaacgtccattacttactgtttaagtagccaatgatctctgaaaaaagcttggctgtaaagttggcagaatgatgcactgctttgtttcaagccactgtaaactgtctttcccagtgtcacttttatctccagtgcttttgtcacatgtttttgctcatttccccaaagcggaaaaatattgcattccccagaatgacaattttcattgctgcccgctcaattcagtttttcataaatgcccaggaaataaactagctgagttattctccattctcacacatcttcattagcacacacgagaagcttttttacagggaattctcgtgttgaccaggtatgataacctgttgcaatgtgggtagtcttggttatattaatgtttttaaagataagtagtgttattactttattggtcatgtataattacatcggagatctaattattgagagttaacaatgctttgtaattggtattttacggcatgctaaacatttttctgaagtgcttgtactattaatgtttatattctttatttcgtagtcactcttttttcatactgtaaaggtaaacggaattcggcttaagattgaattatcaaaaattttcaggggtctaaacaaatagtatttagagtccgaccctcccactgtttgagatctaggaaaataaaagccttgggcggatgggtttcgggcagaaccgctacgctctgcaagctgaccgtggagttgggcacagtgtcatccaaagaaatgaagattttttttttattagctcttgaacaaaattaattaaaagttgttactcttgggggtgagggggacaaggaaagacaggatttgggagcctgctgacctacagttcaaccctacaaaaagtatacccattttgcaaatgaggaaacccagactgaaacacatcctttctcccaagccggaagctggcggccagcagcgctgagattcttttcgtaagcagcaacagcagcccccttgtctttcccgcctgggggagcgcaagccaggggtgcaggtcagcatttcaagccccgctactgcctctgctgcgggcccgctagcgctggcgaaggcgacaggggcggccgccttcccgtcacgtgaccggcaccgccgccgagcatgccgggagacggcgccccctccccggccgcgggcttccgcgcgtgggcggcgggcagagcgcgcgcgggaggagagaggaggtgggggccgggcagcgacaggggaagaaaccgcggcgaagaaaagccccctgtagagcaggccctgcttcaccgccctgcccgaaatcccccgccgcgcccctgcctcggccagccagcgtcgggcggtgggaaccgggcctgagctgagggcggagggactccggcgccgtccgttcattgtaaacaaatcgagtgagaaatggaggcacgcctggttcctgggtcccttggtgcaggctttcacaccccgggtgctagcactcggtctttctcctgcgtaggggataggattgtgtgtgcagtcaggtttttctagtaatatcttgcactttttttttccttcacccactcagacattccccatttttcctcataatcactttctttcgcttcagcatacacacttagcccttggcaggcaaagtggaatctcgggttcttgtcagacctcaatgtttaagctgctgaaacacagggcatatttggtttagatgttttactgttatgaaaataaaccacctcctgcagttacaccagctcagattttccctcgatagggtcagtgtggattatctattggaggaaaaatatttaattagaaaggaatgaaattctcttagttccttgaggttggaaggagcttaggcaaggaacagttagttaaaggtaagcacaaaaaatgccaggggaccaagaagccactattggaatgcagtatctgttggctgctggtttagcacactgccccaggcttcccggttgggactccactcaggtcctagactgacaaaatgggaaggcaccctcccaatgggtcttcattaccatctgccgaataaagagaataccagtagttgtatttcgtgcatttcttggagccaaatgattggattaaatctagtcccttactgtgcaagcgtagtcaattttggtcatctctctctaggcctagtgccagttgttgcctgcctttgtaaccagatagccacagtgaggtcatcagaagaggataggcagcgctgcagaagggaatcctttttctgtacctcaccatgatgaaataggggtagccgtcaagttgaactttccctttttttttttttttccgagagggagtctcactgtgtcgcccaggctggagtgtagtggcgtgatgtccgctcactgcaacttccgcccccctggttaaagcaattctccctgcctcagtctcccgagtagctgggattataggcgcccaccaccacacccggctaatttttgtattttttagtagagacggggttttgccatgttggccaggctggtcttgaactctagacctcaagtgatccacccacctcggcctcccaaagtgctgggattccaggcatgaaccaccgtgccgggccaagttgaacttttctcttgggggaataatttccctgctcaacatagacctggtggaattttcttgtctctctcttccctggcattttctctggtcttaggcaagcatttcctgccttttctgattccctctctgtgtgtgcatgggacttaggggaggaaggaggagggagttttctgttaagggagccgtgaatgagcaggaaatggctatttggtaccagttattctgcagaattagggagtgctgatgctgacaaggagtcagaaggattcagtcatcatgacatctgcagtcacaactgggtgggttagtgagcgcccctgaagtgtgtgtactcatttcaggcgcagccagcagcagaatttgggaagactgtcccacccctcctactccctgtgtgctgacagtttgctgtgtgcgtctccatggctctgtggagcttaagagattaagtccttggagaaaatgggtaaagtgaagttttttttttttttttttttttttttttgagacggagtctcactctttcgcccaagctggactgcagtggcgctatcccggctcactgcaagctccgcctcttgggttcatgccattctcctgcctcagcctcccgagtagctgggattacaggcgcccaccaccacgcccggctaattttttgtatttttagtagagacggggtttcaccgtgttagccaggatggtctcgatctcctgacctcgtgatccgcctgcctcggcctcccaaagtgctgggattacaggcgtgagccaccgcgcccggccaaagtgaagtttttaagtaggactgttgttaggaagatgttagcacagttagaatttgtaggaattctactgttggggtgtcactttctgttctgttgaaatgatacttcttccaaaagcaggagttctgagcttatatagcagacagccttgctgcggctcacacagaccctgcgtggctagcttctggtcagagtgccaaaagcatttgaagtgcctggaggtgtgttagcattagaatcagtgtcattgggtagctgggacattgtgagaagtcttgtccacgtctatagaaacagtttcagactgactgcttgctggtttctcattgaaggcaccgtgtgctccatgtagtgctctacgtaatctaacatccagagtcaaagcaaaagctgcaaatgatgacaaacccagatccagaaaaagacacaggccttgacaaggtggtgaatttcttctgagcttcccagcatctctttttgtgttctcttcctctcttgcttgaattttgtttgggcccccactcccttctcattctgataaaggtagaggggctcagaaggtggtgttctgcaggcagtgtaacctttgggaagaagaagcaggctctggagtcagagcctgagtttcaatcctagcctggccaatcactaatatcattctaggcaagctattttctgtgaaaacacttttggcattgggtttatgtgggaactcagcaatgtgtgtaaagcgcctcacatatatattaaatcgtattaatagctgtgatgatggttaatactgagtgtcaacttgattggatttaaggttgcaaagttctgggtttttttttttttttttttttttttttttgacggagtcttgctccgttgccaggctggagtgccgtggcgtgatctgggctcactgcaatctccgcctcccggattcaagtgattcccctgtctcagcctcccgagtaggtgggactacaagcgtatgccaccatgcctggctaattttttgtgttttagtagagacggggtttcaccatgttggccaggatggtctcgatctcctgaccttgtgatccgcctgcctgggcctaccaaagtcctgggattacaggcataagccaccgtgtctggccagttgcaaagtattgatgctgggtgtgtctatgacggtgttaccaaaggagattagcatttgagtcagtgcactgggaaaggcagacccacccttaatctgggtgggcaccatctaattagctgcgagtgcagatagaaaataaagcaggcagaaaaacgcgaaaagactagactggccaagcctcccagcctacatctttctcccttgctggatccttcctgcccttgaacatcagactctgaagttcttcagttttgggacttggaccagctctccttgcttctcagcttgcagacagcctattgtgggacctgtgatcatgtgagttaatacttaataaactcccctttatatatttatctatcctattggttctgtccttctagagaaccctgactaatagaatagcttagtgtttgtctgtctttctttctttttctttctttctttctttcttttttaattaatgaagctctgctgtactgggtgctatgaagaatatcccagaaagggctattctcaaaaagctgacagtaaagatgatactgactaacgttcattgaatgcttaatatgctccaggcattgttctaagtggtttgaatattttggcttatttagtcctcctaatgaccctgtgaggtaagtgctattaatatatctattttgcagatgaggaaactgagactccagaggtgttaaatgacttctcagttgtccaagaaaattctagtatgtgaacacagttcttcagagcccagacctgcctggccgcactgttgggctcttaactgctgtagtctacactgctgtagtataggctcacgcactggggaatctgaccgtgtcgtcagcagcccggagggtgcttggcggtgcagagatcctcagagatcatcctccaggtacacagccagagcagtctctgtcctgctcttgcacctttcctttctctatagcattgctgatgtgaccaggaggcattgccttcagccttcctacagaacagatagcgcactgagtactttccttctagatgagacttttctcagttggcctgataggaccttattatcagcatactagaaagccagggctgcttccttatgagaggtagtgggggtgaggggaggccagagggccatggagagttcaaggaacctggggaaaacttaaggcattgttcctgcctgccacctcttccctgtgtccttcatagcagttggtagagtttccaggtgagactggctttctagttctttcttgcactgcccagctcagccctcttaattttaagcaaataggtgcaacaggttggagagggtaccagcctgagatatgaccagggtagcagagctagtcttgtctggagactatcagcagatctgtgactatgcagtcagcaggacaggatgagaagccagtccagagctgagctctagcccagtggcctggagcagggagggctgccccatctgggatgctgctttccataacctcctgcagatcatgcctgtcctcttcctagtctgacctctgccaatagttacctaactttgaggttggcaacctgggaaaaagagtcttccatttttctccagcctctgatgacttagcaacgcctcattcatatataaatgaacaattcctgtcaccttggcctctgtcttttccagagatggtttagttggtttagtctggggagaggcaaaatgaaacgtgaaggcacacactttccagtcttacgattctgaaaggttggtcctcctctaattggcccagtgcctccatactctgatttaagagaggtttctcatccccctagcagtcagcatccctagccctgcccttctggcctctaaggtcagctctgctcagtccagaaatgagctgtcgtagctgctttagggatcttaaggagtctgtgacctttctcatctttcacatgaacagaaatttcctgaatatccactctgtgccaggcagtaggctaggtgctgtggaaacaaaagataaatcaaacagagcttctgccctgaaggtgctgtccaatttgggtgattccccttggccccttgacagttacactggtgacatttaggggacagaaaacaagatttgaaccggttgggcagacagattcaaagctgtccttcagtctacagtgctgttctgccccggggggagtgtccttccatctgtctggagagtgcagtgcataggactctgcctctgagttgagtggctcccagcctgtgggcagccagttgtggctgtgaccgggctgcccccagggggtttggctcctcttggggaccccttatcacccagatgtgagggcacatctgccagggcaggccacagaactgtggtgttcctagggcagctcttatgtggagagttctgggttggtgcagaggaccctagagaattgtctatttcactaatgccacctggggcaggtccccactgtcttcaccactaatcgcctcccttctctagctcccatagttgtggtgaggaaaagtggcttcagtgctcagcagagtgcttgggactgcatcaagcccagttcgcctatcaggtatgtttgatttcagcttattcctcagaagaaatggccagctattgtttgcagagttggagaatcacgcacaaagagattccctcacctgacctctgacacccatctctccagggatgatgagaaggggaaccagggccttccttgctgatgccagggctgtgtctgcatcacagtgctctcttgtctaaagggggaaattctgtttctcattttgcagcactgtgtattcatgatcttttcagatttgcttattggtgcagaaaggggaaagagtctaaagtttcttgaatctttgccagacactgtactatgcctctgaatgcatcatgccttaatcacgcctcacagcaactattgctactttcatctttcagacaaggaaacaggttcagaaaggctaaccaagttgtgacaggcacctagcctgaatcagtggatttcttcctggacccaccaacatttagttgacgcttgcccaggtttctgctttggtgaactatattctattgctctcagataagaatacctccaaattaacatgaatccatttgtttggtggttgttgatatgatttgttcccaagaggcctggatgaatgaacttcgtggttgtgacctctttttaattagtgatgctgtacctgtccttcctgtaggaagctgacatcattgagtgtgagctgtgtgctgggttttttcctgggaatggggacaggttgtgctaaccccccggcccctagtcgggtgctgcagaggacactcaggcctcaggggatggcttgggctacatcacctctgcagtgtctcagctctgagattctcaggccttagtaagtgtgatgagacacttaggaaatacttggagccctaaccagatgtaaagactgcgtgtgtgtgtgtgcgcgtgtgcgtatttcctcattgctggtgctagctgtgagttctatggagaaagccagccatcttagcggttgcttggtctccaaggggaccctgagaaatagcagcagctagtaatgctccaagctagtaattaatactccaactagaaattatgttctcagaaaacagtagaaaatacaggggccgggcatgtgccatttcgtctctaagttttggccttgtcggaagtggaagccggtgtccaagatagtaaaataagttgctatctacgtgccagggatgtacattataactaaaactagctaccagggagcaccttttatgggccaagcatctgtgttgagagagagatacatatacacacacacacacacacacacgtagatctatatatgtgtatatatatgtgtgtatatatttcaaattaagtctcacttaatcccataccaaaactatgagatagatattattatccccatttcacagatgtggaaactaaggcttagtgagattaagtaattggtctaaattcacccagctagtgactagtagagccagggttttaatccagcatagtgaattccagagattcccaggtaggggcattaatgggtgggtaatgggccaagctgggtgccccgggcaagtagcaggaaggaactgaatggaagaagaagcagcatagcatgtaagtgaatattggagggctgggagtaattagtcttttccctctgctctgcctttttcttatcctcttccctttgctggccttgcatccgtttcctccccctcctccccgcttccctctcttccctcatcttactgtcttgccccctgggtttggggggctcacagtgacattgtgggccctgccataatttctccacttcccttcttgtcttctcccccgtgtcctctccctcctgtccttcttctcttccctcttgccatctgtcttccaattctgctgcacaccgactcttgctgcggctgccagaggacagagtgaggatggagcagagccacgttctgtaggggagggggaggccccacaggtagtgtcaggtctgcggcaggtgtgagaagagagagaggatggcggggttcaatgctcgggcagctggcctgggtgggagtgtgagagatgcctggactgcttgccctgtcagtgcagccaagattatgttggcatctgtggagtcatgcaggactgccagtctctgggctgaaggttaaccaaccccctttgccaaccttccatacattaactgccataaaatgccatgagtgccagtctcactttgcacaattgatttatttaaaaccaaaatatggaccttcagtcttttattattggttttggcctagaatgtcaatcaagataattttgactcttgatttttgtaatttatcctgttcattatccctcccagctttcatttatttatttatttatttacttatttattgagacagagtctccctctgtctcccaggctggagtgcagtggcacaatctcagctcactacaacctccgcctcccgggttcaagcaattctcttgcctcagccttctgagtagctgagactacaggcgtgcatcaccacacccggctaatttttgtatttttggtggagatggggtttcaccatgttgcccaggctggtctcaaactcctgaccccaggtgatccacccaccttggcttcccagagtgctgggattacaggcgtgagccacggtgcccaataccttccagctttttgaaagagttggaagaatgaggagacctaaattcaaatactgccctggttaactttttaactgtggaccttgatcaagccagatcaaagtttgatttacccagtggttttcaacaggagtgattttggccattaggggatgtttgacaatgtctggagacatttttggttgtcacaactgtaagggtggtactgctcctggcacatagtgggtagaggccaggatgctgccgacatcctccagtgcacaggacagcagagaattacccagttcaaaatgttcatattgctgaggttgagaaacactgatggctaagcctgagtttctttactatgaaatgaatataataatacctagctccttgacttggaggctcaaatgagataagatgtgtaaaagtacctgataaaactgcaaagtgctctgtgggtacccagttcatcagttgatcagttgttattgaggacacgccataccaattggtaatgttgctgtcactaattaaagaagtcatagatagaaaggttgactaggatcagtctcagaaaagaaccttctagggtcctaataaaagcaatttccaatgttcttaagggtctgttatcagtagcctctaggggtatagttgttctaacagcttcaaaactgttcaaccatactttgacacagatttttctttttctgtcttttcatgcaccttggtgaaatctgaacacattctttatggcattcttcctgattttgtatcctgcatcaaaagaagaaatgagattggtttgttgaaactttttcttaatgaacacatgtatatttttagtgatttctatctttccctgtaaatgctcacaaatcacttgttaggtaatccagccctatgtttgccagtctgaagcttccagaatccaatttggcaaaatgttaggcaaatagttacccatctttagtcctctgacacctcttaaaggttattagcaatggttctgtgaatgcagagttgagttctttcagagctatccttgaagacaaggtgtgctgtgagaacccattgtgggtagggccgcatggatcatttgaattctcttttaaaagtgttgatgtggagctttttgagtaaacttgagttatccaggaaaggggaataaggtacaaatcaccttccctctgacccatggtgtcagcacaggcctttaattcaaaaacgtgggactggctcctatgaccacagcagttttaaaactacagattgtgatcttcaaatggggatcaatttagatggttacaaccaatagattttaataaaatagaatatgatagagtagaatagaaaataacagcattcattgcacaaagcaatggtaagtactgttgtgtgaaacttttgttttcagttgtatgtgtctgggtatatgaagaatatactgagcacaccataaattagattgcttacaataaaacatgtcagtagggggacaggcagtgatctctacggacccagtaggaagtggttctaaagtctagaaattaaattctaaagcagtgactcttaggcaggggttttcctaatatctgtgtgcaaagagctgcccatcatcgctcgacagcagtttagaccagctagggaaaggaagggcatggtggagggtctgactgcttccagaagcccgaagagatctcagctcagtgtcttgtgtgttctgcttctgagtttttggctgtcactattcccaacagaaactgcagtcctgctcctgagaaagcagagctgggtgctgtctgctcaccgaagttgaccagaagtggctcttgtaatgtgctaccttcaagggcttctggaccaccctggaggacagagcacccaagccacggctcacatgcctgccttgctccctgagcagccgaaccttattaccatcacacttgaagcagctcatcagggatttgtttgaggcaaaagttcccaggcccaggaaaaagctgaaagctgtggacttaggagccagatgttgagattttgttgtctgctgattgttggctcttgtcaggaaaggaggaggaggagaaatgagagtatattcacagttgcatgggggagttttttacccttttctttttttaaagaagttggtatgttcttcaaacctgagtatttatattttgagcactaacaattctacatttgaagaataaatcccctgcgtgacatgctaccttcagctctcattcttgggactaagctgagtggtgatttgggggtggctttcccttttagtggccggctcagaaatagccagcacacttattacacagactgccaggctctctggaggaagacagaggctttggagcccaagtttagcgtcagctgttctgtggcagtgtagggtgagaattggacctggtggtttatgttaagaagtccagggctgcagaatgggaatgctttctttagaagtttacccccttaaaaataatttccactttcctatctatttaaaggggcttttgaacttgtgtttatgaaatgtcttcccgccatttcatgtgacttgggacacagcagctgggatgatcttccttttacccaaatggaaagttgggttgggctagggcctatggaaaagctggagaagtttagaagccaggcaagcaggattataaaaaacaagaaccaggggaaaaaaaaaacccacatgattttgagaggcagcctagtgtaatggaaagagtgtaagctttagagtcagatgacttagagttgaatcctagctctgctccttggacatattgctgaatttcttccatttcctcatgtataaaacttgaaagttacagggttttgaaggctcttgcatgtagtaggcccttgataaatactgattccctcccaggcgttttatctttgttttttctggggctcttaacttttcctcactggacctttgtaggcacccatttggggttcagcaggtacctgggagcccagaggaaaaagagtgctacagactccaggtgggccctgggtgaccactgaatccaccttcatgatcagggcccacgcaacacagagctgcttccagagctctgggggatttgctattagcttggggtagtttaaaattgaatccatcacaatgacatgatggggagacataaacagaacatttgggagcagagcacagctgctaaggtggcatgatagactgcttggcattacagcattgttatttattagggaaagttgaaatgggtcagagaatgaagttttcctaaagacctcagtcttaggactagcagtctcttttcattgttcctccataaaaatgttttgctctgctctatattgggccaaatgcaccagccaaaatactgttttgcaaatttcaggggaggggatgcggctgctcattgtgggccctccccttcctgctgttgactcaggccagtctaaggcgttctgtgctgcatttgggggattttctggggccgattttagaatgcttgcttactgtgcatgcagagtccccccagccaggccccaccccagcacggctcctgcctctgtcatctgaagcctcatgggctgaggctgggaagagaatagaagacactggtcatatgcatgtgcccagagtttgtttgaggaagagattatacatccatatttccaaagagaaaaaacagaggtttttttttttttaaatgtggcaaagtgtacataacataaaattcaccattttaaccattttaagtgcacagtttagtggcattacatccattcacactgtcacgcagccatcaccaccatccatctctagaactttttcattttctcaaactgaaactacccattaaataatccctctcccctctctcctaggcccctacaaccattaatctacttttctgtctttgtgaatttgcctattttcggtacttgggataagtggagtcatacagcgtttgtccttttgtgtctggcttatttcatggagcataatgtgctcaagggtcatccctgttgtagcatgtgtcagaatttccttcccttttaaggctgaatgataatccattgtgtgtctatatcacattttgtttatccagtcatctgccgatggcacttggcttgcttccaccttttggctattgcaggaaactagttttgacgtgttgagatgcaggcctgatttccctgcctgcttgtgaggtaggtggacacgttgaattgacggtcctgtgtgtgagtgaagtgtgtgcgactgtgtctgagtgtctgtccttctcagttgacgtaaatactagggttatgaaaagtcctgttttatatctgaagaaactctccctgcccactggcttgtcagagcctcttgatgaaagggtaaacaggaggtgagtgcttgacgtaggaggagtgagttatcctgcctcagcctcctgtcctggagagtgtgtttactgcaggctgctgtggggatgagaggaccagtttgggagcctgacagccccagatcaggaccagtctcagaatttctttgttgtgtgactttggctaggtcactttaacttttctgagcctggttgtctacatctaagaggattttgggatccatattaaatgtaacatgtcaaaagctgttgcccggtgcctggctgatggtatgtattcaaaacaccttctcttccttaaagaaacgcttatacactgttggtgtgagtgtaaattagttcaaccactatggaagactgtggcgattcctcaaagacctaaagacagaaataccattcaatccagcaatctcactactgggtatatacccaaaagaatataaatcattttattataaagacacatgcatgtttatgttcattgcagcactgttccataatggcaaagacatggaatcaacccaaatgcccatcagtggtagactggataaagaaaatgtggtacatatacaccattgaacactacgcagccatagaaaggaatgagatcatgtcctttgcaggaacatggttggagctggaggccattctcctcagcaaaccaacacaggaaccgaaaaccaaatactgcatgttattataagtgggagctaaatgatgagaacacatggacacatagaggggaacaacagatactggggccttttgaagggtagagggtaggaggagagagaggatcaggggaaataactaatgggtactaggcttaatacatgggtgatgaaataatctgtaaaacaaacccccatgacaaaagtttacctatgtgacctgtacatgtacctctgaacttaaaagtacacaaacacatatgcatgcacacacacacacacacacacacacacacacacacacacacacaaataaaaccttccgacaaaggaaaaaaacccacaaaaaccttctcctcctttctccacccggatagtgagcatcttgccagggagacaccttgttgtatttacctataggattccccttccctgggcctaccacagtacctggcccgcagcagcggctgctggttggatgcttattaactttatcctggacactctctgggaaacaaaggctgctccacaataggactttccaaaaatgttctgagaaaacacagccccagtggaatcagcacagagctttctaagggggtaggctttgaagagaatattatttatttggatgggtaaattctggattgtttgaaaaacaaaaacataatactggcctcattacttttttcgtcattgcccctttgtctgtgggtagagtgcttttgagagattattggttggaactttaaaaataggccagttgtcagatgtcttggcacgaaaacatatcccagtggctttctttaggaattttcataaagctaaacgtctctccttggagagggctgtgttgatcaccatctgctgaatactctaaagaggtcggagagcaaacttgctcccaagctagtggaactagccagtggaatccagatgtcagtaaagtggggaagcacttgtttgttgggggggaaaatggagtggttggtaatgggagcaaaaagagtccaaatcattttttctggacccttctcccaattcccatccctatccctacccatctgtctttgactttatcagtgagagtcataccagcgtccttgggtggttttgtgggtcaggcagagagaagggtacaaagattgttggtggattccaaatgccaggtgaaaggggaaggagaaagtgctagcataaaagctctgcctgggacccggcaggctgctctggcacagctgactgtggcagcagctctgtggtctgggcagcccctgagtagcctgctaattgtgactggcttcattagcattttgggcagtggccccgagcagctgggctgctgctgtcaagagttgctttgcagatggaagacctccttttctgtcctctcctcttggccctcattactatctaatgccaaagatacagagtgggggtgactcttggcttgggttctgtgggaccctgaacacacgagacaatcctgatggggggcggtcaggagtgggggtggttacattctgagtttcccggaacagctctgcaaaacagctccccaagggatgttgtctaattcgtctttgcatttccagtgccagcatggtacctgccatatataggcagctgcagtttaaaaggctatgctcttttctggaaccctccagggctgcagggatctcttgtatgataatgtcactatttgccatttcataggggcttaatcattgctgaaccctatcagaagtgtgaaccctatcagaagtgctaagcccatttgttttttcttgccagaggcttgggcctgagacttggtatggcttctactttgggtgtatttctcctaaggaaaacgtagggcaattgggagctttatcctggtttctttttaaaaatagttgttacagacactcccttggctggtcctggcaaagactcttgaggttgtaggagctgctctttcctcctccccagacacctggggaagttggtgagctccttgaggaaactcggaagcagtatctttttaatctttttacctccatccctatggtcttgagtagagagccacacacaaaaggcccctggacaatgaggagcaatggcgatgctgcccagctagagatccttcccacagttggtatctgtgtggcccctctgtgccaagcaaggccacaggagggcaggagggcactgtgtctctaggtaagtgctccctacagtgctggaactgctggggctgcagtttcatggaacccctcagttttgccagcctcaagttgacaagtgcaaaagcagatgtggtttctgagctcattcatgttcctttacagcgggcagcacccttggtctcagtggaaaaagctgttccagggacagagggtagaggctgttcctatgttggcctctgagctggaggctggaaacaagggatcagggtgtgatgtgggagggcagatggcacagaagactccaaaccctagtgttcccctttaaggcccacttttggttgtttcactgtggacagtgggtgagatttttgttttcatcccgaggatggaagccatagactcatgactctgaagagctctcttatgaataacttacggttctatatctcatggtggaaatatttggcagcattctgcactatttctgccttctcttcttgaccagattttattttgttccactctgatcttattttggcccaagtgtaaatgacgctatagaaagattccttttttaaatattcctttttgctcactgactacaaatatacagtactagagacccaaggcagcaaatgacttgtgccacatcagtgaggcaggacgttagtccctgccagcacctggtgatgttactccctggaggttccagattatagcatcccagcctgaggcttgaagacccaggggacttctgttgtcacagcacagtcaaatcctcttggcaataactcactctccctgcacgtttttctctacctccagttctgctctgtcccctcccattgccagataagtcagccatatgtggcccccagggcacagtggcatgtgcacacttggcaccccaggacaagccttaggaaaaacggacacacacctaaaccctttgggatgtcctttttcgacattgtgcacagctacacatgatctttcatgaaagaatccagatgggagacatgtggcaggagatctccttttagtgccagataggtacagagtcctctggtctttaatgagttttacgttgtgttatgtctgtgctgggatggagggcacgttacaccgcacgctgacgcagtttcagggccccagaggatgcacagaggcagggcaggagctttgggtttttcccactgagctaaagggagtttgggggctttgatccttttgaatttcccccatttccccaaaggtcaaactctggacttgacacttaacaagaaatgctcctgggaaccccaatctaataatggtatctcagtgaaccccagggaacttttccacttctttttgaaactgactatggcttccctttcaatctatactagacatgtccaggaatgaaattaggcccactgggtgactagggagttggagacattcttcagccagccagagcctcactgttgattcaagagcagatgcttctgtgatttgccccctgcccatccacccccatggcctcattagagcagacagaactggttcggaagcctgctggcccacatggctttcccttgggttctgctgaagtgccctggtaagccttttagggcggggggtcgctttatctgccattccctttcctttagcaacttgccttgttaacctggggttgctttctgcaataatgtctcaggttggaatcttcatcatccccctcctcttctccctcactctttctcgtttcctcccccatcctcagtttcttgtcttgcatcacattcattggctcagaaccttcctcgtgctgccccacagctcaccgcggcacccagcagccagccgcttcatttccccagctccagagcttcatggatgagaaagtggaattttttttccttgtacaatgttgtggagcttttaattagttaactcatgtgtccattttataaacaatgaactaaacacctgttacatgctgaacattccagcccagcaagccctggtgcctgcccttgaggacgtggaggtgtcactggtcacagagacatgcagtcagatcacagagtcgttgggtagaggctgcagggaggcctgtgagggcagggtcatgccgtgtgggtgcagacagggaagaacagctactgccctggagcctgctgggaggcccagagctcatctgtggaggctctgtgggagaggggacagtcaataacatctttactgttgagttggacttcagtggctggacagggagggaaagatgattccaagttgaaggtccacgtgagcaatggccaggaaacccgagagaatgtggcgggaccgggaaatggtgagtgggtcaatgtcgccaggacttaggggcaggggtggggcagagcgggcatgcgtggagccagggtgctgaacactgagctcagcacgagctgaattttgaagtgccacattctaaggaaattaaaacatcctgtggatggcaagaggacaggttgagttttgaaaggggcgtccgcagatggaggtgtagggaggtagctctgaagacagggactcttggatgaatctcttactgtgttgttcccgttgaagggctgtttccctcttggggcagaggccaactccttcattccccagcttggcttaaatgtctactcaggcattcaaagggaaaaggaaagcaatggtttttcctgaccccattccactctccccatgtaggacctgtgagttggctgattgtgggttcagcatctgccaccctgggaatgttgacccaggggtgtgaacggtggagcgctggaggcaggcaggggccctccatgatgggcagagcagctcagtggccttggcagatctggactctggtcccacctgtgtgcctctagggacgtctttggggccctctgtacttgggttttgttacctgtaagttatatatgagtgactgcttaaccttctggagtctccatgcagagcaaatgaaagaacatatgaggatatcatttgaaaagcacaaggcctgagatctttgcatgcaatcatctgcatttcggtagctgacctttcccagagctggttcaccagtgttctctattgtggaaaggaccctgtgcctgagaagaagggcttttaagagaccccagttctagaacaagtctgatttcaggtttgtatgtactgcctctgtgggtccccttccctggttaaagaaaaaaaaagtgttgctctatcctgctctgctatgctcattgaaagaatggctgctctgtgaatccaaatgcaggccttccatgcaggctttcgagggaggatggtggggtgcacaggttgactgctctgctccctggctggtgctggtctccttctggaagcatgcactaggctggccagctggacagtgagtatctggtaacagatgagcaagtgcttctcctactttgagtttcttgggggtgattctacacttgctttcacatatccgtctggtaacacctggactggtgccatttccttccccttcgttttgttcctaatggccccaacgtcagtactgcatgcgaaaggtgagagagaattcttggtgggagagaatcgggtgctgtgaagaggctatttttctactcacggaagttcatttactctttggattggaaatttccctgacactcagaaagtcagatggtttgtcagtatggaacatgcctcagggaattagcaggatatccataccttctttgactggaatttaatatttcccactttggcccagcaattgaacaaaatctctttgtaatgaaggtaccttgtggtaccttcatttctttaaagtgaagtttggtaagatgaaagctgtgttctgaggcacagatgttgtaagatgtttggtggttgattttgagtcctcctccagcctgtccttgggtagctggctttgccattttctcagatgaagaaaggagagaggcatagaaaagagggaatgatgtgttgctcaaactcagttttagaatggagcatcaagtcggggggactctgagttcagctagagcttagattagttgcatgtctacactccccttcccccgccaccgtctccacttcacagatgtcttatactacacagcaagcaggagggcctttgacatgggtaggcggtcatggggcatagcatggtggagaagaatgggttcttggtacatatacatgggttcaaatcctgtttctgatgagttctgtgactgggagcaagtcatggcatctgcctgagcctctgttttcttaccgatgaatccaggtcatcttagttcctgcagtcagctgcctcacagggctgttttgaacatcataagaaataatggatgagaaagagctccatcaactctacaggtgttaggggagaaaggagagaaaaggaaaaggagaaagaatcatgtaggcagtgggttcctttatgctgggctgctcaaagcacgaagggggaggtgttgcagagttgggattccccagccctctctgccttgggacagttgtcacacattcccagggtctgtgtcttccacccaggtttatgcaagcgtggacagcacagtgacaggttgcagtgctggctgcccctctagggcctggcttccctcagagcatcatggtgtaaagtaggagggaaaaggcaggtgtgagtctgtgggcagacagacctgtcttgggcagagctgcttcggatgacacaatccagggtgacacaatccagtctgattgctacccactttggtaggtagaacgtggccaaatacagctagactctccctgtaaatatacacctcctcctgaggctcaacttgcagagaaaaagggactagagatggagaacaaaggctggaggtgccccagatgctggagtggctgccctgcctgtctcctataccactttcagcttcttttatcttccacagctcctccccaaggaagtctgaatctcattcactaaaggggtcccctctgaagggtactgtcagcccacagcctctcttcataccaaacaccagtcaatcccaggtgtaatttgtttattaacaatcataagtgtcacttatggaagaccttgtatgtgccaggcaatgccctagtgcagctaattcctagcacagtccagcaagggaagcagcctcattttacaggtgaggaaactaaggctcagaatgaatgagtggctttacccaggtcacatggtgggcaaaatgctggagctaggactcaaatttctgcttgctttgctccaaaccctttgctctatgttgctaccttgccttgcactgccagtacacagaagtcccttcggtcattctctgttctcaagaaccctgaatgacctgctgaatgttatttatattttcctagctcttttgggccactttgaccaatggtgtccagtggttcttgccaagactgcactttggaaacatgtgggagcttaacaaataaatccctgtgctagactacactccacaccaactaagccagaatctcggggcggggggggacccaggcaacaatggttgtaaaactcccaggtgataactgatgtgcagccaaggtcaaggaccactgcattgccctcccagccttcagctagtggtggtcctttgactactggagatgagatggtggcagctgcctggggatcctttaggaggctgagaaattcttcagccaggcctttaggtggactgctgacattgcttctacactgcttccacatagctctgagcctttttatgtaatgccctcattcagcctatgagcttataagcagcgtctgaactcccagcttggactcctgagtgacagatgctggagtacaggcatttgttttggaggaggcaggggtatcatctggagagttggaaattttgttttgcagggttgccaaaaacatggccagctagtagacctgcatttgctcccttttttagtgcccaggctgaggcatttaaatgttgttgcaggtgggagaggatgaagcacagatccaaatctgcacaatgcaaaaatatgcaaattgggctttaaaagaaaatgtttatatttaatttttaaatcaaaccttttacctcaatataggtatttttctgtatgccccaggcgattgcaggaaagcagcctggcatagggaaatcctgggttagatttgggctctggatttatcaaattttctgcacttaccaactctgtgcccttgccagggtggttgtgaagaccaacttagagaatggacacacaagctgtcttgcataatggtaggctcagagaacacactcaacacatattaattgctttccctgccttctctgcccaattttacagatggaggtgtctgcaatggtaaactttctggctaaatcaaagggaaatgaagtgtaaccccttaagagcaaaagggctggttctaggtgggagtgttattcacaggctaggaagaaaggaacaatctggcctcggaaccagcaacactgtctgtggactgagaagcaccccacgttaggtcttctcaccagacgactgggtttgacatggtgagaagaggcaggtggttagttttctgaccaaggcgctcagctgaaaggctatcaaggatggcatgaataatttttgccaggtgaggggaggggagtttcagagagcatgcatctcaaagtcttgtcagggcaatgactggacctcagaggctgaccacttcatagctgcggactttttcttagcaacgtgaaagaacacatccacttagggtagtcacagggtgtgtgtgttgggggtggcagaggtcttgcattcacccaggatggggctgaacattttcccgtttgtcccagggacagggtagctctcctgtgccctatgggcttcaaggcaaaagggctttatgaatcctggtgagaaaaagcgtttaaaatgtctcttggccaacagtaccttggtttagttccctcgatctgactttcctgagttgcatcccaactgggctgagcctggtctctgaaaagtccctatcatcaatatccatctctttccaaacgcccttgctgaaaagcctggggcccccttttctttccttcttgtactgtgggatatttgctttcctttttcataagaatcgtggataacttaatacaagtaatcattagagccgactcttcacatcggttcaccagctggtcccggaaaaggaccctacctaacacattcagcattgcctcctctcttggggaaagagctgacacatttctgtgcctcctgctggttctgggatgccctcaggcttccctacctcccccctctctgccaaaagggacttaggatctctaagctgtctttcaaacctcaaggaatttcaggaactcgcttgctcttttggggtcatgctgatttgggcagctgggtgtgccccgccccatccccgccccagcagtcacgtcatggaaaggctggggaggtgggtccgtgctcacgtggtcgcgggcgctgcgctgcctggaggctcagttctgggctttcagggttgaaaacccctccccaagcttagtttgaggccatctgaggccgctggagagttgaccctgctctcacaggtgatgtgttaggatcgaggtgtggttggttccgtaagctggtcggaggcgcagacgctgggccaaagtgtcagcagcagtaggaaatctactgggtgttgaggctttttgcagttcccttttctccctgccctctccgcctggcctgcgctttaactcttcccgggtttgctgcagggttgggagtgagggcagtttcactggtgaaaaggacgctttcagaagccagactcctaaccttctccccagcaaaatcgaatttagagcaataacctttaagttgagttttaaactgtgacatgtccattacagatcattggataaatacagaaaactataaagaaatgaaaatcacccgtagtcacccttttagactttttcctaacattaaaaatactgcttttatttctgcaaaatgtaattttaagtatagtcttgaatgactgatgaggaaaaccttcttttatcgtctttcttctttcaacatcagttcaaaagggaggtagaatatcgacttaggttagtccccacaactcagcttttttgagactatcccaagaacacagcatttcagagccagatagtatttttgagtttatgtggttaatctttccactttctggactgagacagaagtgacacaactttcttggggtttccaaattagctgcagagctggaaccagaagaactcaaagagttctgcttctgaagtcagggtcctcccaaaactccaggagcatggaatatcagagttcacttttaggtcagagattttaaataagatcaaaagcagaaaagggaagaggggagacagggagccacatctgaaaaggggcaattttctttggaattttggtacattttaattcctttttacagatggaaacaaagtgacatttttaagaattctgaatagacgctgtcagccattggaacaaaacacctgcaggaagagatactgggaggcagggagctctatcttagagaggcacccagttctttgggatatgagcgccagtctctgcacaagttgaccccagggactcccctagcctgagtgctggcgtcagtgcttccccgcaggcctgccttctaggcaaccatgtggtctcttcctcatcagtagccctccgcagaggcgtgctccctgagatgcccctctttctgacatccactctgggcctgtggttctcttgctgggagtattgatacctctattgtcacttcctgggaggccttctcttcacacaggaaacctccttcctgacagcagagagcggcctagaataagcctatcatgaacaccgttgtcaagaccacgtaaaaagctcaccaaagccttatcccagtcctggctccttttggaatagataattctccctttttctctctggccaggactgataatgataataataatgaacacttaggtagtgtttagtgctagacactttacattttaatctacacagtgtcccaaattcatttcacaggtgaggaaaccaatggggcacagataagcttgcctgaagtcacagctatgaagaacagagccagaattcacactcagcctggctccagagaccatgttcctaaccactagactagactaatcagcctgctccaggggctcggcctctgccctcagtggcagcactctatttgaggtctgcagccatctgcaggggatttgattttcctccccctttagggaaagcaagtctggggtcactgtggctcctttgccctctcctaagtttgcatggcagccagttttcattttgtgtcgttttattttccataggccacatttatcatatttaataaccaaatgttatttggttattggttattttgtaaaattcttcacatgaataacattagaaaaatagtctttgttagcgtccatgtcctggtttggtatttggacaaattgtggaggtgtggccagagagtatattctggagttggacaaatctatccaaatctagactctactattgactggcaacatgtctttcttttttttaattccttcgtttcatggttttcaatgtattcaagtaatgcctgtacaagcttgatatagcacgttaaataatgcacgcgaaatacctgtacaagtgaaataatacaagatgcatgaaggtgaagctcctcgtctcctccttcagtcctgtccctctcaatcagcattagccacgttctccagggcagcctgctgagcctccacatggttgttttcctgcctataacaggaggcgaacgccctgtgatgtatgtaatgggtgctctttcagtggtagtcattgttatgaggagggaacacatgtgcattagggctgcagtaagttgcatttttgccatgggaagagaaattctccacctttcccgtcagtttctctttgcttctccatcttgcagcctctggcacagcccagagtccagtggtatccggcagaagcagtgctgtgcagctctgagctgggcccttaaggggaagagggagtacctccagcaatattcagggtggatgtgggttccagggcttctgatcctggggctgggcttgtctgagattcacaggaggttagagaactaaggaggaaggggagaaggctttaacccacccctctgctgtctctctctggaggaaacctcaggcagctctgtgtacttccccctctgcacacacacctcttcctgccttctctaccctgacaccaaggtctctccccagccctggtggcatcgtgcctgggttgctaataatagagaagggtgaatctgccaggcagtgaatcagaaggctgtcccagctctgttcttctgccctgatcctggcaaattcttgtgggctgattcggtaaatatccttgtgagcagaataagtctttgtgtgttctggaaactcctgctgtccctgggggtaacaccctcttggaaggatgatggggatgcctttggcctcaagatcttaggacggcgtttcaaattgctccaggcttccaagctagcctgggctctgggaggagggtttgcaggtttggagaaggagctgcttcccaggtgctcaggggatggaagtgagaatagggagggtgtggagggtacaaagagactgtttagttcttgcgtaaaagacaacacaatatggtccttccagttctttttagagctcaaaaggtgaaataagaataaagaacagcgatctgcagttttcctattatccaaaagcctactacccaattcagtggattgttttggcaacttgcttggataaacttatttagaaattatttcagaattcctccaggcagttaccctacgtcctttttaagtcaaggtgtggtataagtccattaacgaattaaaatacttccagatttctgtgttattctcaaggcacttttgctagataacaatacctcacacttggacggtgttttgtggtttgcaaagcactttcacatctgttttctcacttggttgccataataaccctgggagccgggaagggcatgtcttgttattatccctattttgcagatgaggaagccaaggtttttagaaggttgggtggcctagtcaaggtcacaccggtaggggaattggggggatggaggaaactagagctgtttttccttaaccatcttgcctctcactgagatgaaacagcaggatggttcctgggacccaggatccctttgaacgcttggattaaaataatttatgagttctttgtgagtgtgtgtggacctgctggtagtggcttttcttcattagaatttgcatgcaagattgacactaagatggctgactttcaccatcccaaaccaaccctgtttttgcaccgtgctgtagtggtatgaattaccttgcaggtaattgtggcttaggtgatggtacacaaaaggcatcatacagcagccagatgttcattttactaaatggaaaatatgactcagaacacgggccaatctgagcctccaagcaggcaaattagccattgaggatgaagtcttcacctctggagaggagagaatgtgggagcacagagcccagagtcaaatgatttggttgagatccccccactttggttatttagacttgcttatactcctctgaccagactatgggatcttctacagaaattctacagaagtgtgggcagaattacaagtaaggtgggttgaggaagtgcacaggtggaagtgtagccgagaggatgcgtttgaggagcaagaggctgggactcaagaaggctttatgcagactcgaatcttacattgataacaagcatttgcgtagcacatacgagtttcatcctatgaaggattccataggattctcacagcagcccaaggatgtgagcagagcagtaaacaatatccctgttttatagaggaagtagaaatcgagaagcaggaaggttgggtaatttgcccaaagttccaccactagtaaatcgcagaactgggactaaagcccaggtcttctgaccctcactgggcccagcgttctttccaatatgtcatcctgccattttccccttccttcctcctccccacagctccttgcaagttcagcctgctggaggtaagggaagtgatcatgagagtttttccagtgctgagacgttctggaaaaaacatggacctgtatctgtgtcctgatctgtgcttcgtgattggactgtcttgacactcgtctcaggactctggggagtgcttgtgcaagtgtttcccagtgtggccggcttcttgaacgctgctaatggaaagttgtaagagttctattttcctgtttcaagcgagcgtttcccccttggggttatagcaaccacttcctcctcagcacccggtgggtcgtggtaaacaccagttacagcagagtatccccttctgacaacctcattggttcctttttttttttttttttttttttttgcctgtaagcacatacacacagagttctgaaggctaggtctcctttccttctggtttagagttttcagagtaccctgctgtggccttggaaacagaaaacccacacagaggtcaaacgcagttctcgtggagtcaccttgtcatcctgctttgttttggaaggaactgggtcggaggcagcacagtaggactacagcatctttaacccttggtaggatggctggatccgctgaacgcttgtgggtaaacaggaagctcacagcctcagtggatcattaagggtgatacagaatagacacgaaaatcttaagtgggatgggagcagagcaggacttggtgggtagatagtgaggaaaaggaggcaaatagggatggtgaagaaatcgaaagggaatgggggatacaaggaaagggtcaggaaagggtgagtaaaaggtttaaagagaggtgctaattttagatacttaaaagtattttaagtatctaaaacttgtggctgggtgtggtggctcactcctttaatcccagcactttgggaggccaaggcgggcagatcacctgaggtcagaagttcgagaccagcctggccaacatagtgaaaccccgtctctaactaaaaatacaaaaattaggccaggcacagtggctcacgcctgtaattccagcactatgggaggctgaggtgggtggatcacgaggtcaggagttcaaaactagcctggccaagatggtgaaaccccatctctactaaaactacaaaaatcagccaagtgtggtggcaggtgcctgtaatcccagctactcggaggctgaggcaggagattggtttgaacctgggagttggaggttgcagtgagccgagatggtgccactgccctccagcctgggcaacagtgagactctgtctcaaaaaaaaatgtgtatatataaatacttaaaaaatatttgtaattgctggtttggggttactagaatctcttctgaatctgtctcagtttttcttacagcttttaaaatccatggaactctatcaccaggagatgattgtggtatggagctgatcaccccggagttagtggggtggcaactgagatcggggggaaatggagcagtttgaggatatatgggccgtgaaaacctcccagctctgcccccagccatgccatgaaagtcatggggaagaaaggcccccatttgtgtgtttgtgttattaaatagaacagtaacagagcaggtctctgagcctgcctggcagaaatctttctgtagcaggagtgtcctgcaactctctggtggatttgcaaaacagtacagatagaaaaacttaaatgggaaacaagcttgtcttgtcctactttgtggagatagataataaagccgaaaggccaagaagtgtaaatatatagcatatatctaatgtatatggtatatgtacatatcaatctatagctatgcaatatctacactatttatctatgtttatacgatgactctaggcttcagaagacctgtcaaagatttccatacatctagagaatttagaaggatccctttataggtgagagttgagactttttggctgcaggttgggatttggtggactagttcctggtaccaccacctagttgccgtgattatctttagactaaccaaggcccttgtgttagccttccgtaaatcatccccacccctaagcaagacagcacctataccttcacagtttctccagttcatccctgttttattttatttattgttttttgagacagggtcatgctctgtcacccaggctggagtgcagtggcacgaacatggcagcctctacccctgtgttcaagcaatcctcctgcctcagcctcccgagtagctgggaccacaggtgcgcgccaccacacctggctaatttttgtgttttttatagagacaaggggtctcaccatgttgcccaggctggtcttgaactcctggcctcaagcagtcctcctgcctcagcctcccaaagtgttgggattacaggcatgagctactgcatccggcccatccctgtttaaatgggaatatccagaagattgtccttgtcatacactcggtgcattttagagtgtcttcaccacttgtcagaaacaggattctggttgggaagggccatcattcacagtgtggcaggtttttgctttgttaattactggaattggggtacagaagccaaatgcaggttctccacctgggaccttcttcctgtttgtctgcccacttcacacctgtcttagcagctgcagcctgaaatagtgagatggctacattgcctgatcaaatctgggatttatgtagtgataacacctcccaggagatagatttcttcgccctaccccagtgcttcccacacatgcccatggaccagctctttatctctggcatgaagattcctcccacttccctgttgctgagatccttaggcctttagagggcaattctttcagcagggattgcagctccaggttagagtgggagtgagaagaagccatatgcctcacaccgaaagacagccgtggtcttgtcgacctaatatctgagccaaggtggaggacagctgcccaggacacacttccaagttgccttggggagtgctctgtttggcctttgttacaagcaggttttcaaaggcaaaaggaacaaggaagtgggctgatacaaagttgtttgacaggaatcctccctggtttacagagataacattggatagtgattgctctacactgttgaactatggagtacgagtgatggtgtcaagcatatgtcattttatggctacttagcatcagttagtcttgagcccacatagcaagtggcttcaagaggtgattatttagctcaggcggggagtgagacgtgatcgctgtcacacgctgtcacatttcggtgcctctctgggtttgataattaaagggggcttggattctcagataaaaaatttttatttctcagtctaaaatggagagttttaaaaaaatccatcttcctctctcacttggacaattacagcagcttcaaaatggatctttcttgttttcaccctttctcgcctgctttctgttccccaggtgtacacacagaagcagcgtgagccttttagaacataagccagactatgacactcctcactcaaaaccctccagcagcttcctatctcactgacataaaatccgaagtcctaagaacagcctaaaaaactctgcaagaactgacctcatatgtgatatattctcctctttgtttactctgttccagccactttgctgttcctgctggcctttgaagctgcccacacacctgtctcaaagcctgtgcacttgaccgctccctctgtctgcagtgccataccctctgcctgtgtatggctcagcccctcacttcctgcagaaagaccatggccaactaagccagcacacccctctccccgcctccctggggttctcccttttcccctacctggctttatttatcttcaggatgctcatagctgcctgatgcaatatgtctttatttgtttatcatctgcctgtccccacttagaatgtaagctgctttaaggatagggacttcgttgtgttcactgctaaatcacctgcggctagaacagtggcacatctgtaaatatttgtccaacagtgaatgcatgtgtgcatgcatgcgtgaatccattagcaacagcatttattgggttcttttacttggcatcacatttgtagcaaggagtacaaagatggattccacggtccctgccctcaggggctcactcctttgatctgttctttgtggaagggtttcccacatcagtctcttttctgatcctgttcttacccatgttgtttgaatattgggaaggcgcctccaccctaggagtctagctgctgtctgtcatccgaatggtcctccactaatgttcctgggcttctagagatccttggggtcttcacggagcagtcaacccattcagggaacagttttcagtcctgagctcacagaacctacaggaagaaagccctatttctcccttagctgaagggacattttggagagtgctgtgttctcagatcaaatataggaaggagcactgaaggtgtaagatatggtagcagtttctttatgttacttgtttatttggtgttctgtatattttttacattgtaaaagcaaactaaccaggctacagaaatttcgaaaataaaaagaataggtatcatcataaccctacgatcataatgatgaaacagcttgattctatgcattattaattaattggttaatttgtattctaccttattcaaaagatttgtggatacttacaaatatgcatgtagtgcaatagaatataataactgagaaatgagagcaaagggttaaatcgttgatcaaagccagtataaagttaatgtgcagaaatgcgtattagtacaactactcttataaattggtatatttcttcttagcctaagtctgtatattttccgtagctaattctgctccctgccccttaatcttatagcaacattttccacgtttctttcttaaccctgatagttaaggactgaacgatccatcccaaggatgtgcctctaatttgtttaatcatcctctgttgttggaagttgggctattttcactactattgttattagaaacaatggcataattaacatcttggtgcatgtaactttttccgttttttggagtatttccttaagtagatttccagaggtaaaataaataactgaaaggttgaaacatttttatggcccttgcagaatattcctgggctgctttcccaaaaggtcatgtgtcttggggatgcctcccagcagtgggttggcatgtatcacaccttactctcctcctcaccaacactaggattcactattgaaatttttttttttttttttttttttttttttgcggcggagcttggtggctcacgcctgtaatcccagcattttgggagggcgaggcaggcggatcacttgaggtcaggggttcgagaccagctgaggcaagtagtgaaaccccatctctactaaaaatacaaaaattagccaggcatggtggcgtgcatcttctagtccaggctactcaggaggttgaggcaggagaattgcttgacccctggaggcggaggttgcagtgagctgggattgtgcagctgcactccagcctgggcgacagttcgagacaacatctcagaaaaacaaaaacaaaaaaaaaacaaaccaaaaaaacattttttttgttgctaataggcaaacatatattattatttcattatatgtatgttgaattatatgtatgttgccaggttatctactggcacctgagattgtttttacccatttgtttgagttctttgtatataaaacttaacccttcaagcatactttattttgtaaaatattttctgcagtttatttgacttctgctttggtttgcaggtgtctttgcttttgatactttgagttttcacgttttggatagtcatagttcttggtaattttctctgttatttacctagagacagtagtccaagttcattagcctggcagttgaggcctgtggtgatgttggctttgttattccagaagactcaccttctgttctcttaggaccttcttgttgggaagctgaatcagtggtgcatctagcatattttacaccaggagtacatttttttttttttttgagacagagtttcgctcttgttgcccaggctagaattcaatggcgcgatctccgctcactgcaacctccgcctcctgggttcaagcgattctccagcctcagcccaggcgcccgccaccacgcccggctaatttttgtatttttactagagacggagtttcaccatgttggccaggctggtctcgaactcctgacctcaggtgatccacccgcctcggcctcccaaagtgttgggattacaggcgtgagccaccatgcccagctcaggagtagattttttaaaatactcccctcttctatagtaacaaaattatttcaataattaagaaataaataataatgatgatgataatggccagaaaataatttcagacagttaaacatttctattattgaattttgtgtatatgatgccagcaataaaaaaaggggggcagggagtaatgaatttaatgacgctaatgcttattttgaaaaaggggaaaggttacactttcatagtggtctgtagcagtaatgaataaaaactatagtttctggttttgagtcttctgtaaattgatcagacttcgtaaatactgatctttccctattcatcatgatcaatagacaaagccgcatttgttggtctatcttccctcaaagctggtcgcagagcactttttattcctgttaattttgaaaaatttcttttggttgaaacagcagatatacaaataggataaatcttaaacataaaatttggcagaaattcacaacaatcccatttcacagtaaattccagacattgcaacaaagtcctgttcttcagttcttcaggattgattaacatctcattgttgaaaagtcagaaacataaatagaaactcccaagtggtctggtagaatgagaggatggaatagcccaggttctatttctttgtctttacaatgactgtgcttccagcctttatttttggtctggtcttcaagcttaggaacacatcgtaccacaggactcgggggacgagccaccccaaagtgagtgccactgataccgaatcctgtgaacttgctcttgaaacatgggtagctgagtccacgggtgtcaggggctggctttgcaactattaatatgagttatttgaattaacttccatagagaatgtaatgtttatgaaaaggtaattagtctgtgtgaatttgaagcttacatatattattaaaagtcaagaataatgcagcaattgttcagaattagacaaaaggttgttgggggaggtgttggattatgtttaaatcagaatcgccagctcatggtcatggtaaaaagcccatcagtttcagtattgttttaaattccttacagacaattttccctctttttgcctccctctggggcaaactgctccgtgccaggcccttagtgctgagctgagccaagctgttggctgtgctgttggctgtgctgttggctgtgctgttggtgcttttttgcttctaggcttttgcttatgcttttctcaatcctgaaataccaacctccacttcgcacgcgcgcgcgcacacacacacacacacacacacacacattttcctcatctttttaagacttagcttaaatgtcaccttttccatgaagcttccttaatttttaattttttccctttttctcccaaagtaatagcttcctcttctgaattcctgtagccctatcccagatctgcaggagaaagcactcacagctgtgcccagtgcatccagggacagcactgatgtcagaaaatgtgggtggtctgattggacaaaggagtccaggagccagcccaggttacctgcctgggtcctggttccagagctcctcttgtttgcctctctccctgatgggctggccctggttgtgggacctcactgagtctggatgctgctgcctctggttcttggcctctgggtgtgaggcaacccttacttaacttacctttctgcttcagaaaccccgcccttaagccagaccccacagtaagggctaggcattctgagcactcttccgctttctcaaccagactcttgggtcttggcggggttcccacatgtttatgttagcctatatttatcgattcccaactctgggaaagcagtgtgccaggtagggcctaggggttcagcaatgaactggccatttccagtcctcaaggaatgctcactctagtgggggtaacactcatgtcatcaccagatcacgtgaatgtcctctcagcagagaagcagatgcgtgtgtgaggtataggggagaagcgattagcctttttgagtgcattgggcaaaaagtgcaaagaggaggtgataattgcgcatggtaaagaatgaagaagagttctctcggtaggttaggggaagggtcttccagccagaggggccagcacaaaaggttcaggagcatgaagcagtgtggtgtgtgttggcaaacacaaccagatcagttttgcaacagcccagggagtgaagggacgcattggtggggagaggcgagagcccttgagagtccatgtgtggtctgtggtctttgtcctgcaggctttagggaagccacagaaggtttaaagcaggggagggacatgatgaaattggcatgatcagattgatgttttagaaagatctgcaaggctgatgagtggagagtgggttgcaggaaggcacacccaaggcaggacaggctgttgtgatcctggagagataggaagagcaaggggtgctagccgtagggagagttgtcagggtggtaaattaggaactttagtgattgactggctgttttggcagccctgttccagaatcgccttagctgtccctgagggtagatcttagggtctcccatggaatttgtgatcctcatatgttcagcatggtcccattagatctgtggggtcagtgtgctggggcatgacgctgcacatgctctatcttcccagagcccctggagcccctggacaccagggagccatgtccgtcacatatgatgccttggtaaggagctggtaagaagcaagatgacctcttgctcctgagagcagcaagcacttacagcttctccctctgagcgcctctggcttgatgggagctggcagaccttgctgagtcttgccctgattgggtggcctgagtcattgctgccacgacaggcaccagatcccaccgtgccatgtgctcccttctggtatcacagctgctcgctctccacatgtggccttaaggagggctttggggcagatataggactgatgcctttatcatttaaacctctctttatcttctgagaagcccattggtagccctctgcggtcatgtctgtcatttctttcatttttaggcaggctggtggggaagaccgcagatggccaggagcttttgggtcacccctcaaaatgcagttggccgctacactgtgaaatccccagaggccacagtgccctgtgatttactcctagcattttgagtgttgagtttcattgccaggatgctaggcttcctcctggccccaccacaggtgcttccgtgagtgtctcctcgcctcacctgggctgggccgtggctgcaagtcccaaacgccaaccatcccgggttctaaattgtgttgtaactaattagaggcagaggttggtcagagtcaggtactgctcagccacgaccacagtgatgttccacttctctgggtggggaggtggtaccgcaggcagggccaggttggtggggctgggtggtttagaaatcctggcttccatctcagcccccgccggtgaccaccgaggtagcttttgtgtgatctgtcgtttcctccgctactcatctcatcagagaggcccgttttgtcttggtgttctatttcatctttcagacccgaagggccacatcttacttgcatggtgtgtgttcaggttttcaagcatgtcccgtgttttcctacctagtcctccctacagttttggggatgaggccttgctgtgcattttcatttctgtttgcagagggagaaacagcagctcagcaaagtaggtgacttgcccgcgttgacatggccagtgagtagactacagtggaggtctttggctttcctcagcactttcccctttgtctctaaatccagcggctcaaactcaaatgccaccaggggccgggcaggtgacctgtgtcagcgggacccagtgacaggggaagagaaggtcccatcttaagtggctgctgctcagccccaggcaggggccgctgtccgggattacaggcccaggatttcaaagagaagttgggaattcggatttttgtgtggaatctgatttttaaatgttagcaactaatttagaaaaaaaatgtagccaaacaaggtgagtctgctggcctctgccctatatcacctggctgctagtcactcacccacggcctttcctcctgactcaggtttacagggagcctctgctggctggctatcctgttaagggaaagggggaaaggaaagggaagaggaaacagttctaggagcttctggtccatttgcgtcgtgctggccacacactgtgtaaatagctcagctgcccacattcccaaggcaaatactttccatgcgcctctttggccaccttgaatcccggggctctttggcagtttatcggctcgcttccttttccgaagattcaaatgacgactgcctgaaaatattttcttcagctgggtttttccttggtgacttcactccgagacagatgtgccctaataatagcattgaaagttaaggggaataagtcagccagctggttctgttccctagaaatgatgttaacagttcctaaatgtgagctctccccagagaccttggaggggctgagcctgcaagaggccgtggtcattgtgagagtctggagtccttctccctgggacagagtccccaaggctctcccctcgtcccaccacgatacgtgtactgcccggcacacagcagatggacattgcaaaggaggtttgctctctttggagatggtcaggggctctcgttcagctcctgcctcctgagcctagaggccccaagcttagtgagacctaaatcctgactgcacaaagcagaccattcctccaagtgcctctctcatgcctgtgttcaggctcactgactggaaggactcccagaagtcatttaagcccgttcttcagcctctatcattccagaatacatttttcagataacctgcttgcattccctcaataatgtttcatttcctctaactcagtaggaaggagatgaaacaagtctaagagaaccaggagccttctgtaagctgtgcaggcaagagagtgacttttgtgggggccaagctttaagatctcttagatagaaaactggaccagcctctacggatgtcgatgctctgtttcttggttttgcttctctgtaaatctgagggagaagacaggaaggacctggggtgcagcccttctttgcctgtctcataggagatcctcacctcactttgtgaaaacccatgctgtctgtaatgatcccaaaagctgctgcaaaatacctcaatataaaagacatgttaacctggacgtggtggctcacgcctgtaatcccagcactttgagaggccgtggggggtggatcacttctttggtcacctgaagtccaggacttcaagaccagcctgggcaacacggcaaaaccccatctctaccaaaaaatacaaaaattattcaggcatggtggtatatgcatatagtcccagctactagggaggctgaggcaggaggattgctgggttgcttgagcccagaaagttaaggctgtaggtgagccgtgattgcgccactgactccactccagcctgggtgacagaacaagaccctgtctcataaaaaaaaaagaaaagaaagaaatgttgaatcattgtagcctaaagcaagaagtgaaggaaacagtttcagggtgtccctgctcccggtgggcgggagaacctggctgcagtagggcgtgcaggcttccagggtaggagtttgggcaagaccccaaggtctgccccgattgggacacaaacctaggagcgcacctttgcctctgtttgctgctctggtaataggaggcgagactggtgcctgcctttctggggccctgggaggctcctgtcacgtggggaaagtgctaagtaagcacccactgccactagcagggcctggttgacagagatgcacggggaagggcgatgagtcaatctgtttatgaaaatcacacatatcgtcacacataccgtcaagatgacccgggggacagctgagccctgagagctgatgagtcttgctcatacttgggggttctctggtgtccctttttggcaacgccgtttcctgtgcttccagaggtctgcacgtgaacagatgcatgactgctgaaccgagacacagggtctctaccctgaacagctctggtcaggagagggaagctgggtgactcatagcagaattcagagctgcgcattggccactgctggggcagggctgcagatgcttctttggaaagcagcttggggtttctggttctctctgcgagtctgcattctcacttgctgagtgccatttagccacaggcacatcagcataatctgtcagaaatatgaattgcaccagtgtagcttgataactgcttataagccgtcatgtggtattcaagtcctccctcaaaagtttccttgttggaaattccttaagtgggagttcccaaaactctggctttggatttagaccaggatgacccccttaaccaaatctcttacaaggtcttttttgcattcccagaaactaattaaaaggcagtgttttgtccattaatgttcttggcctagagaggtaaacttttagcaattggaggttgaggaaatcttgtcccttctactatatccagtagtatcctaaggttttaaaatgtataacctgaagttttttcaatctcaggaatctctgaaaaagaaccaggggttactaaagagctgttcacacagaagtaagtgtgtttcctttagcagggctgtgcctgggagagctttggggagagaagatggcattttagattcttgaactttctgcagaaaacttcgttttagattcctggctttgtaaatgtcatcctccagcatgggatgaagaagtctgtttccacttgtggccacctggcagagctgcctgtgtccctgttgctcagctcagtctcccggggaacaggcagagttacttatttcagatcccaggtccctgggggaggtttgggtggggggattttcaggaaacacgagagcctctagtggctctcctgccaggctgcctcatcgtccgtgcactccctctcacacccgactagaaagtagctcctgggcattttggagttccagaaagactctgtttctgtcaaggaataggacttttcattggggatccacttcctcctggctgtggcctacaccttctgccctttccttgtggaaaggtgggattcaaggctgggattagggatagaagaggaggtggtcagaccctactgctaacatctgctgggctcatacagagctgtctcccatacagttcatccgatccataggctcttgaccttgagggggtcagaccagacagtatacgtgagaggtatgcaaaatgtatctgcctctgttgagtgctcttgtgtatgtaccaggcactgcacacagagaatttaatttaaccctgaaaacaatactttaggatacatggtatttccattttatagatgaggaaactgaagctcagagaggtttggtaacttgcctagtgccaccagccaggagtggcaggatctaaatctcagtttatctggctataatgttacctgttccacatgacaggaaatgaggcagcccagcagagtgatgaagagcttggatccgcagccagcctgcctgactacacatgtacagaaccttgggcaagttgtctcatgactctgtgcctcagtgttcccatctgtgaagtgggacagtgacagcacctctgtgatgggttgagagactcttatcacacacacatagcaaatactcagccctgtgtctggctctggtaagcacacgagctatttcttgaactggcactagaacagctcgcatgctatgggctgcgctcctgccctgccttacctctctgtgggctataaaggaaggattaagcaactctagctccccagaccaggaagctgttcccaagaaggtgtgttgggggtggagatggggctgagtcccctggctggcgcctctgagagagcggcccaagatggactctgcgggtgctcggaggttccagaacttcagtgccaattgtctgccgatcagtgaaggcctttggtaaatttccaccctctgtaacttggccttgttgttttgcatttaccaaagtaaaaataaaatctctggggaggagtggatgagcgcagggcgggagaggatctgctgcgtgttgcaggggtggcccttaaccagctgggcagagcccaggcgccctttcccagaggaaaggctgagcccttctgtcctctgggctttatccattaggaagtcagcctcgaaaggctgcccatccgcctcgtgctcttccccagcccctttggccactccctgtttcctcctattgttggtcccctcctagcctccgggcccagcagcctttgaggcctggagaggcccctggtgtgagctctgcgaggcccctggtgtgagctctgcgaggcctctgttcagcacagcatttcctgtgccttcttcctctctcgcctctctcctctagcccttcattatttttagttcttaagaggatggaatccaggagagaggaggagggaagagccaagttaatgaccttctcaccagagatggagcatttgctgggccctgcccaatagggagggttaggaacatttccattttgggtgaaggacacctcgattcttgagtaaccaaaaaaagactctggtttagcaagattgcaggcccctttgatgccagctcctatagagtgtggatgagggaaggagtgcagacctgaaagagtcgctaaggaagagcattctttgctggtgtctccagtgtccctggctcctgcaggatactggggatgcccacgaagagatgtcccctgcctgccagcaagggcatcacagattgagggatgggagagtgagcaaacagtgactaacctgagtgaaaggttgccctccaaacccttgagtgaaaaagacccctggggcctggggccagccaggctgccagccgtggggtcctggagagaaacccaagcagaccaaacaggaaattcccacaaatatgccccctcttgttacttggagaagtctctagaaaaatccaggtgtgagcaggtgaacataaagcagtgtgagccttggtgtaggtgtgctttatcttccaggcctgggcccttagcatgtgctgggtccgcagggtcctcttatcagccagatgccgggagtattggattcctgccggctgtgcagcctgggggacatagagaaggttaggacagatccccagttccccaggagccttcctgccactgggagacatggtatggcacacaagaatcacgaagcaccccagcttcctttcccttccctgccccacctgcaggtctgctgtgcaggtgccctgctgggaagctctccctcctcccttctgcgtatccacatcctgcatctccctccagcttcagggaggattccaggagtggcgtggggctagagtggcctgagagacttcagggacaaggtagggccagcttgcagattccaggggatctgctggaaggagaggtaggatgtggatacacagaagggaggagggagagctttctgggcagagcacctgcacagcagacctggaggtggggcaggtatgggatggcttgccctgacggattggagtgggcacgccagagagtgagtgtggggccgtatctgggggtggctctgtatcccggagggaccctgctccctcttatgggtggtcagggagccttggtgaggccctgggctgctcctggagccctgtccttgccgtctgggccttgggcaacctcctttggcagggtttagggcttatggtggaagaggaagagtggccatgatggagggcccctgggtgccagtctgggtgctgcccttggcctagaaactaggcctctagttgcaacaggaagaaggcagctaatcaggagacagctgggcagtcactcagggttttcctggttttggccagaatgtgctgctaggggtcgattgaccatggtggcgtccctcaaaaagagtcagccaggttgggagctccagccttcagcccgaccaggtctacgcactgcaaaccagggacccggcagccctcgcagcctgattgggtgtggaggggacagagcgctcacctggagctagtttagctagctagttcactgagctggttcgtgtagcccctgcagggggtcccggtctgcaggggctggtaaggacccatcatcctcgttctcctgccccaggcccagcagttgcttctgaaggagggacttcaccaacccgacagcgctcagtaatccctaccctacgctcatgggttccataaagggcgggggagaagaacctcgtgcctggtgagcagcgctgtggaggatgttcggtgccatccagcctgcgggaacatcacacggcgggtggagacgggggatgaaataaagccttactcgggtcttttctgaaagtgcttttgcatttggcatttagggggattttcttgtttgttaaagggggaaaggcagttagtcttacatccagacttttatttttagctggagctacctgtcctgccaagtccttgggcttaatttttccgatccttggtgtcttggttttgaaagcccttcccctccttccctcccagctcctttttggcaggggcaggtttcgcttttggccccagccaggtttctaaccagggctacaggagggagctattgagccaggggcccctacctgcctgggcttgtacccagctgccgccaacccagctgggccctgccagggggaatacaatgaacaaagttggccaccgcctccactctgcagcctaggagaagcaccaggcttttccccagtgaaggaaataatgatcactagggaaaccctaactgcttttttagaaagaccaaatgaagaaggaaggaaaaaaggattttttccaaacatggaaaactcaatgactctcactcagacttttgcaagagcaaaacaaaggctttgacacagaacaaattctcccctggcaggggcgttcttcatccactttcgacgctttgttagatgtgccttccccgagcgtgtgtcagtaaggacgttctgggaacagacttggagggaggggagagtaggcctttgttcaggcctcccccatctgaaaggtcactcttctgacaaagcccttgctgtttatgtgaggctattttataaataggggggaagcagatagccccaggtccgagagagatgatgggagcccagtaatcctgttggctgagacaaaatccttggaattaagtggcacaaacctggaagctgtgtgaccttttgcaagttactaaacccctctcaacatgtttcatcatttgcaaaatggagacaacaatatcagtgttgtgagagttacctgagctattagcttattagtatctaacactatgttagacatgtaacgtgatctctttgcacacacgcagcagagttcggctggcaataccgttttcggagtgttagagggtccagggatcatttcccatttctgatattttagagatttcccctcatctcttttacccaacaacaacaacaaagggagactctttctttacgattatctaaagataaaagccaagtgatcaaactatttaaataaaaagagaagtgctggaggaaaaagtagcaaattgagggaacaagtcaggtgaaaaagaggctaagaagagaatgtaaaccccctctagaaaatgaaatttgccaagcaatcttattattcaccttgaaaatatctttctttggcagtgcctagcagagttccacatacatgaaataagatgctttgggaaatcattcttctttttgcaacgtcagtgacttgaaccagaaactgatattgactcacttgggctctgactctttccaagttacacatctgggggcctaaggaactgccccatgagttcccggagctgcgatgggcatgggacgggaagctttgtaagcaattaatcacacagttagcctcatctgatcaccactggccacgatcaggccctctgaaagtgcctagttggatgcttgccaatctgctatgccttggaggaaaaaatcatttcaatttaagaaaatagacacagaagcaaaaaaccaaagtgagcctggaaggtttgcctgtctgtgacagtctacagagcagctgtttgtgcctgtcacctgctcaggctctcacggtgactgcatggggagggcagggtgtgtgcattgatacctgccgtgcccagtgtacaccgaggtttgcccatgctgcagctggaaggctgcagaacaaaggttcgttccaacctctacacttgaattgcattctgcgtcatcatcctgccttctagaacaacatccaactccgtgggctgccttttaaaatcttgatggagggggagaggagtatgtatgttgcttcagcccttaatttgcaaggtggtgaaaccactatgggcctggccaaatcagcaagaagggggctggaggaagggcagctgtcttggggtacactgggactggaaggagctgccttcctgaagtcctccttgcttctctgaagttgtcccagcacagctgtggcttccgggagaggaatgtcagggccctgataaggaaatgaagtggagcccgcacctgcccagaatgtgaaatttcttcagcagcctctgaccgggctccagatgggcaagtgcagcccctcccacacctgctgagtttgatctccctcctcctggatgctgtgaggcttggcacctgcccagccaggcactcaggaaacctgctgggggtctctgagcgcccaccagggtaaaccaaggtccctttcttgtgttaaagagaagaactgggatggaagcgtgcccagggctctttggaagcacccaggaggggcaatggaaggcttcctgggaagagggtttctgggttgcattttaaaatacacacaggagttagctaagtcctgagcatcctcagtcattcttctgcaaagtccctaatagcagaagctgacacccttgcgggcctaaggtggcgtggggacaggtgtgtggagcaagaagttgcctgcagaactccacaggcctgagagaatatgagcccgggtgcgctgcagatggtgccatgtgtggatgggagtgggggtcaccagggctgccagtgacctgcagtcctcacgacatacaagtgtctgcccccagcgtcacaaccctttcttctacccaccccaaattgcactgagaaatataacattggtttggaggggcgggaattggctggaaagaagacaggaagcagaccccagggggcatgtgggctgagctgaggatcagacagtgctggccctgggtggcttggcctcctgcggagaaggctgggctgggcagggcaagtggccactgactggctcagacagcactgcagggacaggaagcaaggccagactctgaacaacatgcagaaggctgaggtctggttgcatcctcaccgctcctgccaggcctttccaggggacttctctgagccccaaaaagagagccacaggtgccggtggccttgagccctcccctgccctaggattgaggagcctctggtcattggctgtgagcaggccacagaggcctgcaggcctggggtcacctgctgtctcctaacgggggccatttcctccccaggaggcagggcccatttcctggctgagcagtcacagggcatgagaagggccccgagcttggtgaagttctgctttccccatcatgacattcttactgaattttggacaagggacccctcattttcattttgcatgttatgtagatgatcctgatgatagctaaagcattttgtaagtggggtggccagaggcccacacatccccacagcctagagtagggtaaacctgggtctctccttcccctccttcctccctcttcttcctcctgccctcctcttcctcctcccctcctccccacctcctcttcttccttcttctctcctcttccctgtcctcttcctcctcctctttcctcttcgtaccctcctcctgctctcccttctctctcctcttcttcctccctcctccctcctcttcctcctccccctcttcactcttctcctcttcttcctcttcctccttcctcctcttcccctgtccccagcagtccttttttgcctgccttatgaacgacaaaggctagacctggaggttatgcccgtttgccctctgatttgttgaaggcagtgtttccgtacagcatgactgaggatgcctgatgggaaggacccggggaggatggcgtcacccaggaaccgttagcatcacgggagggttgggacttgatccagaaaaacacacagaatcagaccctccccaggcagccccactggctcggggcagctccaaggatgggctggaggtggggaggagtaactgcttgcccaggaaggctccacacccacctgccacagaaccctgggtctgttttatggctctgtgtgttgagcaggaggagatcattctgtgtaggccttggcccccagggagtagattcccatctgctcttcagaccaggaacttctgggaaaaggggaagaggaaaagggagacaaaatgtggcatgccctgagcttccccaaggcgagggcttcctactcccaggtgacgtggggagcagaatcgggagctggggcaggcttctctctgttgcaggggaatgtggctgctgtctgccggctcctcaagctcccttcgcctctgacttcctgtctcctccaatgcaaagatggttggggttttgttgtcagattttttccctcccactacaaatctctctccacattctctgaatattttagctctttcaagtcgggtgccaggggacaaaaccacaccagaggtctccaggcctctcttgagtttcaaagaatcactcccctccccaccaccaccacccctccctcaccctggtccggctgttttctgatcctttctttccacatttctctgagtgaattgaagctccatctttccctgcgcttctggagttcagcacgagactctcttacagagcagggtccaggttgcaacaggcaggggtgacaaatgtcagcagcaggcactgcccaccctgcctgcagaggagcagctaagcaaagctcagaccagtgctcttgtaaccaggagtgcagccacctagggagttccccagctggttcgcatccaagcctgtgaggccgggggttacctgaaagacctcatgcctggtcttcagttggtttaaccaccctgcccagaatcaaagtaaaagccgtgtgtctccagcccactccactgccctttacctacccaggggcacccctgcgttgtggtgctttcctttccaccgaagtgtcctcaagaacatcacaagtgcagaactccatccggagtctagaagtgtctggctgctctgatctgacacatgggagagcttaaaccttgtgtcatctgacagctgcaccggaagtggcacctgagcagccccagggagggatgtatctggggtttcggtggccagctttaggggcaccaggggccctgggctcctctgctaacggagcagccagaaaacttcactgggctggcaccctggctgtccaggggaaccgccctggaggaatcttgctcttgtccttcctgcccagtcttctgcctcttgtcccctcatcctgctgtctcgagactggaaggggcactcggaggtgggccctcactcgttgataggcacggaagtgggtgaactggctagaggctccccatgtgcatggtacctactggcagggcatagaatgggatgactttggagaagtaacttgctgagcctcagactctttcatctgtaaaatggagaaaacactcctaactagaacataggaacaaggccataattctctaacccgggcctgtcacatagcgagagccccataagtggtaacaggtatgagtgtacacaccgtgccatggtactggtgcacgcctgcagaaatgggccctcctatctccccgagagatgacaaaagcaatgccggccagcagcaagtccccctgcacagtactactcagccagcttaggaagaaacccagcacatccactggctaggccgaccccacatctgtgtgtgaggaagtaagggtcacagcagagctggccacctgccccaggtctgccaaagagaggctcacagccccaggaggccagcagggacctgccacacatagggagctttgggagcactccgggaggtgtccacaagggatgtctcgattcccctgatgactgggaggtgatgcaggagcaggtggccagctctgccctgggcaggggaccaggtaccctttgccacaccacgttcaaggcatttgaaggccacttttgtatttcctagagctgggcttgagaggctggagacctgggacggggtctgatttcagacagagaagagacagaggctgctgtggagagctcactcttgaatatctcccacaagggagggctggaggggcacgggataaacccctctgggtgggattcttctgggttgtcctcctttcttgccttgttacctgtcttatctgggggatgaggcctggagtccatttctgaggactggggcttcctccagccagtgcttggagggagggctgttagcctgtccgctcctggaaagcggcgtgtgcctggagtggatttggttcctgaggcagatgctgtggtctccccgaccatcacaaggacattgattctctggaatctcctcccatcctttagttcatctctgctcctaggggctaggctggagtggttggggtcaccctgcagccctccttccctccttcccccagcctggacctggaaatggctttttctgtttactgcttggcagtgacattaggcactgcctgggtgctgctatttaaaaaccatggggaaaccctgtgtgctgctgctggcagagagaaaagaggtctccagtgcaagtgcatggcattctcacaagtggaatattccacggccctcatccaggcagagcagccttgggactgggggactctcagggccttggccacgtgggacctattttcatggtgaagaaatggaggaggtgtgggcagaggggagccaagcggtaaaggtgcctggtttggtcagagctcagcgatgtgagaggcttgtggatcctttgaactgtcagaagacccccaccctggagcaccccctcctttctagacccctggtctttagcctctgggagaggtccaagaactggaagtttcttagcttcaaatggccttgcagaggctaagccacactgtctcgcccagcatctgttcaccttcctgggtcacaggctccctgctcactgtgtcttgtgggtctctggagagctgcaccccaacaggatgggcatgaccctgccccaggctccgaggtctttattgttcagaacctaggccagcaactccacctagcacaggactgaccattcttgaagtaacttcagagacacctgggtcccctccttgaacacagagggctaaagaccctcccacagacaccctggtacccacatctcctgacagctttatctcctgggagaatgggaatctatgtgtcgctctttttacaaacaaggactaagaacttgttcaaggtcagtcattgaggaggaaaaggggagccgggactcgggcccaggttggcctgcctcaacgccccacgctctcccgaggcctcgcctgctcacctatctccctctgtctgcagcccccatgcccatagcaggtctggttcccaaccactcccagttccagtccccgggcctttgtccccacactcccgctgccagctgtagtcttctctttctctccactgagtctggcccccagctgtctctggtgggtgcagcctccgtaagctccctccttctccacagtgagctgccttctagggtcctgggacccttcctccatgcatgctcatttgcctcctcctgtatacataaaatataaactggcacgctgcagctgggagagtagccctctctagtcttcctcggaggggccattgctgttgggatgagggaaggtcactttccagggccctagagtgtccatccatccaaggagcctggtataccagctgtctgtccctcaccggacacaggaaactgaggccccaggagggactgtgaaacagtgcaatgtgtgttctcccctgatagggacatggcatgggttagggcgagccctggattgagacactctgggctcccctcctcccacaccacccctgaagcctgtcagcccctgtcctctctgagctctgctgcagggatgtgacccacgggtggtgaccggctgtgcactctccccctggacccaccgtaatggcttccccctgagcaggggcgtccccacgagccactgctgggctcatcttgtgtaatgaggtttttccattgttgccctcatgcattgtgtgccctgattgtttatgcagccttctgggtgcttagataagaaatgcctccgctggctctagccttctttggcgatctccatcagaaggatctaggaaaaacatccttgtcagtaaagcctcggcccttttgtcacatggcctcatggggcgctgccctctcttaagaatagaattggtcttggcggtggggtgagagtttctgggatggggataagaattaccaggtttagtaaggaagaattcctctccttaaatagattttaacttgaaaacctgatgacagaagcggctgagtctcagcaaagagagaaaaaacaaaggaggccgatttcaccttgacttcaccttggggacccagcagccgccgctgacccctgagggctgcagctgggcgcttcggggcaaggagtgggaaccacatcttcagtgtgtccccctgtcaggcagtaccaccctcatctcctctgcaagccacatggcttctgctctccgtggtttagctggtccaggatccactttctcaggaactcacaatgcttctcattcaggttctcatcgcccccctgaggacgggtgtattttggggacacttgatcttcatctctgcagcctgttcttattaaagttcacttaaggatattttttctaaaaatatgttttttttttgtttttttgttttgttttgtttgtttttgctggggaagaaaagaattttattaattttatttattttcaagtagttgtataaatgaatgtttaaatcccagcttcgtcatttacctctctgaggctcaggctccaccagatggaaatagaaaagaattgacttgcatgctcattgagaaaataaaataagatgctcaatataccttagttctcctttctgcccaaagggcctgctctccccaaacacacatgcacgcacacacatgcacacgcacacactcatgcacacatatgtgcatatcacacacgcatgcacacacatgcacacatcacacacatgcacatatcacgcatgcacacactgatgcacacatatgcacatacatgcacatatcacacatgcacacacacgcacacatacgcacacactcatgcacatatcacacatgcacacacactcatgcacacatgcacacaatcacatgcacacatgcacatatatcacatatgcacacatacgcacacactcatgcacacatatgcacacacacatgcacacacacgcacacacacatgcacactcccagtcctggctgttttcactgaagaaacatcctgagagggcggagcgcggtgcagaggagagagctgtgggcttgctccctcctgtgtgacctgaagccatcggtgcaggttctgttctgaggaatttctttaaagtctctcttcaaaccactcgcaggcaagaggtgcctctggtgcctccgcatctacgaattgaatatgaactaatgtggtgcggctgggtggttgtgtcctctccagccttccttggaggggtcgttgctcttgggacaggggagttcccctgagcattttgctcaggctgtttgttaaatggggtaaagccacctcccaccatgtgccgcataggtgatggtggtggcaaggtcctcagagcccgtcaagggcccttcccatcttgtggccacaggcaatgagggcctttgctttgaatttgtcctaaccagaaattagtggttgtctttctaatgtagagctttttgtttgtttgtttctagagcaaatcatggaggaagataaaaaacatggtgcactggtctcccttcgtcatgtccttcaagaagaagtacccctggatccagctggcaggacacgcaggtagacacagctctcccagactttcccagcatggtgctcagccctctggggaggtgccctggacgctgcattctggggatcaaagctccagagcaagttccctccaagactttctagtctgaaatcacagccacacttgcaggctgcggccttaccaatgccttgtaaatgccatagacaacggacctctctggagtctgtgttacccccatcctccaaaacatgcatcctcccctccctcggtctctggctcttatctctgtctcttccagtctctttctttctgtctctcttcccgttgtattcaataagacagatgaagccatcagtctttatagcttacctgccatttgtcaccctggacaaagaggcaaagctaaccccttcattgagcacctactgtgtgcctaaattgccatggtcctgggggttgcggcattaatggagatgtagtttctgccctgagggagcctgcagctggtggaagatgcggccaagccaccccataactgcagggcggtgtgcggtgttgggaggaaggtggctaggagctgagtccaggcagtgccggggagaagggacatctggagccgaggccccagagccatctagcccacatgtaggaccctctggaagcactgtcatctggagacatgtcaggggctgcctgtggacttggccttcgtgacttcaccagcctcctcaggccagcacaaggtcccgcatttcgcttacctcgttggccacactggcccaactcaaggcacatggatggacagcctgtgtgaatacttacttggtctggctcagaagaagtgccacccaggtgggctgagccttaggccccccagcttctcagcctgctgtatctccccaccttggctctgaatcctgtccaatcagggtttctctactgaggccaggagacaccttcgttgccgagaagcagggctgatgatggaggtgaggatgaaaatagcaacactaaggaatgactgggtcgtggcacctcagtctctcacctagctctgtacccttccagcagggaacactggtgaggaggagtctggagtcaaggaagctggggaaccagctcagaattacagttagtgagtggggactaggtcttgaacccactccccttaaggtgctcagtccatagcagggacatagacacaccttcagccccaggcttagccatccccagggaggcccagaccctgtgctggggagggtgcctctgccagctacctgcagccggagaccaggaaccttctacacttgctctccagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggtgagccaggcttctcgcagcccacatgcctgcctcagtgcaagccacatggcaggtgcacagcgtggcactcagggcttcccggaggcctcacaggtgcaagggcaggctgaggaggctgttggaccaattagagcctccccatccccaggcatctcccattatttgcagagggttccgggacctgggctttgcccatgatggcccctttccttctccagtgagcagaagccaggggctggcggaaccagaaaaagggcaccggctgggttctgaggccccctagagagaaggaagagagagctgcccttggttcaggtgggatcgctgggggtgcggggagccaccaggtagggaggtcgcaggatggtgacttcctgctgtgtgagctgcaggggagatgggaatcgaggtctttccatttccccagccctggtgagtgggaagagagagtggctagtagaacatgctggtttcccaaaaaagacctgtatctgcctaaaaggaggaggaagcccctgacggaactcaagaaacccacatggcaggtcaccgcagggccccaggtgagcccggagcagtcactgggcctgtgtgcaggactggctcccacccccaggttcctgacaggggctcaggctcaccctgacacctgcccaggggataagcctggagaggactccagggaagaggagagaggaagagggggcttgaggaggcagggcagagagcagacagggatgcctgaggccggctgctgtgatctcggggctcagttttaggcagccgggttttctcattacctctcaaactgctgcccttccaccctgagtcatccacagcacggctccttctcccctgtgcaggcttggtgaacctccctaaggctgtcggcccccatggtgtccagcgtgcggtgctcatgttgtggggctggccctcactgcagcacccgggctggacggccagatgccaagcccccccatgcttccttgcagggctgtctgggaggccaggcacggagactcagagctcagagcagaaggctgtgtccactgtgactggtttaaccggattatttctcataagagcagattgagaaagaggggtgtgtgtgtgagagagagagagacagagacagaggccaggagagaagagagctaagccagccagcatttctttccttctttcctttcttctctctcctcctgggagttctgtcctaaaatcacaccctgccactgactgttgtgttctctcgccatcactcacagggaaagaatgggggatggagaagcacaggccccactgtttgctcttgagccatccctggccacctccctcccaccatccaagttccttactatctttagcccacagggacctgggatagggcagggaggagaaagaacatgcccccagccagcccgaggcctttgcttttcccgagtctgatttctgacccaggatggcatccactggtgcaccagaatgtgtcctctcaggggaggcccagcccttccttccaacccagacagcagcaggacttcgcaggtgaccacatggagaataatccaagtggtgtccactcagacctggccaaaaaagtacggcctgtgtgaagaacactggctgggcatttctggaagtcggctgtcccaaagacacagccagccaagcacagggccaggctgccccagaacctgcctgctcctgctggggacaggagccccgcttcctgccccagggctgcccccacccagccgcttgacttccgcagcttctctctgattgcaccctagtgctctcaagagagatctagagtgaccgtggctggtacccatgtaacccatcttggcaggcagagggaagaggatgagagaggagtatgtgtggaggggaagaggaaggtctccccagaagcagggtgcacccagcccgatctttcctgcacacaaatcctaaggacccttcttgttccaagggctatgctagatgcttccattatttatcccattgcgttctcaccgccattctgggagatgggtcatgttccagtgtaagcaggagggttctgtcaccaggaggttcagtgactcatcagggccacccagccaggcagcagcttggtgcagttctgcaccaggcttgcttgactgcaaatcaggcccccagctgcagcccagcccttcccaagggggctgtgtgggacccagcttccatggcatttccctggggtgccaggctagttccatttgggccatggactgtgccttcccccaaatgcgttcatccagaacccttggctgcagggcctctcccaagactggctgctcatggtcacctctagaatgtggcctttccatgacagggtgaggaggctggagcccagggttacctcacatgctgagtcccagggcaagagagtttgagacatgtcacagagaaagggaagggccggtcaccaaacaatgctgggcatggcgggggcagaagggtggcactaaggagaatgtgatgcagttgctggtggcgtctgcacgtcggggcttcttgggactctggctcccgccgacatgtgctcagtggctctggggcatgctctgagatttgtgacttgtcctggagagtcaacactgtcttcctgacattgggaccaggggcctggggagtgcaggtgagagcccgcccctagcacctaggagctctgggtggctttcgcctgccacctgttggctccctgggctggcctgtctcaaaggagcacttcctccacctgatcttgagtcccctcctcccccagcgtcctgtgagtgggcgagcaggtctctgcttccctgcatggcttggagcttcgactttgtctcgggcaggcaggggagtgtggggaggggctgagcctcaccttcctgtgggcatcccgccccaccatccagctggcaccccctgtggacatctccccccagcctctttcctctcctgggcagtgagtgactgcccgctttgagccacgggggccctttttggagaaaggccatgtgaaaagggatttcacattgaggtctgcttcctgtttaagggggtgctgagagctctttgcagaagtgcagccacccaccatgcggtcccctacagcgccctcaggagtccctcccacagcctggctgccccttttctacacagtacacacatggatgcacacgcagcccctgcctcaatgcccccgtcaccactgacctggctctgcatgtgaggggtgtgctctgtgcgtgtcctgcatgggtgcacctgtgtgtgtgcagtggtgcacaggagtccgcgtttatgtgcatgtgtgtgcatgagcacatgtgtgtgtatgtgcgcacatggttgtgtgtgcatgcaagggcccaacccaaagctactgacttccccctccagccctcatcacctcctggaaggtcctaaccagccaggcctaagttcacacccaaaggatttgtttttttcttcccttttctttccgtgcaaatttcaattaatacagtggtttctaaagcctgtcatttttaagaggctgtagtttttgtttagtctgttctgggtcccaaaccagcaacttggagaagttggtgggcagtgttggaacaaggcctgggagacagatgcaggaagagtggagggccaggtggagggcaggcgggcggggcctctgtgggcagctcccgcccacacagggcaaaggggagaaaacttccccatcctgcaactgacactgctgatttctgcctcctcaagggctgtgggcagcctctgagcctgttgtgtagggagactggggctctaaaaggagagcagaggagcgggggtgggatgactcaccccacctctgctctggagaaggtagaagcgcagagctgtgtgctgggggaggtggcgtgtcccggcagctcagggccagcgattcagcccccggctgctcaagtgctctgctgtccctgcccctgttaccttccccagtgtctaggtggtccccgccagttcagctggagctgctcgtgtggaggccagggccgtgaggcagttgagttggaagcattttctcaggctttttggactgggggctcacctatgaggaggcctggtgtcgatggggtggggtgcaccaggcatgtctctgggatgagcagaggctgagggagccccctgcctttcccccacaatacggccttctccatccacactgggaccccttccaaggccactttctgacctgaactttgtgctccagaagatttcacctctttggaaagagccagagacacttatgggcaggctcagccttcaggctgcctgagagcagcagagatggggacttgaggacagaccacttctcccaccaggacaggttctggctttggaagccctcgctttatggaagggccgaggcagccaaggggatctagtggggccctgagtagaccctgcccccagtcccctctcttagctccaccgtagcagcaggatcaggaccagccacccccgacaccccctgctgccctgcctccgtcttccttcttctgctggttcctgtgggggtctcccgaggaggagctccttgggctttgtgaggccagccgatgggcttggagtgaaagtgaaggcagtccgattcagtgaggctgcaccttttctcctggatcaagagccaaccccaggctgggtggtggtgcacacctgtaatcccagcactttgggaggccaaggtgggaggatcacttgaggctagaagtttgagaccagccggggcaacatagcgagactcccttatctactaaaaaaattgtctaaaaaaaaaagaaaagaaaaattagagccagccccagctggaacagagtctgccgtcccctcggaaagacgtgccttgactcagggcactgagctgactgcagctgttgggcaacacacgccccaaaccttcatccaccaggcaggaaaggagctgctggtgagccctgccccaggcctcggccctcatgtcgccttccctcccacgtaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaaggtgaggccggcgagtgagggcagcctcgggccccacccgtgcccacctcagggggcttggcttctctcagcgccctttggaagctgtaagcttctccaggcacaggctcagaatgtgggtggcccgccccaaggccagacatttggagacatcagcctattcctcaggcgggatggctgtgtagggggctcaggcctcagagcagagtggcttctagccctgcccagctgtcagccctctgccgaggactctccatttagcccagacggtgcctggcaccgaaagccaggcgagaggcacctgcgggatgcctgtggggtagctggttcattctgccatggctgcaaactgggactggcagacaattcggggaagggaggagcatgctgaccgcctttgatgttggagccagggtctctgagaaactgcattctctctgctttgctcttcgatctttttttggaaattttaaaatatttattggaacagaaatagaaacataagctccaaagaaacaacatgacaaactttataagtaaatgtaattttcccctaattaatatatttactttgtgtttgtggtttacaaaatgatggctctttcccttctatccctttgtacctatgtgtatctggcaggaaagttcttagctctggctatgggcacacagaagcttcctatacatgattatgttcaaatgttgatttactttccccagaataaattggggaactggcactgtctggattggtgactgtctggatgatctccctgtccctgggcccctgtgtgcacccttgctgttaaatttgcaagagccgggctttggggcgccggcccctcagggtctcagaagctgtccctcttgagcagatggcagtccctgtggggttgtcgggtctcccattctctgtccagtcatggtctgcatcatctccagtgtccagcctggagtcagggttgggcagccgatggtcctgatgggagggtcccctgagcctcctttcagatggcatttagacgtagcttccgcagctgtcaatggctcgctgcccacggtggcatgtggggaagtttttaccttcccccgggacagctgctttgcgagctctgggctgagaaaggcatttgcccccttctttgtcttttgaaaccagcccttccctcttttttgcatccagctctgagactggatgcaaattccgtacccatccgccttctccttaacgctcgctttcctttctttattagaaacaatccactttcccttcacctctccctctcgagcaggatgtgctcctggtctctgtctattgtccagccgtcagaacagccgacagcctgtcttcccactcagagagaagccagctgtcttcaccatcacctgcctgccccgcccttagctaagaggctctgcctggggtgcactgcccacagcccccggctctcggcccctcctgcacccagggctgctccctcagccccaggtcctgccagtcctgtcgaaggcagccacagtgaggacacagctgaagtactctccagcctgagggcagacacggcccactgttgggactcctggtggagcattccctttgtccctaaagaacagatttcctcataggtcagcaaagccccacatgagggcccaggacagcctgaacagagatagtgctggggccaagaagatgggagtggggtgggcgagggagcagagatgggcagggctgtattggatcctggctttcagaaaacgtgaaagaagagatggtagattataaaggaagtcaagctgagctcagggcgggagcaagtctctcctccctgtgctgaggggaggtgcctctggcgggcagggacctccgggcaccggttccagggcccgggccccagagtgggaagtcgaggccgaccctctctcttggccctgctgttgcacccaggacaggccagccccgggtcatgctcctccatcctcagcctggatgcccttcacacctccgggcctttcctaccactgttcactcgcctggggatgtcagcgccaccctctgcgttctcctgtgtctgggcacagggcaggctcccctctgctgtgcacgccacctccatgcgccatacgtggacacctgggtgcctccactggccctgccccaggttcagatggggctcgcctgctctgtggtgttgggtgggtgagaacagtttctgcccgagggtccctgctgaccccctcctgggtggggtgttctctttctcagaaagaagacggcaccgtgaaccgggacttcaagaagaccaaaacgagggagcaggtcaccgaggccttcagagagttcactaaaggaaaccataacatcctggtgagtctggcacctccagagagggtctctccagccagccagggagggacaactgtgtctactctggaggtgcccatggggaggacaaggcacccccagggacagcacaccccagcccgagttcgtagggctctgtagagaggccactggcagagacttttgtggctctctcactctgccctttcaaaagtcaaaggcacgccgggcacagtggctcacgcctgtaatcccagcactttgggaagctggggcaggtggatcacctgaggtcagaagtttgagaccagcctggccaacatggtgaaactccatctttactaaaaacacaaaaattagccggacatggtggcgcatgcctgtaattccagctacttgggatgctgagacaggagagtcacttgaacctgggaggcggaggttgcagtgagctgagattttgccattgcacttcagcctgggcaacaagaatgaaactctgtctgggaaaaaaaaaaaaaaaaaaagtcaagggcactgaagttagtacccaggaaggtttgtatccatcctggccccaggcttctgcttggaaagtaaagaagaaggcgatgtgcttgtccctggcgtgcggcgggtaggcggggaagcttggcggacactcactgactctcccttagccatcggccccatagctccagagagcatttcccatgccctgagagagagaacagtgcccgccgtctgccaggtgtcatgccaagcgtgcagcaaatcttcacagcagacctgctgtgggtagacctgcttgtccccatcttgtgtgcccgaggtcacgctgctccctgccagcaagagctggcgagctgtctccgagtccaggagtgtgggttgtacaagttcatgacaaagttctgtcttgtgtgttgctgctgcagcggctcgcagactggatagatgctctgcccacagggaccagagcactgacccttccagctgagtcagggaatattgtgccactgtgccccaagtgcacggctccctgggacagtcagagatccaggcacatctgggacacgggccctggagcccctgtgaatggcaccttctgaacagtccacagcagctgcagagcaagtgggggcggaccaggcagccgtttctccaaggagactcagtaccggctggaactgggaaatcttccttttccagctggggaggcttcccttggctcctggcaagctctgaggctgcaggcagggggaatgtgcctgactctttcgtagcccaagtcctccaattcctgagtcccttgcaggggaggatctcagcccctaagcagtggccaccatggaacatgcctcctatgcctggggtttgttcctggtgctgaagactccagggggctgctcggctggcccggccagctgtcactcttttccagcaggcattgaggaactctgtgtacctgtgtatgacgagcttcccaaggcagcccgggggtgagacccacagagctggcttctggggaagatggggcaccccccaaggccagcaaagcttgacatgggtttatagggctccatggagagggcactgggagagatatttgtggttctctctcttaccctgtcctttcaaaagtcaaaggtactgacatttatgctgagaaagacgccacagcagccctgctcgcaggaagctgcctctagatgtccggcgtttagggtaaagcacattcacgggagggaccactagaggccgcatgggtgttctgacactgcccttccccacgcggcgcttaaaaatctggtcctctttctattcccagatcgcctatcgggaccggctgaaggccattcgaaccactctagaagtttctcccttcttcaagtgccacgaggtagatactgggcttttgccctcttgagcagaatgctgcgcgtgccaacaggccttctccttctccttccagaagcccggggcatcgggcattttcagggtggtgcagccagaggcaggccatcagggaccagaccctcgctgcacgggggagctgcgtctcaatgcttcctggggtgaccacacgggctgtcctgcctgagacccctggctattgccccctttctcctcccttgtccttccagctccagagtcttgtccattctgggcagtggtggcaggactcatatcccacacacccgtggtctcagggcagaagctctctgagctgctagagtagccaggcacccgccgaccgccacctacatcttcagatgagaccctgaggagggcaggcaggtcttcaggtgccactctcgggcagggctggaatctcccaactttgcatacgttggttggcaggggcagcaggcagcaggtggggaactgagacacctgagagaggctctgggaggtgtcggcaggttccctggaggggtgtgagaccctgacatggggagtccaggtccccagccacatgacacattcacacacacattcacagatcccacactcatcaatcctataccacacacattcacagatcacactcataaaccctacatgcacacaccttcacagatcacactcaaaccctacatgcacacacattcacaaatcacacacattcacacacatgcagatcaatcacatgcatgcacacacattcatacagcacattaacacaagtcatacgtatacaaacacacacatgtattcatatatccacacacatttttgtgtgcacacccactcatacacaaacatgcatgcctttcccagtctcacacacacacacacacacacacacacacacacacacacacagagctgcagtcctggggctggctaatcccatgggtgggtgggtgtgaagcgggatcctgcggctccctgcagctgtgtaggtagttcaggaaagcagcccctctcgtagggactctcttgtggaggtcctcttgtatggggtcttacatggaggtggcctcagcctcagcctatgcccacagagaaggctgcggagccagcaggaggaactcatagggtcagccctgaggcagccagcagggcggtgcatctttctgcaaactacaccaccaggcctcctcaggcagatggtctaccttgctctgcatgtcattccctgcggggcgcctggagaggatggctgcgaggagggggtggcacacccagagaggagactcaggctttgctgtgcccctagcagggagctcggtccttctcggaatgttctttgctctccttgtcccccagaccctcagctcctcctgtggcctctcctttccacttgatgaagcatcctcctgccacctgccagagccccctttgccccagctgcctctctggacgatgggggtgctgcctggctgcctgaccccaggggccaagcctgggagaacttaaggccacagagctctgtctcaaagccgttcccacccttcttcaacacttctgcttttatttcttggaaaagcattttgttctacactttttggggtctcccttaaggtctagaaagaggccaaatcagcttgggtctgttgttttccacctgcgaagaggaagccccttttttgggctcagcctcgccaggggccccacctgccctgcactgctggaagctggaatgtcacctgagccctttctgtgcccccggccttcctctggccccactgaggtgatgcaggggtatgtgtggccatatttgggaaagcgcctcgctcccatgcagaggctctgagctcacccaggaggggcaggctctttggtgcccactatccctgggccaggctgggaaggccctatagggtctgcccacgctgaatctgcaggggttgtgctgctggggtgggggtgctgtgtgcatttgaaacaggttcttcaccacccccgccccgggatagtttggacgctcctgggcaccttccccttcactgtggttccctgcagagtgtttgggaggagtcaggttctaggaggcggaagggcgaggccccagattgggttgtggtctagaaagagtggaaagtttgcccaggtgcagtgtgattcatgcccgtaatctcagcactttccgaggccaaggcaggagaatggcttgagcttaggagtttgggaccagcctgggtaacatagtgaaaccctgtctctacaaaaataaaaaacaaaaagttagccgggcatcgtggtgcatgcctgtagtcccaactactcgggaggctgtggtgggaggatcgcttgagcctaggagatcaaggctacagtaagctgaggttgcaccactgcactccagctggggcgacagagtaagaccctgtctggaaggaaggaaggaagggaagaaaggaaggaaaagaaggaaggcaggaaggaaggaaagaaagagggagggaaggagtggaaagtgtgcaggccagagtcagggggtgaaggggtgcctgctgctgcccacacagaagggtggtcgccgaccctggaacccgatgccctctgcccaggcatggccattcttgggccggctctgctgcctgtctgaaaatggggattggaattgcaggcacccaactgtccggcctgagcgagcctccccacctggtcacccaggccccgggccgcagtggggagggcgaggcccgggcttcagctcacccttcacccccatgttctcctcaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttggagaaaactgaactgttacaaacccctgcacagtgcctgtcaaacagatgcaaaccttcctgaataaagccttggagaccagcgctgtctgtggtgtgatccttctggcccccagccctgagacctggctgaggggcaggctggggagtcttaggaagctagagggcccacatgggggctgttaggggagtgggtgtcagactgggtaacattttaatttgtaaagaatataaaccactctccaaaatgagtcttttcaaccctcatgaaactttgaaatagtagctcagagactagaacatcaaccaagaagcactgtccccaagtaggggggtctccggtgcagcgatcgcttctggggccttactctaagctagactggggctgaacacgcccatcggagttcccgttttacccagatcaattccctgaacaaagatttatagtctgttttacagatgaggaaactgaggtttaaatgaagcaacttgacctaagtggggagcagggatttgaatctagaatgtgccttgattgaaaaccaattttgtcgtcctcctaactggcagtgggggggtgtggggagcagtgtctggagggcagaaagcttgtcttatttttgtcccagatcccaggctctaagcctctgacttggcacacggtagcagcccagggagggtctggagaactagttcatggctacttggctggggcatccaggaaagacctttgggggtgaagcccctgccacacatcatgatggtttcaccatctgctaccgtacacttttcctttagtcctctccctagctctggattgctgggggcttcatttgcagaactcagaattctttatttggaggtggaggtccttccttcttctcctttctcctttcttgtttcctttcctcccttcctcctccctccctcttttcttttcttttctcttctcttttcttttttcttttcttttctctttctttcttcttctttctctctctctctctccctcccttccttctttcttctttttgcctcctcctcttcctccttctctctctctctgtttctttctttttttaacagtcttcctctgtttcccaggctggagtgcggtggcacgatcatggctcactacagcctccacctcctgggctcatgtgatcctcccaacttagcctcctgagtagctgggaccacaggcatgcaccaccacgcccagctaatttttttgcattttttgtatagatggggtttcaccatgttgcctaggctggtctcaaactcctggcctcgaccagtcctcctacctcagcctccccaagtgctgggattacaggtataagccaccgcgcccagctgcatcctttctttatcatcactctgagaagtgataggctgtgagtacagatgatgaaagccacagggcctttgcacctgctctccacaggctggcatgtggtaactatgcttccttcagatttttgtgccttcacttacatggtattgttggtgatgctacagcaaccagctctgcaggtgccaagcaatgtccagcaatggagccctttattgccttgagaagggtgggccatccaactgcagaattccaccctgcggtctgttttctaaggagaccagctgtcccgtttgtgtccttgcaaacctggatggtcagtcaccagttgctttccaggaccactgctggcaccaattgccttagcctgggccccctagaaacaggtcactgtggccactgcttggcagcaagtgtgattgactccttagtctcatgggatgtcttcagagacactgtgtgaactgccgtgtctggggacagtcctcctagaggaggcagggatagaaatatctgtgccagctcccgctggctctgtctcccagtggtcagtcttcccggagggtgtgatttctggggtggcaccgtcagcctctccagtaaccatggagcccctgagcctgtgcacagatgtcacatctccatagcatgtccctgcggtggtggcagcattggtgatgtggctccaagaccacaggcaccgtactggccatggctgggtgg

SEQ ID NO: 12066 - DNA, 7055 bp, Human
caccagctcaaaatatatacgcaaaataatgaggtggctgtcacattccagtgttctggagttttgtaagagaaagagttttacgtggttgcccagttttgccattccacaacataagtgactgcctgcattgtctggcactgaccaggaggtgaaacggaagatgaagggacaataaaaggacatgggtgcctgttgtgcccaggagagccggaggtggaaatcctatggaataaatgagcagtgttttctatggtgagctcagtttttcctcactcctcatcctaggaatcacagcagcatcttgggctcaaaaagaagaaatgttgaaactccagagcagatagcaacgcaaagagacactccttggggaattcaatctgacaagtatgtaccaagtctccaccatttacaaggcactttggtagttgctagaaatataagttggctaggacctactctgtgccctagagaaccccatggttgggagtggtggtgggaagtattgaccacaaatcacttacttaaaattgaattgtcagctaactttgggtgggtgaggagctgtctagacaatagttcctcttctgtaaatgatttgaatgatacaataaaaaacagactttttaaagcctagggttgagttatattagattgctaaaatttctggaaacaaattgtgttcaaagtaaccacaataatttggaaaaataagtttaaagaagatacatgtaagttatctctgggcccagatcaagcaagaggtacaagttgcagaatgaatgtccttccagtttaacaactagagcgctgcaaattccctaccacaagggcagtgccaaaatattaagtaaaaagtctaggtacaggtcctgctctcatcccttccacgacaggcttgagtcataaagctggactttctaaccacacaacttcgacttcgtgaatttcctttcccatttttcctcttatttccccgccaacaggaaacctgtgtagtggataaagaccaggctgtcactgctaatcccaatcagaaacttggtccttgattcttcccagtggccgacatctccgctgcgaaaacgggtgtgaactattcactaaagcagcagggcccgaacgcctttaacaatccatttccttcggactccgtttgcgaagcccatcagcacccattactccctttggcttcgcatcctagcagaagctaaattgtttaaacccccgctcctccccagggtttggcggtcctcgaccctcaagggaacctgggatgccggcgccaggcttgcctctggcccagggcgcccgcctggcctgcactccctccctggacactgggcccgcctgccctccccgggctgtacctaggggtgtggaggccagggtgccggcgcccgcggggccgcggcgggagctctcccggcccacgggccgaaaaccctggcgactgggacgcggccaggcgggccgggggcgaggggcgctgaccagaagcgggcggagcctagggcccgggccggcagcctgactccccgtgggccggctctgctgggtgggcattcccgcggggcgccgaggtacaacatgagggctctttcgctgacaccgaggggccttgagggctgcaagaaatgcaggcccggcggctgcccccgagagcgggacgcgcgcccgcgcggtgggcgggaatcctaaggggacgcggaggcgggcgcgcgccccgcaggggagggggcggagagcgcgagaaggagggaggaggcgtccccgtgcgggagcccggctgaccgcgccagacccagacagagcatcgcggctttggctgcaacaggcggtgggctcggctcgggggcggaggcggcgaaagggcggggagcgcgaggaggagcgacctggcctcaccgctgccgcctcttccccgccgcatggacgagcgcctcagccttctgcgctcgccgccgccgccctcagcccgccaccgcgcccaccctcctcagcgcccagcgagcagcggcggtgcccacacgctggtgaaccacggctacgcggagcccgccgcaggccgcgagctgccgcccgacatgaccgtggtgcccggggaccacctgctggagccggaggtggccgatggtggaggggccccgcctcaaggcggctgtggcggcggcggctgcgaccgctacgagccgctgccgccctcactgccggccgcgggcgagcaggactgctgcggggagcgcgtggtcatcaacatctccgggctgcgcttcgagacgcagctgaagaccctttgccagttccccgagacgctgctgggcgaccccaagcggcgcatgaggtacttcgacccgctccgcaacgagtacttcttcgaccgcaaccggcccagcttcgacgccatcctctactactatcagtccgggggccgcatccgccggccggtcaacgtgcccatcgacattttctccgaggagatccgcttctaccagctgggcgaggaggccatggagaagttccgcgaggacgagggcttcctgcgggaggaggagcggcccttgccccgccgcgacttccagcgccaggtgtggctgctcttcgagtaccccgagagctccgggccggcccggggcatcgccatcgtgtccgtgctggtcatcctcatctccattgtcatcttctgcctggagacgctgccggagttccgcgacgagaaggactaccccgcctcgacgtcgcaggactcattcgaagcagccggcaacagcacgtcggggtcccgcgcaggagcctccagcttctccgatcccttcttcgtggtggagacgctgtgcatcatctggttctccttcgaactgctggtgcggttcttcgcttgtcctagcaaagccaccttctcgcgaaacatcatgaacctgatcgacattgtggccatcattccttattttatcactctgggtaccgagctggccgaacgacagggcaatggacagcaggccatgtctctggccatcctgagggtcatccgcctggtaagggtcttccgcatcttcaagctgtcgcgccactccaaggggctgcagatcctcgggcaaacgctgaaggcgtccatgcgggagctgggattgctcatcttcttcctctttattggggtcatccttttctccagcgcggtctactttgccgaggcagacgaccccacttcaggtttcagcagcatcccggatgccttctggtgggcagtggtaaccatgacaacagtgggttacggcgatatgcacccagtgaccatagggggcaagattgtgggatctctctgtgccatcgccggtgtcttgaccatcgcattgccagttcccgtgattgtttccaacttcaattacttctaccaccgggagacagaaggggaagagcaatcccagtacatgcacgtgggaagttgccagcacctctcctcttcagccgaggagctccgaaaagcaaggagtaactcgactctgagtaagtcggagtatatggtgatcgaagaggggggtatgaaccatagcgctttcccccagacccctttcaaaacgggcaattccactgccacctgcaccacgaacaataatcccaactcttgtgtcaacatcaaaaagatattcaccgatgtttaatatgtgatacaagtgacatgctgtgctcagtattgtgtggaacgtgcccccttggtctgcctatgcccttgttttatacatttccagaccattcatcaaggaaaggacctgaagaagtggaaagcacacttcattctccctctccctgctgcttcatactgaaacaggtgcctgttttgcaagtgggctgcattctctcagctctccttttccctcttaccctctctctcttaacattgtaaacaacagacttacgttaaacttcatttctagtacacgccctatttaaaaaagagcagtacatcctgggaggaaatgaaactaaagaacagttagagtaactgtttaacctcagaattttaaaggcagttgtttctttcctaagcacatcaattcgtagtaaatgatgcttcggtttgatggacctttcaacgttatttattgaatatgtatttcggttgcctaccctgtagatatgtggatgaagagtctaactagaataatgacttgtaaacccaccatgagttatttggtttttgacttaaattcctatttgaatcccctttcccggaattttaagggtctctacaactttgaataaagggaaatgcccccaagatgtcctgatctgactaattagtttaattctttcgggcttgctaagcatttctaaagcattagactaacagattcctgtgaagttctgtgcatatgtcccagccccaacaactatcaaagtctagaaacagatgttttcagtgttgctgagagaaacaaaaaatttcctaatgcatctgagagataagcttcggcagtatcacaagaagattaaagtggcagacaccccttccagcggaagttactaattcggacctgactgatgcagtttccatagcaacccatgtttcctgggaaacccgaaaaaggttgtcatggcatctcttgctctctagccccacctcccagcccctgccgtttccacagtaacctttccagatggttcctacttaaatgatttcataaggaaaaccactgtttgaataagccgcacaaaaaataaagttaagtctgagactctaaggaggtgaaatgaatcccaaatgcattttttaactatgaaaatcattatgtcattccataatgactgaatcaaggaggaaaatatggtgtttggaatgttagatattaaccacaataaggcatgatctggattaaatgccatttattaggcaataatttttaaagatgcttctctacagttttctttctccaagaactttcaagccaacaaatgaaatttaaaagcaaatgtaaaagtgttctgtacataagcaaatgagagattcgatcagtgtgcctgaaaccttactacaagggaccttcaggctttctctttaaaaaaaaaaatacagatcccacaacagctctgtcatcatcacagcacttgacaagctaaataaacttcaaataaataaaggatgcacgtttaaaactgagtgaattgcagacaatcaattaaaaggagggacaggaagtaaccagatcttgggagaacacctgcaagtttcagccatatgccaagggttgccagaagacagacagaatcaggtgagcactctgtgatctactgggagcagtcccttttgttatccagagccagggaactgtcattcatgtatagactgatggtatttgccaaaccaacagttttatcttagttacatgcttggtgtctttttaaaaataatttacacctttctcatttgatttccatgttgctaactgtcgtttagtttccattgtttattacaaaaggatgaaaaaacagtcattgctcttcagaataaccttcactcaagccaaactgaaaattattccgttccttttactaacccacttggcctccaagcaacctgtttccctttaaaaaggataaatggcagaatctactgctgttagattattggtccaattttaatttacataattatttaatagtatgcagtggtacagttctttgaaacaaaaaagggttaaaaataagagtaacattttatttaaacataatcattctgtttcatatacattatataaattatacattatctacagttgttttttggttttaatagcatataactattctatccttccagagtaaatgagagtaaccctatttttaaagcccatgaagtattttcagttaggagtacatttataatgcatgcattgaagagagaggaaaatagtgattgagactataagagagagctgaggaaggaaaagaccaaacaaatagaggcaagaaatctaaatatacctggtcatagatttgttgtttgttttttatcatatatttgtttttatctatgtatatctaagtaggacttcattatctagttttctttgctttttgtttgagttaacctttgacattgatctacctcttgaccaaacgtttggtacccttaatgaccagaaattatttttatgacacattttgataatatgttagatacattgtaacaattacattaaaataatttttgtatctgttcttaacatagagatggaggaagtgcaatgacaattttattcacatttattcaggagatgtagaaaccttgattagttctataagtaaattatggttgtgccataattcttatggttattaaatggcagtaatttaaagggggcctttgttctttaatccagagaaatatcctggcttttgactcataactttgaggtaatatgattgcttgtagtcaccacattgtaagttccctaaaggatataagctctgtgtcttgaaggttttaggtactagtgcctagcacagaatgtggcaccttttatatttgttgagtgaatggctgttatcttacataaatgttatttccaggcttttaataaagtggttaaaagcataagctctgcagtcatatttccaggatttgagtcctgactctggtatatgatcttgaacaaattacttaacctctctgtgcctcagtttctttgtttgtaaaatgagggtgataaacagtacctcacaggtttattgtgaatagtaaatgttaatacaggtagaacacttagaaaaaataattccatgacacggcatcagagattttgctaagagattatattgtgatcatcactcacaagcactgtataattaatacaatgttttgtgaatatgaaatacacaagtaatcagtgtcttcctatttcctttctattataagaataataattaccatttattaagagtcaaccatgtcctggacacttgtcaactccgcaaggtaagtgctattaacctcattttaggagggcataaaatagatgcttaaagttaagtgatttccctaagacttcacagctagc

SEQ ID NO: 12067 - DNA, 8237 bp, Human
acatgcaaggtgagagaaaggagtggaaatgagacaggcaagcatgagatgggcaagctggctgctttcctgttgtgatgtggtttggagaaaaaagaacaaaagccctttactcaagctgtaactcccagccagtcagcatcaaaggcccaagaagctattaaccacaaattaattaaccccttgctttagagaactaaggacctttctgaggccctacgtgcctagctaggcttaactttcacctcatcatgaacttttccttattttagtactaaaaatcatgcccacaggtggagatttaagatgctaatgagacatatgttgtatgaagcagcatcttaagccaccgtacatgtgcccgaaaaacctcacctctacatgccctgacttccccttactgcagacctccacaaagggaacccacaccttgactttggagagcaacccacttcctttcttggtgtttggtcccttatgtccataagctttcataaaatctttctctttgctactgtatgctgtgatctcttttgatttctatcctgggggatcaaaaaagcccacagggcgttggtgccagaaatcagctgtgcaagcacagaaagggagcagaggctgttgcctggctcaactggtgaggagcaagactggagaatgagcatgcagtgagttctaatactagcacatttcttacccactcaacacctgatcccttcccgacacatccaggagccttggttctctccttcctccaactctctgagagtgaatgctgctgagaaccactgtggttttaaaatactccgtgcaatacaaagaactctcagatgcatcctgtggtttgagagcacctttatgtgtcattctcatcattaacctcaatgaatgcatactaatgatctaatatgcaccagaagctacacaaaaacactttgtagttgttagccaattcattttggctacagccagccagaaaagaggaaactgaggcacagagaagcaaatgtcaaccctacctggaagtgtcagtctgaaaagatcagttgagtcttcctctaccagaccccaacttgtctggtctcgtgaagaaagacagaaatggatggaaaaccattcttatcaccttcttgctggagagttagggaagagtcagctggtccctaacaacaaactttgccctactccagtactgccaaaggggtctttgttgtaacatggcctacaaggagaggacatctttctgggaaagcacctagaatgtggctggcacatattcaatgcccagtaaatgtagctattattttttcaatcaacactcttacataccccttttccactcaccctcttctccctttttttggtcacccaataagcagaaattccagatgcatccttcggggtggttgggagcaaaggatccccagggtgcactgtgccctgggctgaggtatctctgaggtgcttccatcttctgggtccttcctcactggggttgttgcctcaggctctcaggactcccctggaaatcttctgatgggaaaggcattgattgacttgccaccctttctctaccatccctttgcaattctgggagagttgcagccccgccctcccaggcttgcaaaggtagacggagaattatattggaatttaaatcggaagctctcaaggcatctcaaaaatactttctctattttttttttcctgtagatattggagaggttggcaaacgggtcttcctgaagacagaagaatgtatgatttaatgttttctttagatttctgtatgagtggatgcacagtgctccgtattgtgtggtggggcggggtgtgtcttcttattgatgaaatacactgcgcaggtcaactcggtaaattgaaatgagaagagccgactgcgggggtggagggggtgtggtattagggtgccggcgcttgtggaggggggcgcgaatgtgaacgtgtgaaagcgagaggcgtgccaggagagcgcgggaaagcttactggtgaggcaagtgtgcgtctatttccatggcgccctggctcgcggcagcccctggctgggcgaggggtgtgatgtgggagtggggtgggagggggcagcaggcggggcctgccacgtcacttggagagtgtgtgttgggaaggaagggcagagcggagagccgagccgctgcagctgcggcggcggcagcgaagccttgagccgtggggaggtgggtccccgcgctcgggcgccggggcagccccgggccctctgcgaggcctgcggcgcggctcctagggaggaggtggcggctgtggcggccggaaccgcgaccttggccggacccagccccgcggtggacgcagggcggaggccgagccccgccaggagtctttgccgagccggagggaggcgcatctggcgcttcggtaccagcggcagccgggggtccggagcggctggaggagcgcagtgggaactgggaagagctagcccggctggagggcggacctctgcgtccgggagccgggtctcaggcaccgctgggggcgaagccacgcgtcttttcgggcagccaatttcacacgcgcctgtgtgcggttccgggcatcccagtaagctctagcacccgggcgcgggtaacgggaagcgcagaaccaaatccccagcgcccaggtcacctccccagacccagccttgcagggaccagggctttagggctcaccgacccaacggccaggtcagaccgcgaaccgggaggagcgcgggccccaccctaaagagggcgcagccgggagctggggagcgggtgccgcgctccagagattgtgtcgtgggcgccgtcctagtggcggggagcgcacctccgagggggcatgagatcggagaaatcccttacgctggcggcgccgggggaggtccgtgggccggagggagagcaacaggatgcgggagacttcccggaggccggcgggggcgggggctgctgtagtagcgagcggctggtgatcaatatctccgggctgcgctttgagacacaattgcgcaccctgtcgctgtttccggacacgctgctcggagaccctggccggcgagtccgcttcttcgaccccctgaggaacgagtacttcttcgaccgcaaccggcccagcttcgacgccatcctctactactaccagtctgggggccgcctgcggaggccggtcaacgtgcccctggacattttcctggaggagatccgcttctaccagctgggggacgaggccctggcggccttccgggaggacgagggctgcctgcccgaaggtggcgaggacgagaagccgctgccctcccagcccttccagcgccaggtgtggctgctctttgagtacccagagagctctgggccggccaggggcatcgccatcgtctccgtgttggtcattctcatctccatagtcatcttttgcctggagaccttaccccagttccgtgtagatggtcgaggtggaaacaatggtggtgtgagtcgagtctccccagtttccagggggagtcaggaggaagaggaggatgaagacgattcctacacatttcatcatggcatcacccctggggaaatggggaccgggggctcctcctcactcagtactcttgggggctccttctttacagaccccttctttctggtggagacgctgtgcattgtctggttcacttttgagctcctggtgcgcttctccgcctgccctagcaagccggccttcttccggaacatcatgaacatcattgacttggtggctatcttcccctacttcatcaccctgggcactgagctggtgcagcagcaggagcagcaaccagccagtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacgatgacgattcgctttttcccagcatcccggatgccttctggtgggcagtggttacaatgaccacggtaggttacggggacatgtaccccatgactgtggggggaaagatcgtgggctcgctgtgtgccatcgctggggtcctcaccattgccctgcctgtgcccgtcatcgtctccaacttcaactacttctaccaccgggagacggagcaggaggagcaaggccagtatacccacgtcacttgtgggcagcctgcgccggacctgagggcaactgacaacggacttggcaagcctgacttccccgaggctaaccgggaacggagacccagctaccttcctacaccacatcgggcctatgcagagaaaagaatgctcacggaggtctgacccatgcaggcagggcctgcaggaggggagcactgagctaacagtctcttaggcttccttctcatttccactactcactctagcttcagttgacttcttgactctctcccctacacccactacctggcatccaggaccaaatacctggactatcaaccttgttgcttaatccctgcagcattcaaggttaatccatctaagtgacatttttgaaattccagcggtgccacccaatcatgcccagcttctgtcatatgaatgagatatacatttatgtctgaccttccctcaagactgatttttcatgtctgggacttacaatatctcaaggaacagcaatgtcaacaggatggaaaccagccctatctgagtcttcgctccctccttagtgttctttgctttgggtcatgtgcgtttcctagcttcaggctacttggtaactggaagaagctggaggacagaagcagtactcaacttgctgttattccagtgccctgtaacaatcactggtcctcctgcagatgacccttggtagagtctttatttgcatagcctcaaaataggttattcgtttctaaacttggatggaattagagaatacaatcaaactttaccacttggaggacacggggttagtccaggaccaaagaggccaatggatttttcaaagtgtgccccagcacaagaggcactggtgttcggtctacatttagttctccccactctgatcccctgactctccagcttccaggaaggttccttctcagagccaaatactctttgtgcaagtgccttcctgagcagaagaactggagaaagggaaccacagagccaggaggaatgtctgagcagagtcaagcaactggcttgaccacagtctgaagcaaggtgccacttaaacagatactgttttctcaaaggggcagaggaatcgtgttgcagatggcagccttttctccttcattttccccacattttctctggccctctaccttgcttcctgggagtttgatttaggattgctgttgaaggcttcctcaggcaaactccagcttaaagccctagacaggtaaaagcacacattggatggcagcatgggtttcttcccattttatgggcatgaaatatgtggtttagaataaggaacaagcattattcctttgccaacagcctcactctaagaggcttttttgctgagtcaagcaaacacttgcctgctctgccccttggagctgcatttgacctgctctcactggtaaggtgacttggtggcgttcccacttgatttagccattttcttccattgtgagaccactgccatctatccacctgcccacctccccttttgtttctcagtaacattgccatttgttttttgcctttgataaactgtgatgtactgttctgagatcttttgggtgcagttctgaaactgaaaggactgttaacatgtttttaattttatatctatgctttcagactctttgatgataattttttttttaaaaattattctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttagttatccccatacccccataggcaaggccttcccccagagttcctgctttggatccaaagcctgagaataggccattatggaccattggctccctaaatccctccttggcctcttggactgagcccctcagcctttcttcttacccttcagaaaggagagttctctttagatatgttcagggggatccttccatggctggaggtcaccttgactgggggcttggcttctccaaacctgaaacacagtagaagatagagatgtttatgatgcaaaaacctgctctgaggtcagaaagtgctagttttccaaatctctcccattgctgctggctatctggggaaagaagagaaaagcccattccagaggcagaagggaagctcccagccgagggtaaaagttgagacctgtatgcatgtatctctgtatatgtgtatgtaatcaccctcatcaccatccctgagaaaacattttcttttcaagtcagagcacgcctgaaagggtttgtggagagcccagctcaccagggactctggttgccgtagcaaccttccagactgttctctctatcttctgctttgggcatcaagggagaccaggggactacatcttcccagcttctcaaatgggagcacctcccacatcgtggcttaggggctgggagtgccagggcacggatgtgggacttttggaaaatgtggaggaagcagggcctcaaagcttcctgtctggacttttcttcctagtttccccacccagtcattgaagctgcctcatcttactcctgattcttcagaaatttgaatgttaagcaaccagttaaaccaacgtcagtattaattttttcaagctgtcgaggggagcccttagaggggacaacttcttggagtggcggccaagctgggccttaccaggtgtgatcatagtcttaggtatcatggagttcccatctccgcagaggcaggctcttcccagctccacgagaggcggagaattgcaacttcttcctctctgggaacggcctatctagctcctgggaggaatctcaaagatctttcttcttaagacatcgaagaaaaactgagaggctgtagctcgacctagtttctgtgaagaattttgtcaagtgatccctctcggaccctgagcctctttatttggattttgtgccttgagcaccaagagaatatgcactctgggttgcctggacagctggggtggtgattcacaggaagggtccaagccatcactacacctgactcaagccggaaagagctcccagaggacttcctggagctgccagcctcagcctgagatgcgggatattcgtccccaaggagcgaggagggacagctcgccttctttgcaggtgaggtaggttctactggaggggaattttggttttggctcagtcctgcaggcaaaattagaacggggtggggagagagagaaagtggggaagcgtgtgcatctggagagaggcaaggttttcattccccttccctcaggggctacctcgctttttctgtgtatttttctttgactccattaacttcagtttcctttttctctgtttctgtccccttgatgctgctggcccctgtaaaaaattatctctttttctgtgcatttttctctttccttcttttcattcttactgtctctgccttttttcccctttctccagttttctttcttctggttttccccctctgttcttttaccgtcttcttccttctatgtgtgtcttcctgcttatctttctccctctctccaccttttcagtggctgggagcacctagagtgttgacgtcgaggtcgcacattgaactgtaggacagctgtgcttgctaaggtctgtctgcagcaggagtattccactttttcctgacttctcactctgccattctttcctaccatgctcacctctgtggaggcaagtcctgaacctgccaagcaagatgagactgccatgggctcagaaaaatgtctcccagaaattt

SEQ ID NO: 12068 - DNA, 51671 bp, Human
tgccaaggccacatcgccccgcgggtcccagacacccgcaccttctccttctccaggaacctccagggctctgctttcgggcagcctccctcactctctgggcacaaaagcacacaggcacgtagtaggtgctcatgaaaaaaaacatttgagggtgattttagggaggcaagtgcaggtgagggagtgttgcatttctcgacacggacaactgcgtcctcatcccatggggacatataccctctctgggcctttgtcccctccaacaaagcaatttcccttttatccttccctttggtttcaaaaagtgtaagataacaaaacactttgttttgttatcaaaacaaaatcaaaggggggaaaggtcagcctcccaggggtccctggccctgggctgcccccagcgtctcccccaacacttccccaacttgccacgttcgcttcttttacttattcgccatcggaacggtggaacatttgcgcctccggcctggcttctgctcaaccggccaggagctcggtccctgcggatcattttccccaggggcatattattccggaaacgggctaagcggtcccgggttggggacacgtcggctcctgtgtttttagtttcgctggcctaggtgacccccctgcagaagacggctgtggatctgctgtgccgtgtcttggaggcatttctagggcggctagctgggcaaagggtggtgctgtccctttatttggagctaggtagctcctggggtggtgctgggtcgggagcggccctctcctcccatcagctaggaccaagttgcacctggcccctcattcccaggggcggagagaggagaagatgaaagagcaagcaagttcacaccagggcttgagggcagtgagaacagtaaaccagggcgacgtgcccagagaaggggcgactctagggaagaggcgaccttggatggagccctgaagagccctgtgggaacagggggtgaggagagccagggaagggcgatcccggcccaagaaaccgcagatgcaaaggctctgaggctgaaccggttagggggagaagctgggcgtgtccagaatgtggtgggcggtccagggagaccgcggagggattggaacaaagggtgggcgttgtggggggcagaccgcgtcggcctgtgaggagtcagggtgctcctcttggttcaagaagagaagggaggtggggggagggcggtcatgcgggacagggacgtgacctgtcacacgggtgaggactgaagtctgtggctgcgtcagggagaaggactgtggcggggacaggaggagccgcgggagtggggaggattttcgggctccactgggcgattgtggggtccacggggcgtgggggaatcccctgatcatgggtgtccttgtcacctctgcagcctgactctccttcactgtgtctgactaaagcatgggtcgcagccttccccaacaggggcgggaagtcccccccggggagggtgttgggtggcaccccttgtcctcggctcctgcgaacccatcggctctctgcctccacagtgcagacccgaaggcctcctcccctttgttctttttccctccacacggtcacggtcacaccggcggctccctctgagcgcatctcacacacaatgggggtggggggtgcgctcccagtttcccctcctctcagtatcggcgtccccgagccccgcccgcgccacggaatcccggcctccagaccccgcccgggaagctcgttacctttccagagaggctccccgccggggggctggggaggggggagggctatttttagaatgaatggaagaaaagagaggaaaaaaaacaaaaaacaaaaaccagaatggaggtttgtagaagcctccctgcttccaagaggaacccccctccctgtcccctgcctgaaggtggctgaaggtccccaccaaggctgaaggtgggtgggggttcagagacggggcggagcaggggacttcgaggaggaacacggtggtctgagctggagccacgctttctgttggagggggcagctgaaggagaacagcaagacatatccggcggccctacggactcggagagctggagggaccccggaggtgggcacttgtccgttcgctgaagggaaactgaggctcagaaaggggcttggcagggccgaggtcacggaaagggcttgcccctggacttctccctcccatcccctaccgagccagaccccgcgagccacattgttctaaggtggcagagtgaccttcacaactctgccacccaagcccgggccagtcaggctcaagaggttcctaatcgcgcaggttggggggagggtgtcaccagcccaacaatgaaatagagaagttttctgtggtttggttctggccacccaggctcccccttcctagctgggaccttccagcccggtcaacgtcgccagctgcccgaagcctctgggtcccccgatcctccccagtggcgtggtggggaggctttaattgtctgccttcctctctccctgactctcttctttcccggagctgagagagcggccccccagagtgaggggagcagccctgttccgtgctgctgggacactgggccctggccaggggcttccgctctccgggcctcagtttccccgtctgtaagatgagcaccttgggccagaggcggcagagggtcctcccatctctttgaccgtcttctaagatttgctgtcacgcccctgggtggaggggggagagtgggctttggcgagagacctggagggggattccatccctgctttagaggagacgccttgcgggggggagggccccggctgtggccgcgacggactgcctccctcggcctgcggggtccgcgccccctccccgggcggcggggcggggcccaggtcggcggggagggggtcggctctgcggcggcgcgcgcacaccctcccggctcacacgcccttgcccggccgtgcacttgtcttcgcgctcgggcagggcgcagggactccggctgcggcggccgactccggccggtgagtggcagtggggggcacggcggggagcgttcggtcccggcggcggtccccttctctttggtgggcggattggtcaaagcttgcccgactccgggaattcaaaggggagctgcgggaggagggggacatcccttcttcaacccccgcctccaacaccgatcccgggagtcagctcctgaccccacccccatgccctgtgaggagggggttcctgcttccaggtctggggatgcgcagacatccccctccctccgcgaggtgaaggtggggacatggggatcctccacgcctgcaccctcctcagtggtggggggaaagcaccgctggttcccgttgccccctcctccctctctgtcccctcaggtttctccctttctccttgcgttgtggcggggattccctgtgctggccaggctgcgcagtaggagggaaccccccacctgccagcctactgtgcgctgggctccgggttcctgttcttttccctaagctccctcccttcccccctcccctctcccggacaggaggaggggctgaggcccagagagggttaccactcgcccaaggtcacccagctgggctggggcagagcaggtttctggtcagatccacgaatcccgggacccagctggggaggtcagctttgggatcctctgcccccgccgccgtttaaccctgagcgtgggttgccagggccccagaactggggggattccttactttctccaagtttctcctctggctagagacccagacaggactgagccaagaagccccggcctcgctctcttccggggctcccagatctcacctcctcttgtcccccgtgtgcccccgctcccagcctcctcaggctgcccaagacctcatcaaaggaaatccctggggggagggggcttatagatggggaagtcaaagcttctggagccacggaggagataatttttactccgacgcagcaacccgctgagtgaccttggacaaggccctgccctcccaaggctagggtcagcaccaagtccccctggctggaacaggtggcccctgagccatccaaggtgaccattgccccgatcccaggtcctggtgagagaaagggcagctgggggtttccccttcagtcctgttctggggtctggcattgcccctgccctccatggggtgtccttttctgccctcttctccaggatcggacttgggtaccatgtgcttctataagccctctgcagacagcactaaatagatggagggagcacgccaagggagctacaggctcccagggcagcttcagagctggggagcaagagttcagctgctctgccaagcgaggtggttcacaactgtaatcccaacactttggaagggcgaggcaagctcaggagttcgagaccagcctgggcaacgtactgaaaccctgtctctacaaaaaattaaaaaaattagccaggtgtagtggtgcacacttgtagtccaagctacttgggggccgaaggtgggaggatcgcttgagcccgggaagtcaaggctgcagtgagccatgttcatgcgactgcactccagcctgggtgacaaaatgtcacctccctgaatgtcacccacctagatctccccatggcgaaggaactaggggcaatgtgagggggtgagcaggaacagcattgggaaagacagataaagcattcagtgtctagcttctggagcccagtgaaaggaggagtggccttagggaggggacatggaagaggtggggctagcccagggccccattggagtgataaagccactgttcttaagcttcctgaaagcttaggagatgacccagctcagcaacaccaagccagagcgcagatctgctgtaaagaccattgtacgtaataggctgaagcaggtgaatcacctctggccaggagttcaagtccagcctggccaacacagcaaaaccccatctctactaaaaatacaaaaagtagccgggcatggtggcaggcacctgtaatcccagatgcttgggaggctgaggcaggagaattgtttgaaccctggaggcggcagttgcagtgagctgagatcacatcactacactccagcctgggtgacagagcaagactctgtctcaaaaaaataaaaaataagaaagaccactgtagtccgggagctgtctgcaccctactcttttgggtccccgcctccaccccgcaccccctgtctgatcattacagatctcaaagggacaggaaaggcagcagcagccaccctctctcccagtcaagtggtcaccagcaggactgaaggggacagcccctttgcagtggctcggcgaggagacccctgcaccctagggtgagtgaatcccagacttgggtcgcctttgggggtgggggtggctcaggggttggatagaaaaattggtaactgggcaggctaggtggctcacgcctgtaatcccagcactttgggaggctgaggcaggtggatcacttgaggtcaggagtttgaggccagtttggccgacatggcgaaaccccgtgtctactaaaaatacaaaaattgcccggggatggtggtgggcacctgcaatcctagctacttgggaggctgaggcaggaggaccacttgaatccgggaggcagaggttgcagtgagccaagatcgcgccactgcactccagcctgggcgacagagcaaagctctgtttcaaaaaaaaaaaaaaaaaaggtgacctgaggaaaaagtgccagcttttgaaataataacaagctgggtacagtggcgtgcacctgtggtcctagctactcggaaggctaaggtgggagtatcgagtccaggagttcgaggctgcagtgagctatgatcacgcttgtgaatggccactgcactccagcctaggcgacagagcgagacccccatctctttaattaaaaaaaaaaaaaagaaaaaaggccagacgtggtggcttacgcttgtaatcccagcactttgggaggccaaggcaggcagatcacctgaggtcaggagttcgagaccagcctggccaacagggtgaaacccccatctctactaaaaatacaaaattagccaggcatggtgctgcatgcctgtaatcccagctacttgggaggctaaggcaggagaatcacttgaacccaggaggcggaagttgcagtgagccgagattgtgccattgcactccagcctgggcaacaagagtgaaactccatctccaaaaaaaaaaaaaaaaagaaagaaagaaaaaaaataataatataattattattatatcatatatatcatgatgatgatagcaaggactatgctttctagagcctccggggagttactgtccactttctttgatcactggagttggggaaactattcagagaggccagatgacctagaagtggggtgttgagccaggttggaagagctctgtcccaccactcccgcccccgccccccacacacagcctctacttcccggctctcgtggtctcgctggagacagcccccagggtaggccagctctgtggaaggcagctcctgtgctcctttctccagtgaactttttttttttagttttgttttgttttgttttgtttgtttgttttgagacagagtctgactctgtcgcccaggctggagcgcagtggcatgatcttggctcactgcaacctccaccctccaccccaccgggttcaagcgattctcctgcttcagcctcccaagtagctgggattacaggcatgcgtcaccacgcacagctaatttttgtgttttcagtagagatggggtttccccatgttggccgggctggtctcgaactcctgacctcaggtgatccacctgtcttggcctcccaaagtgctgggattgcaggcgtgagccactgagccaggcctccttggtgaacactgactgacatccagggtcagcactaagctgcccatgggggtgtggagaaaacagaggtggtggtcatttagtcaatcaacaaacactgagcaagctagctactgtctgccaggccctaggctggatgctgggatgcaataaggacaaaggccagcccaggtcagcccttgtggaatttcatggggcatcaattaagcttaagtgttttgtgctggatacagtggctgatgcctgtgatcccagaactttgggaggccaagacaggaggatcacttgagctcaggagcttgagaccagcctgggcaatgtagcaagaacccatctctacaatttttttttttttaaattaaccagtggggtggtgcatgcgtgtggtcccagctactctggaggctgagatggggggatcacttgagcccaagaggtcgaggatacagtgggctatgattgaaccactgtactgtagtctgggtgacagtgagactctgtctcagaaagaaagcgagaaagagagaaagggggccaggtgtggtggctcatgcctgtaatcccagcactttgggaggccgaggtgggcggataatgaggtctggggatagagaccatcctgcatggtgaaaccccgtctctactaaatacaaaaaattagccaggggtgatgtcgggagtgcctgtaatcctagctactcaggaggctgaggcaggcaggagaatcgcttgaaccagggagttggaggttgcagtgagccgaaattgcagcactgcactccagcctggcgacaaagcgagactgtctcaaaaaacaaaacaaaacaaaacaaaaaaacaaaaaacagagaaagggagggagggagggacagagggagggaggaaggaaggaaggaaaggatggagggagagagagaaaaaaaggagaggagaggggaggagaggagaggggaggagaggggaggagaggagaggggaggggaggggaggggatggtggggaaggggaaagggaaagggaaaggggaaagggaaagggagaagagagagagggagggtaggagggagggagagagaaaaaaagaaggaaggaaagaaggaaggaagaaaagaaagaagaaagaggaagggagggagggaaggaagaaaattgttttgtattaggaagaaaatagaatatgaggatgtattagtgaccagaggagcagggaagcctcttgtaaaagtcagagaggcctctctagggcagtgatcatgagctgagacttgaaggaagaggaggaactggcctgctgacagctgggggaacagcatacccagcagagggaaccacatgtgcaaaggtcctgaggtgggaatgagcttggcgtgtttgaggaacagtgaggaggctgctgtggctggaacagagtgagtgggagagaggaggaagatgaaggcaagatcggcaggtaggagccaagctacaaggaactcagcggctgcagtgagggtgtggacttcagagcaatggggaaccatggcaggtgtgtgagcaggggagaggcatggtctcagttaggattttcagaagccctgtggctgctgtggagagcagggcaggagtggaggtggcaggagcccagagtggaggcccaggagatgtctggtggtttcagctgggttggtaccagggtagagcctcagatggaaaaaagtgggcacattctgggactgggttggggatggaggatgaaatgtggccaggtttccatctcatgccaagtagctactgtgagagaagggagcactcattgtgcttggggaaacctgggaaggcatcctggaggaggtgctctttgggctgagcctggaaggtcaagtagaagcttgccagcagataaggctggggtcatgtgggatctaactgctcaaatgccaggggatcactgagcacccagaatctggggcagtataatcagatttgtaaccaagaaagatccctgtaatcccagcactttgggaggccaaggtatgaggatcacttgaggacaggagttcaagaacagcctcagcaacatggcaagaccccatctctacaaaaggaaaaaaaatagctaggcatggtagcacacacgtagccccagctactcaggaggctgaggtgggaggatcacttgaggacaggagatcgaggctgcagtgagctctgactgcaccactgcactccaaactgctgcgagacaacaggagaccctgtctctttttttttttttttttttttttgatacagggtctcactctgtcatccaggctacagtgcagtgatgcaatctcagctcactgcaacctccacctcccaggctcaagtgattctcgtgccttaacctcctgggtagcttgggactatagataggtgcctgccaccgtgcccggctaatttttattttatttatttatattttcaattgtatttatttatttatttatttatttatgagacggagtcttgcctcgtcgcccaggctggagtgcagtggcgcgatctcggctcactgcaagttctgcctcccaggttcacgccactctcctgcctcagcctcccgagtagctgggactacaggcgcccgccaccacgcctggctaatttttttttgtatttttagtagagacggggtttcaccgtgttaaccaggatggtctcgatatcctgacttcgtgatccacccgcctcggcctcctaaagtgctgggattacaggcgtgagccaccacgtccagccctatttatttatttatttatttatttatttattttggagacggagtcttgctctgtcgcccaggctggagtgcaatgacgtgatctcggctcactacaacctctgcttcccaggttcaagcgattctcctgcctcctgcgtcagcctcccgagtagctgggattatacgcgtgcgccaccacacccagctaattttttgtatttttagtagagacggggtttcaccatgttggccacgctggtcttgttttttgttttgttttgttttgttttttttgagacagagtctcgctctgtcgcccaggctggaatgcaatggtgcgttctcagctcactgcaacctccgcctcctaggttcaagtgattctctgcctcaggctcctgagtagctgggattacaggcacctgccaccacgcctggctaatttttgtatttttaatagagacggggtttcaccatgttggccaggctggtcttgaactcctgacctcatgatccacccacctcggcctcccaaagtgctgggattacaggtgtgagccaccgcacccggttatattttttcaatttattctttattttagtagagacagggtttcatcatgttgcccaggctggtcttgaatccctgagctcaggcaatcagcccaacttggcttcccaaagtgctaggattacaggcatgagccatgggaccctgtctcttaaaaataaaaaaatgattccctctaggtggggggctctgggggaggttacacccgagtgaaagagttcaagaggtgcttttgaaatagtccaggtcagctggacgcggtggctcaggcctataatcctagcactttgggaggctgaggtgggcggatcacgaggtcgggagtttgagaccagcctggccatcatggtgaaaccccgtctctactaaaaatacaaaaattagccgagcgtgatggtgggcacctgtaatcccagctactcaggaggctgagacaggagaatcacttgaacccaggaggtggaggttgcagtaagcggagactgtgccactgcactccagcctgggcaacagagtgagactccatctcaaaaaaactaaaccaaacaaaaaaacaaaaaaaaaaaagaaaaagaaatagttcaggtaatggtcaggccagttgcagctgtaagcattcatggagcactagtgctgaacctcatgccactggcctccaatgaggccatatcattgccttgcagaggaaatggaggcctagagttacaagtcccttgtccacaatcactgccttcattcctgtggctgccaccacaaatgaccatgagctggatgacttacaaccacacaaagttggccaggcggggtggctcacggctgtaatcctagcactttgggaggccgaggcgggtggatcacctgaggtcaggagttcgagaccagcctggccaacatggtgaaaccctgtctttactaaagatacaaaaattagccaggcgtggtggtgggtgcctataatcccagctactcgggaggctgaggcaggagaatcgcttgaacgtgggaggcggaggttgcagagagccaggatctcaccactgcactccagcctgggtgacaggagcgaaactctgtctcaaaaaaaagaaaagaaaagaaaagaaaaacacacaaaaagttgtgctgtcacagttctagaggccagaagtccaaaatcaaggtgttggtggtgttgccttccctccggaggctctcaggaggatcctttcctgcctcttccagcctctggtggctcctggtgttctttggctgtgtcacccccacctctgtctctgttttcacatgaccttctccctgtttgtccatctgtatcctcatatgggcttcgtattaaaaaaaacagttgttagatcagagcccaccctaatctaccatgagcccctcttcattgggtgggccaaagcaggtagatcacttgaggccaggagttggagaccaacctggtcaacatggtgaaaccccgtctctattaaaaatataaaaattagccggctgtggtggtgcgcgtctgtaatctcagctactcaggaggctgaggcaggagaattgcgtgaacccaggaggcggaggttgcagtgagccgagatcacaccactgcactccagcctgggcaacagagtgagactctgactcaaaaaaaaaaaaaaaaaaaaacccagaaaccagttattagatcagagccagaactaacccactatgaccccctcttcatttaactacatctgcaaaaaccttgtttccaggccaggcacagtggttcacgcttataatcccagcactttgggaggctgagatgggagcctcacttgagcccaggaatatgagagcagcctgggcaacataatgagacctcgtctctacatttaaaaacaaaaagaaaagaaaaagaaacaggagaatctcttaagcccaagagatagaggctgcaatgggcgtgatcgtgccactgcactccagtgtgggtgagagagtgagacccagcttcaaaaacaaaagaaacaaaaccctattttctttctttctttctttctttctttttttttttttgagacggagtcttgctttgttgcccaggctggagtgcaatggcacaatcttggctcactgcaacctctgcctcccaggttcaagcagttctcctgcctcagcaccccctagtagctgagattacaggcgcgtgctaccatgctcagctaagttttatatttttagtagaaacagggtttcaccatattggctaggctggtcctggtctctaattcctgacctcaggtgatccacccgcctcggcctcccaaagtgctgggattacaggcatgagccactgagcctggccaaaaaaacccctattttcaaataaggtccaaggttctggggaggactcaaattttggggggtcacgattcaaaccagtccacctgcgtagcaagacattggggtttggagtcaaacctttgctcctctatggagctgccacagtggggagagaggggttccctggagcaaatttatgggatcggttggacccactggatgtgggggtggtaaaggaaggaggctagagccttctagcctgagcgtgaggagggaggggcgctcatgtctgaatggacaggatgggacagtcccagggtggggccgctggtgggcatgacaggggctccctgacagccttggatgctttttggggactccttgcttatgatggagctgctaccctgcctgcctgtcacgcccaggctcccacttcctgctctagggctgagaacacagcaggcagcccatggggagaaccgggaaggatcaggcccagtccctcccctcccatcctgtgcccctttttcctccgtgttctgtctgcagggcccttgtgtatttatcatatcaaagccggtcttgtcttctggcctgaaactgggagtctgggggactttgtgtgtctttaccaccacagtgtccctgccttagagtacaagtcctgcacacaggaggtgctcagtagatgctgatggaaggaatcccaggtccctgaatcccgagagctcaggaacaagccctctgcgacacctgccccagctcccaccctggtattcccactccgcttcctgcccctgcagttcccaggagcccgagggagccaacactccagatcttgttttttttttttctttttgagatggtgtcttgcactgtcacccaggctggagtgcagtggcgtgacctcggctcactgcaacctctgccttctgggttcaagcgatcttctgcctcagcctcccgagtaggtgggattacagcgccaccacgcctggctaattttttgtatttttagtagagatggggtttcactatgttggccaggctggtcttgaactcctgacctcatgatccgcctgtcttggcctcccaaagtgctgggattacaggcgtgagccaccacgcccaggctttttttttttttttttttttttgagacggagtcttgctctgtcaagcccaggctggagtgcagtggcgcgatctcggttcactgcaagctccgcctcctgggttcacgccattctcctgcctcagccgccagagtagttgggattacaggcgcccgccaccacgccacacccggctaagttttttgtatttttagtaaagacggggtttcaccgtgttagccaggatggtctcgatctcctgacctcgtgatccgcctgcctcagcctcccaaagtgctgagattgcaggagtgagccactgcacccggccacctttttttttttttttgagatagagtctcactctgtcgcccaggctgtagtgcagtggcacagtcttggctcactgcaacctccacctcccaagttcaagcgattctcctgcctctcagcctcccaagtagctgggattacagttgcccaccaacacacccggctaattttttgtatttttggtagagacagggttttgccatgttggccaggttggtctcgaactcctgacctcaggtgatctgccctctttgtcctcccgaagtgctgagattataggcatgagccaccacacccagctcaaatgatttctcttctaagagacttccctgaccaccctaactcaagtctccctgtcctcgttcttagttctttcaacttttttggatctcttcctgatacttctgatacttttttttttttttttgtgagatagggtcttgctttgttgcccaggctggagggcagaggcatgatcacagctcactgtggtctccacctcctgggctcgagcgatcttcctgcctcagccgcccgaaggagctgggactacgggcacatggctccacgcctagctaatttttaaaaaatttttgtagagacagggtctcgctatgttgcctaggctggacagtacttttgtgtatctaaaattctcagttttatttccctctttggagagggttgtccccctcttctagaaagccagcttcaagaggggcacggtttgtatctctctagggtgctgcattccccagcaccaggctcagagaaggggctatgtggatatgtgaatgaatgaatgaattagtgaatgaatgaatgaatcagtgaataaataaatggctgaatgagtgaatatcttacccttgccatcctgacactcactggggcccaggttccagcttccatccgggcagtccgggctgggtccaagatttcagtggatgcacctgtggaggggtgctggggatggaggtgtagggagatgctcgtgtggccaggccactccctgctccggccactacctttgtgtccctgagctcctgtgaacgtcttccagttctcttgcacccagacccttagacactgcccagagaccagaggcccagccctcaggccccctgcggaggggcttgctctccagccgcctccaccatgcttgacgtttgcagaggacacagcctgtgcgcaaggcagtttcccagggcatgagtcccgggggcgtcttggctgcctgacaggctcacttgcaggcttcttgggtctcttccagccaaccatgggctgatgagaggctctgcctggaacggagacccagacagcccccaccagaagtcccacctccatccaaccttgactcccattcatgctgccaaccttgtctctgaggggtgggattccagcaggtggcaggactgactcaggtgggaggcaaggccgttgatcaccagattgattgtccaagttccacttcttgatgggggcagtccccgatccctcagggcaggtgaatgcaaaggagaacaagcacaggtcttttcagagggagaaggtgggtacaggggcttcagggcgtgggcaggggtgcaggggattgggggcagtggagtgctgtggctgatgtttttgtgaatttcgggacagttacatgttagacttgaattcaaaaagcatctggccaggcgcggtggctcacgcctgtaatcccagcactttgggagtggatcgcttgaggttaggagttcgagaccagcctggccaacatggtgaaaccccgtctctactaaaattacaaaaattagccaggtttggtggtgcacgcctgtaatcccagctacattggaaggcggaggcatgagaattgcttgaacccaggaggtggaggtttagaggttgcaatgagtggagatcgtgctgctgcactccagcctgggcgacaaagtgagactctgtctcaaaaaaaaaaaaagaaagaaaaaagcatctgatgctacagcctgtgcaagcagaccagggtcagcccgtgggcatggtatgcttctcgtggctcagggactcctgcaagggctgggttgagctgtcaggggccaggagaattgaatgtggttcagggatgtgcccaatcctgagggagctgtgggtggctccaatgttgtgctttagaaaggggggctcctggtggtccaggcaggggaacagcaagtgcaaaggcctggaggtgggaactgtggcgaggggagactgagaaggcttggctggaggttggagtgctggtgagtcagtggagagatgcaagaggggtggctggttctcaggtgtggctgaaaacccgccccttcggagtccccacaacccctttcttgctctgcagtgactctcaaagctgcttgtgtctggtcagatcactcgtaacagccccctgttacagatcctatccaaccccgcctggtacctctgtggatctgaccgggaccacccaggcctctatttcctgattgtctcagccctgggcattgtcaccacggccgggccttgtgcagagcagtctggacaggctgggatgaggaacgggctctccaggggagggaacaaaggtcctgtctgagactctgagccatcacctggcccctctgtgactcaccgccaccctcagcccatgcagctatccctcattcatgcctgcctgcctgcctgcctgcctgcctgccttccttccttccttccttccttccttccttccttccttccttccttccttcagtccaactgttttctgagctccgcagaggaaacacagaagacagcctccctcaggaataaacactcagatgttcctgacctgggccaaagctctgggctgggaagaaaacagatggagggtgtgggagagagataggaggtgggatctgctggctccaggaagcccccaggctggtgggggacagagctgaacacagtcaccccaagcctggtgggaacagggtgaggcagaggcagaggcagtaagactggaagaggaggaaggaagagctccctacccactggtccccaaagctccctggagccgccattaactttgaatgaatgagtcggccaagttcagcctgggtgctgggggaaggagcacagttttggggacccccagccctggtgatcccaaactccctggggctctggcttcctgtcatcctggaaatgggtgttggaggttaggactgggtggcctgatccagacgggcgtctctcctcccacagaaggtggcctctaaccgagtgccccagcatgtacccagtcccacccctggaaggccctacacctggctcccagacaccccccaacttgcaatcaccctagtccccctcaaggctcccctatgcagagctagaccccggaggaggtcgtttgaggggcaggcattgagttgctttgcaaagttgtctttcagctgatgcttacggggaggacagtccccaggcgtgcaaaggttgacagagcggctgaagtttgggacctaattttggggagggggtatagttaggaggtccggagggctgttgggggcgggggttggagcttcaccaaggtccttcccgtcttatggggcaagagggggagttcgaagaccagccgcatgccggggggttgcagggggcgccggggaatgtgggatctttaaatatgggcggggcttgcggggtcgtcgaaggcggtgccaacccgggctcggccaatcggcggcggctcccgcgtcgcaccgcccccttctctcccggcccgggcgggcgctcgccccccgccgggcccgtggactgggcggcgggggatgcgcctgccgccgccgcccccggccccgccgcccccgggccccgcgcccgctcgctgctgcccgccccgtccgcgaccccggctccggctcccgactgggggtccgcggccgcgcgggaccctctcccctccagccttgtccgcccgctcgggccgagccccgcaggtacagggtgggatgggtgagggtgcgggaggatccaggatctgcagctcagggagcccgaggagggaggcacgtctcggagggggacgcggtttggggcaggggccaagagggagggtctccgtgcggtccggagcctaggagacacaggaaaggtggggggaatgaatgcatgtacattgcccgagtgagtgaggatccacgcacccccatcctgggagggggagggtgcagggttcactttgggggagggcagagctgtgagtctccaaactgcatagatagggttggaggtcggggagctctcagggatggacagtgacccgcaatgacttgggaatgggagggaggtgacccaccactggcccctggatccaggggttggggcactcagggaggggtcaggaaaccgggtcttccatctctccccggacagaagtcccggacccagctcggggcactgcccctgctgttctggagggctggccagcagatgggagttcccgaggctggggtctgagcggagaggctgatggagatgcatcagaatggagggcccccgagggaggcagcctccaggagagcaggctaattgcaccctgctggctgctggcaggctcctggcgggtggtgatggggggatcgggcgggtagccagcgccttgctgcactggctcctgggcggcccatgggacgggagggcaggcagtgtctgtctgccctgcagagctagggccctgtgattattgggggaggggaggggaagggaggggtgggggtggtggcgggaagggggatcctcggagaccttcctcaacctcagcagggacacccggactctggctgcgcccgctggggacccacaacaggcccacatgtcccagaagtttctgctgtgtgctgatctggttgtggtacccggaagcccctgggtgtgcatctggggagcaggggcggtctgccttggggattgaggggcagggagcaccttctcttggtccagttctgaagaacagaaatcaatggcatgaagctcttacagactgcaaagcatttgccatgcgagatcttactctgttctggacaccaaccctcgtagtgggggggtgggggggaggcaccatgaggaatctttacaaagcaggtggccaaggagtgggcagtaacttgctccctggcaggggtacctagggccccttctcagtggctgcctcaaccaacctgtcatttgtaaaaatgctcgctggagggccctgggggcctgactgggattctgtctcttcccatgtcctgttgggtggggaatctaaggagccatcagccctgctccctgctaccctcatcctctcctcaagagctctcatgggtccccccaggcacacgaggttcccccagaagtgtgtgtctccagggagggtgtggaagtgggtctctgctcatcccctgcaccccaggcttcagggaagggagctctcatgaccagacagagtagtaaaagtaaggcaatatcaaagaccttccaacccaaatacaccccgtaggatgtttgttgtttgttagagatgggatattgctagttgtccaggctggtctcgagctcctgggctgaagtgatctcctgccttggcctcttgaatagctggaactaggtatatacctagctaatagggtggtattcctcacttggcaaacccagggctgttacccagaaaaacataccctttcatgggcatccaaaccttggctgagggttcccaggggctcctgggtctctgggaatccctgagggtcccagggactccagtgttaggcccagattgcagtgggggaggggatgtgtacccaggaatggggaaggcccaggcactcatcagttctgtgctccaagctagtggcttctcgacggcaggaccaggccagttcccctcccagaaagcagaccctgccacctgccacgcctggatggcactaatttagtccctgcctttcctggctgggtgaccttgggcaaaaggtgctgagcttctctgagctctgtctcccgtctgtaaaatgggaacgggaatgccaccttgctcaccggtggtgatagggattaaatgtgatcaccctgatctcaggctcaaagcatagtaagagcccggtccacagtaatgtggtgggtgccgggaaagccctccacccctccacccctccaccctcttggaagccacctgccatttctctcctcctccccaccccctccctgcccagggcaccttaggacgcggctgccaggcgaggaggaacatggcagacacacggctgaatttggcccatgcgtcgggtggctgagtcacatccccaaattgcatcttcattggtgcgtttcggaaggtcgtttgcagaggccatcggaggcctacaccccctctgggttctgtctgccaggccacccgcttctcatccctgtgccccccatccccagctggggaagttttgcaccctcggggatggtggaaggggtgcctgggttttcctgggccccctggaggagggcaggatctggggttcctgtgtgcaccctagtgcaagctcccagccccacctggtagccagcggatgttcaggcagtgggcaggggtttgagcctcggagcagaaggcccacctaagtatttgtgaggttacggaaagatcagggccaaggtcagcctcataaactgtcaaatgctgggcccacaaggccaggccttatagactgtgaagtgctgggccggcaggaggtcaggcctgataaactgggaagtactaggccacatgaggctaggtctcataaactgggaagtgctgggcctgcgggaggtcaggccttacaagctgtgaagtgcctggtcacaggaagccacagcctgattgatgtgatgggtgagggtgggaaggggtgggacaagttctgagactcatgaggtcacctgaccatagaaggaatgatttttttttttttttttttttttttttttttttggagacagggtctcactctgttatccaggctggaatgcagtggcatgatctcagctcactgcaacctccacttcccgggttcaagtgattcttgtgcctcagcctcccaagtagctgggatgacaggtgcccactaccacgcccggctaattttgtatttttagtagagacagggtttcactatgttggccaggctggtcttgaactcttgacttcaggtgatccacccaccttggcctcccagagtgctgggattacaggtgtgagccaccacgcccagccagttttgccatgttggccaagctggtcttgaactcctgacctcaagtgatctacccgcctcagcctcccaaagtgctggaattacaggcatgagctaccgcgcccggccacaaagaaataattcttgcactcctgtgtgctgacaccagtatctggagacacatcgtgagggacagacacagtgtggggggtgccggacaaaggcataggtggtcctgcaatgtgtgcggcagccaaagtcacccatgtccaactcagcagtgtagctcatttttttttttttttgagacagagtctcactctgttgcccaggctggagtgcagtggcgtgatctcagctcactgcagcctccacctcccgagttcaagctattctcctgcctcagcctcccaagtagctgggattacaggtgcccaccaccacacctggctaatttttgtagttttagtagagacaggatttcgccatgttggccaggctggcctcaaactcctgacctcaagtgatctgcccacctcagcctcccaaagtgctgggattacaggcgtgagccactgcacccagccaatgtggctcatcttgctgtgtcctggaatgacgatctgctagtctgtcacccccagtgggggtgggaagtgtcctgcctgtgcacacagctgcccccaacccttctcccaggcctggcacatgggggacccctagtgcatgctgttgtgaccatttcaaaggggataacacttggccctccacccacccctgcccagcttgttgggaaaatctcacaaaggagccgggtccggaatcttccctgcaaggagaaggtgtgtcttcaggcaggtttgtattattattattttttttttgagacggagttttgctcttgttgcccaggctggagtgcaatggcatgatctcagctcactgcaacctccgcctcccgggttcaagcgattctcctgtctcaacctcctgagtaggtgggattacaggcatgggccaccacgcccagctaattttttgtctttttagtagagacggggtttcaccatgttggtcaggctggtctcgaactcctgacctcagatgatctgcccaccttggcctcccaaagtgctgggattccaggcgtgagccaccgtgcccggcccaggcagattctttcacaacatcatgccacagtttccccatctgtaaaactggccaaatcccaggacccacttcttggcagtattaggattcaggagaacatttacataaagaatggagcctgggaccgggcacagtggctcatgcctgtaatcccaacactttgggaggacgaggaggaaggatcactggagcccaggagttccagaccagcctgggcaatgtagcaaggcctgatctctactagaaataaaaataaatcatctatggccataccaccctgaacactcccgatctcatctgatctcggaaaaataaatcattagctgggggtggtggcgcatacctgtagtccttgctgcttgggaggctgaggtgggaggatcgcttgagcccaggagtccgaggctgcagtgagctaggattgccccactgcactccagcctgggctacagagcaggcaaggagtgcatttgagggtctgagatactgggctgggcagggcaggggagaatctgacaagttggatccagagtctcagacagcctctcaatgccttggtgagcatgatgactatgtcaccatcattgaggtccctgctctcacacatgatgccacaggacattgctctgtaatcccacagggtgcttttcaaatagcctggcagggaaacaggctagcctgagatcatagagcccagccaagcatgtcttatgtcttacaaagccctgcagaatcgattctagatcttggagttaaagcctgcattgccacactgtttggagatcatggatcccctcctggaaaccatttggattctgtttggaatctgtttggagattatggatcccctcctgcccaggcaggagggagcctcaggatctctgtagccacagccagggtccctaatgtcccataggccacagtgcaggagcctacaaatgcaggaggcacggtgaggtgaggttaactcatccaagagtctgaaggttggaagaggatgagctcagatgaaaaccaccttctaagcataccattagccaccctctcctcccaggcaagcccgttggtagatttcatcttccagcgttcagcaagtgtttcctgagtgtcatctgtttgctaggcattgttctaggtgcttggatacacataaagtcagcaggcagggctctggtaggggggcattccaggcagagggcacagcctgtgcaaggtatcagagaaggatgaacttgttggaatctggtgattgggagaccattgtggctggaggaattgggtctggggagagtaagaaggacgagataggtgggaaccagatacagagggccccttggccatagtgaagagtttggtgttttatttgtttttgtttttgttttttttagagatcggctctagttatgttgtccaggctggatttaaacccccagactcaagtgatcctccagtctcagcctctgagtagctgtgattacaagtgtgcaccactgggcccagctctggagtttctttgttctttttcttttttttgagacgtagtctcactctgccacccaggctggagtgcaatggcatgatcttggctcactacagcctctgcttcctgggttcaagcgattcttctgcctcagcctcccacgcagctgggactacaggcatgcaccactacgcctggctaatttttgtatttttagtagagactggttttcgccatgttggccaggccagtttcgaactcctgaactcaagcggtccttctgccttggcctcctaagtagctgcaattaccagagctgcaccaccatgcccggctctctggggttgattttttcagtgagatggcactggggagccatggcagggctttgagcaggggagggattcaggctgactcagatgtttctgggatggtaaacccacgtgtcagcactctgggccactcccaaacttagaacgttctgggttggccgggatggtccttgcctttctggtcagtaagctggaccctgctgtgaccatgtccctctgtgcccttgcaggtcagtgcaggagcccagccgctgagccatgccgggccccgggcggcctgcagcgagcccaacccctgcacccaggtagtcatgaacagccacagctacaatggcagcgtggggcggccgctgggcagcgggccgggcgccctgggacgagaccctccggaccctgaggccggccaccccccacaacccccgcacagcccgggcctccaggtggtagtggccaagagtgagccagcccggccctcacccggcagcccccgggggcagccccaggaccaggacgatgacgaggatgatgaggaagatgaggccggcaggcagagagcctcggggaaaccctcaaatgtgggccaccgcctgggccaccggcgggcgctcttcgagaagcggaagcgcctcagcgactatgccctcattttcggcatgtttggcatcgtcgtcatggtgacggagaccgagctgtcctggggggtgtacaccaaggtaggcgtggtcctcccccaggcactccagggaggttccaccaagcccgcctagctttcttgacatggggttgggggtggcagggccccccgggagatagggagtgttagggggctcccggaggtgagggctccctggccttctgcatacccacctccaggaaggtagcagggaggctacacatggagaaggaaggttccagcccattccctggccaggtgtcaaggggctgcaccctggcttaaggcggaggggggcttccccccaggacaggggttccccagagtgggcctgctctggggagcaacagaagatcttcctccccttccgagagtgagtgcgtccaggttacaagcctggctgtgggttccctcatgccacctagaatgtgtgaggatggagagagatcagggctgtgtcagcctgtaaactctgaagtgccgaggctggatgaggtccggccttgtgaactgtgaagtgctgtgcccaagtgaggccaggcctcataaactgtgaagcactggacacatcttgctgtcagcccagtccccaggaataaggacaggagagcaccgcttcctgaatacagcacatgctgcacgcccagccctgataagctgtttcacacacagcagccccaggactggggaactagcagaaattcagggtacagtgggagaagccactgggaagagccccatttagctgactcccatgcccgggagccagggtaaggggatgggagggccgccggcccaccgcctccagcgtccatctggctgtgtcctctctctttaccaggagtctctgtactcattcgcactcaaatgcctcatcagcctctccacggccatcctgctgggtctcgttgtcctctaccatgcccgggagatccaggtcagtgctgaatactgcaggaagcagctcctctcctcaaaccccagatccccccacaccagcccaccttagaccccatcccctcaaaacataaaaggatgtataattggcttctgatagaaaaaagatctccataaagacacacagtttccatcattctagatttccttgaaacacacatctgtgttttaattttcattgattatttacaaaaaagaacaggtagtgagaaagtgaggggctgagctgggactctgggacacacgggttgtttccaggctggagtgcagtggtgcgatattggctcgctgcaacctctgcctcctgggttcaagcgattcttctgcctcagtctcccgagtagctgggattacaggcgcatggcaccacaccttgctaatttttgtatttctagtagagacgggatttcaccatgttggccaggctggtctcgaactcctgacctccagtgatccacccgtctcagcctcccaaagtgctaggattacaggtgtcagccactgctcctggcctatttgtttagtttttgagacagggtctcactctgttgcccaggctggagtgcagtgatgcagtcatagctttgacctcttgtgttcaagagattttcctgccacagcctcccgagtagctgggactacagctgcgcaccaccacacctggctaatttttgtattgtcttgtcagtgtctcgccatattgcccaggctggcctcaaactcgtgggctcaagtgatcggcccacctcaccctcccaaagtgttgggactttacaggcatgagccaccatgcccggctgcacacgcatgttgataacagcactgttcaaagtagccaaaaatcacacctgtgatcccagcactttgggaggccaaggcgggtggatcacttggggtcaggagttcaagaccagcttggtcaacgtggtgaaactccatctctacaaaaattagccaggcatgatatcgggtgcacgtaatcccagctatttgggaggctgaggcgggagaatcacttgaacctgggaggcagaggttgcagtggagctgagatcgaaccattgcactccagcctgggcaacagagcaagactccgtctcaaaaaaacaaaaatacaaagtagccaaaaagcagaaacaacatccaaatgtccatccaggcatgaatggataaataaaatgtagtgcacctgtacaatggacaattattcaacctttttttttttttgagacggagtttcactgttgttgtccaggctggagtgcaatggcacgatctccagctcaccgcaacctacgcctcctgggttcaagcaattctcctgcttcagcctcccgagcagctgggattacaggcatgtgccaccacacccagctaattttgtatttttagtagagacggggtttctccatgttggtcagggtggtctcgaactcccaacctcaggtgatctgcccgcctcggcctcccaaggtgctgggattacaggtgtgagccaccgcgcccagcataacctttttttttttgagatggagtctcactctgttgcccaggctggagtgcagtggcgcgatcttggctcactgcaacctccgcctcccaggttcaagtgattctcctgcctcagtctcctgagtggctgggattacaggtgcccgccaccacgcctggctaatttttgtatttttagtacagatggggtttcaccatattggccaggctggtctcgaactcctgacctcagggtgatcctcccaccttggcctcccaaagtgctgggattacaagcgtgagccaccatgcctggcctattcaaccttaacaaaagaacgaaacaccaaaacagcagaaatgtattgtctgaaagtctggagtatagaagtctgagatcaaggcgttagcagggttggttccttctgagagccatgagagacaatccgtcccaggcctctctcctagcttttggttgctgctggcaattttgggggttctcagcttaggagatgtgtcactccaatctctgccttgaggatcacatgatgttctccctttgagagtgtctgtgtccaaatttcccctttttaaaataagaacaccagtcattattggattagggcccactgcaattagatgattccacttttttttttttgagacagagtttcactctgtcacccacactggaatgccgtggcttgatcacagatcactgcagcctcgacatcctgggcttacacagtcctcccacctcagcccccaggtagctgggattacaagcacttgccaccatgcccagctaatttttaaattttttgctttttttgtagaaagggggtcttaccatgttggccaggctggtcttgaactcctgggctgaagcgatcctcccacttcagcctcccaaagtgctgagatttcaggcgtgagccactatgcctggcctgattccagcttaacttcattttaactagccgacctcgttacaatgacctcatttaacgagatgacctctataaagaccttatctccatataagagcacattcagaggtactagaggtcaggatgccaacatatctttttcagcagaacacaaatcaacctataacaatttctgatactgaacatggatgaacctcagaaatacgacgctcagcagaagaacccagacataaaaggccacaaatcgcatgcttccatttatgtgaaattttcagaagatgcaaatccgcagagacagaaaggagattagtggttgccgggggctgggaaaggagcgactgctaatggggacagggctcccttttggggtgatggaagtgttctgaaattagatagaagaggtgtactaaatcccactgaattgtgcactttaaatgggagaattatacggtttgtgaatttcatatatgtatacttgttttttttttttttttttgagatggcgtcttgctctgtcacccaggctggagtacagtggtgcaatctcagctcattgcaacctccgcctcctgggttcaagtcattctcctgcctcagcctcctgagtagctgggattacaggtacctgccaccacacctggccaatttttgtatttttcgtagagatggggtttcaccatgttggccaggctggtcttgaactcctgacctcgtgttccacccgcctcggccttccaaagtgctgggattacaggcatgagccactgcccagcctgttttttttttttttttttttaaacacaggatctcgttctgtcgcccaggctggagtacagtggtgcagtcagagttcactgcagcttgtacctcctgggatcaaggagtcctgcctcagccttccaagtagctgggaccacaggcacagaccgccatgcccagctaaatgtaaaaccttatatatacagatatataaaaccatacatatataaagacaggattttcctatgttgcccaggctggtctcaaactcctgggctagagtgatcctcctgcctcagcctcctaaagtgttgggattataggtgtgagccacagacccggcttttttttttaactgtaattcaggctggacacagtgactcacgcctgtaatcccaatactttggaaggccgaggcaggaggatcactcgagcacaggagttcgagatcagcctgggcaacgtggcgaaacaccgtctctacacaaaaattttttaaacagttagccaggcatggtggtacacatctgtagttccagctacttgggaggttgaggtgggaggatcacctgagcccagggaggtcaaggctgcagtgagccatgatggcgccactgcacaccagcctgggggacagaatgagactccctctcaaaacaaaaaacaaaacaaaacaaacaaacaacaaaatggaggcagtatggacagtaacatagcaagaccccttcctcttaaaaaaaaaaaaaaaaaaaaggccgggctcacgactgtaatcccagcactttgggaggccgaggtgggcggatcacgaggtcaggagatggagaccatcctggctaacacggtgaaaccccgtctctactaaaaatacaaaacattagccaggcgtggtggcgggcgcctgtagtcccagctactcgggaggctgaggcaggagaatggcgtgaacccgggagtaggagcttgcagtgagccgagatcgcgtcactgcactccagcctgggcaatggagcgagactccgtctcaaaaaaaaaaaaaaaaaaaaaaaggaaggagttagaggctccagtaagcagtaagctatgatcccgccagagcaggacccggtctcaaaaatagggtggggggtgggggagggggcgtggctgcattcctgatgataccttttgcctccagctccaatatgattggtcccggctccgtaactgacagatgttatgtatcttggcgctcccctcatctcccctaggactggccctggatatggccagggtaccccatggagggtgagcaatggcgctgtagggtgtcctttatgtcaacgctttgccgatgtgcgagcggaggaggcccctagaacgcgcggccgccacattttaaggaagtgacttttttttctttttcttattttagaatgactttattgcttcttatttttaaaatgacacgtgaaaaaggaaaaaaaaagatacttaagagttatacacacgttcagaaggaagagaaaagtacagtgaagggctgggcacccacacctggaatctcagcactttgggaggctgaggagggaggactgctggagcccaggagttcaaagccagcctgggcaacagagcgagtccccatctctgcattaattttctttttctttttctttcttttttttttttttatcgagacaagagtctcactctgttgcccaggctggagtgcagtggcgcaatcttggctcactgcaacctctgcctcccaggttcaaatgattcttgtgcgtcagcctctcaaggctgagattacaggcacccgccaccacacctagctaattttttttttttttttttttttttttttttttgtatttttagtagagacggggttttgccatgttgcctgggctggtctcaaactgctggcctcaagcagtcctcctgcctcccaaagcactgggattacaggcaggagccactgcacccattctgtttccacttttggaggttgtgaatagtgccgttgtgaatgtgtctgtccaagcgtttgcttaaacacttgttttagtttctcttgagtctgtctaggagtgggattgctgggtcattagtaactctatgttgaactttttggggaacactcatatttcgttcgaactgtggccagtgctgagaactagagagttttgcatacgaggtcacgtttctgacttctcttggaaaaatttgaagctggtgcggttgctcacacctgtgattccagcactctgggaggctgaggcaggaggacacttgaggccaggagttttagaccagcctgggcaaaatagggagaccccatctctacaggaaatttaaaaaattagccaggcatggtgttgcatgcctgtaatcccagctcctcaggaggagactgaggcaggaggatcacttgagcccaggaggtcaagactgcagtgagctgtgattgcaccactgcactccagcccaggcacagagcaagaccttgtctccaaaaaaaggaaaaagaaaagaaaaatcctcgccaggcacagtggctcacacgtgtaatcccagcactttgggaggccgaggcatgtggatcacttgaagtcaggagtttgagaccagcctggccaacatggtgaaaccccgtatctactaaaaatacaaaaattagccgggcatggtggcaggcacctgtaatcccagctactcgggaggctgaggcaggagaattgcttgaacccgggaggcagaggttgccaagatcgtcttcatggtgcatgagccaagtgaaccaggattgcgccactgcactacagcctgtgcgacagagtgagaccctgtctcaagaaaaagaaaaagaaagaaaagaggctgggcatggtggcttacgcctgtaatccctgcactttgggaggccgaggtgggcagatcacctgaggtcaggaattcgagactagcctggccaacatgatgaaaccccatctctactaaaaatacaaaaattagccaggtgtggtggggcaagcctgtaattccagctactccagaggctgaggcaagagaattgctttcacccaggaggcggagattgcagtgagcagagatcgtgccactgcactccagcctgggcgataagagcaaaactccatctcaaaaaaaaaaaaaaagaaagaaagaaagaaagaaaaatccgagcctgtggggtttcaggccaggctgacgtcactctctaggggcgcggtggggctgggcagggagcgcggcgcgtgtctgacacccatggctggttccctcccgccctccacagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtcttcagcatctcctcctggatcatcgcagcctggaccgtgcgcgtctgcgagaggtgcgaccgccgcccctggagcccccccagcccccagcccccgtctccctggacctccatgcccattcatgatttcaccgaccctgggcccctcccgaccctggccattgcttctgtctccccgactgcaagacacccgtggtgcctcctgtcttccagtttgtggcttcagtaatcatcctccctggggacctaaccctgtgtccccagctgccctcaaccagggagggaccccagctccctctccctcatcctccctgccagggtctcccaagcttccttctcccagcccctcggctccctgggaggctgactcccgatctctggccccggggggcgcaggcagcaggcacagggatgcctccccgtcccctctgtctcccatctcccacgtttaaccagctttcattttcccctctgcccgctccactggactttagggaaaacatgtgagtcccaccctccgctgagctgtgtgcgcagagcagccactgccaccgctgccgccatccccgacccgctaggaatttaagattagctgccgcaaggggagggaggcagggagaacgggcccggcggggtgggtcggggtaagtcaccccgtcacgggggcaggccactccactgggcgtcctctccgagcctcagggcccttgtgtccgaagggtgagggattaaggaagggcttggctctcatgttgtgtttgggcagctgacccctgggagctccgatgtttcctcccaagacttaaatggatctggggtgggctaggtgcggtggtggtgcctgtgatcccagctactcgggagcctgaggcaggagaatcgcttgaacctgggacgcggaggttgcagtgagctgagattgcgccactgcactccagtcaaaaaaaaaaagacaaataaatgggtctgggatgaaggaaaaccggccgtgcctttgggacctccaagcaggagggagtctgttgtaaatacccctaggaggtggtggaccatcaacccgatttacagagagggaaactgaggctctgggggacaaagggacttgcccggagccttgagtcctggcagtctcagaggcaggaggggctccgccaggcctggggtgtgagggtgccttatctgggagagggtctccctgccatgcgcctagctggtggaggccctggaggggtccctggctggacccctgcttgccctcagcaccccatcctcatccctccacccagcccccaccccccatactcccacgggccctgcctgggcatgaggcctggctctcagggatgaaaggcccagtttctctggctgttaaggcttccagggctctccttgggctcttgatgttcccccatgcagctctcacacccctgatgggtggggtcagaactagggttaggggtatggggtgcccctcgtcaggtatccctgaggtccaagctgggtccttgcagggctctgggggggtggggcacggggcagggccggcaggcagccaatcctaaattctgagcctggcgacaatgcttgaagcccccttgcctgcctcgctctgacccacccccgcctcccgcatgtcccccagccgtgctcctgggtggtcccgcggcaccccccaccatcgctccgtctggatctggggctcacccacccaccgactagagggcacccccccgcccctcctgccctctgggggtcaggcagcttggggctcagatgttttggtgtaagatgggggtcagtcagctgggcaccgtggctcatgcctgtaatcccagcactttgggaggccgaggcgggtggattaccaggtcaggagattgagaccatcctggctaacatggtgaaaccctgtctctactaaaaatacaaaaaaaaaaaattagatgggcatggtggcgggcgcgtgtagtcccagctactcgggaggctgaagcaggagaatcgcttgaacccgggaggtgtaggttgcagtgagccaagatcatgccactacactccagcctgggcaacagagagagatattgtctcaaaaaaaaaaaaagatagggtcagtccctgggcctttacccagcaagtgtcctagaagcccagactggaggtgcctggagtggcattcgacttccgcgggagtgaagacccccaaatgccaatatttggggagcccccatctccttccctctggagcctgaccccagccctatccttgggctgtgtcacccactgtgcctggcacaggcctcccctgaagatcctgctctatccaggccacttcctcggtgctaccccagttggcctctgaccttgaacaccccagaggctggcttggggctcaggtgatctaagccctgggaaggagtgggttagctggaagccaggtcagagggggcccagtctccagaaaaaggccaaggggatttggggactgagagctgagtgggaacagatcctagagccacccccagacccagagagccaagccctcggcccgctagcatggccacaggcagaacctctttgcagcccctctggccgaagtcccaagcctggctgtgaccaggactaagttctgtcagtcttggggcctgtctccctgggtcccaaatatagccccaggcatctccccagtgccaaagccgatgcccctctcttcccaacccccagatgcaacataggctgagttgggggactcatgctgtcctccagtctatgtccttcctatatggacgtcccttcttcactcgagccccaggtggtgatcctccagcctcccacctcctccagtcctcctccctccttggggccttgctggctgagaaagttcttcctggtgtctgtcctgaattcttgcctccacctcctgctgcttctggtgctgtggtcacccatccccctgtctgtgtgtctgtcgttgggagggggattgtatgttcatacaacctcacctgggcccctctctgccccatccagggaagcagcttgggggggcaggcaaagggaatgtggaagggctgtagcgggggagagggtgcgcctgtcctgtacccacaggacatagccccaacgcagcgaggtggactcagggccctccagccctggcgctgccccagggggtgtgatggaggcaaaggggatggtatagactgagccctccctcttcccactctggctcccccaggtaccacgacaagcaggaagtgaccagcaacttcctgggggccatgtggctgatttccatcaccttcctctccattggctacggcgacatggtgccccacacctactgcgggaagggtgtgtgcctgctcactggcatcatggtaagggtgagggtccatgtgtatgatcctgggaggtccagccagctgcccgctccaccagcccttgcataccccttgctgacagggtgctcatcccatcacgagctgtgcctgatcagcgtccctccatctgtcagtccacccctcccctgctctgctcttttcctctgacgtcacgtggaagccacacccacaggcttcctgggacatctccatgcggtccttccaggcctagatatgcagctcccaccatgcctgcccagtaagaagctgcggtccactctgaccagagagtcactgtcacccctttattctctacagcctgatttattcacagcctttggatccagggcaaggggcttgatgctgatgtgccttagtttcctcagctgtgaccagcgctacttcctctgctttgcaagggctaagtcggttatttatgtgagaatcccagaactgtgaatgccatggacatgctataactacctgctgggggccgggcgtggtggctcatgcctgtaatcccagcactttgggaggccaaggtgggcagatcacctgaggttgggagtttgagatcagcctgtgaccaacatggagaaaccctgtctctactaaaaatacaaaaatagccgggagtggtggctcacacctgtaatcccagtactttgggaggccaaggcgggtggatcacgaggtcaggagttcaagaccagcctggccaacgtggtgagacccagtctgtactaaaaatacaaaattagccgggcgtggtggtgggtgcctgtaatcccagctactagggaggctgaggcatgagaattgcttgaacccaggaggcagaggttgtggtgagcggagatcacgtcattgcactccagcctgggcaaccagagtgaactaagtctcaaaaaaaaaaaaagaaaaaagaaacctgctgggctgtgtcctctgcagcccaaactcccttccttagctgactttcggggtgttccctgagtttttcgtgacagtgggcgcaggcagcaccccgtctccccgaaggattctcaagtctgccgtgggtgcctgtgaacatcctttcacactcactgctttctcttttccctaattcagtcatcggggtccctgtccatcccctctttccagagccttctttctctccagacatgttttatgcccatgccaacaaacgcttttccatgttttatttttatgtttttataaagatggggtctcactatgttgcccaggctggtcatgaactcctgggctcaagtgatcctcctgcttgggcctcccaaggtgctggagttacaggcctaagcaactgcacctggcccatgcctgactttgtttttttcctcattgagatggagtctcactctgttgcccagcctggagtgcaacggcacgatcccagctcactgcaacctccgcctcccgggttcaagccattctcctgcctcagcttcctgagtagctggaattacaggcgcctgccaccaggctcggctaatttttctatttttagtatagacagggtttcatcatgctggccagtctggtcttgaactcccaacctcagataatccacctgcctcagcctcccaaggtgctgggattacaggcatgacgccaccacgctggccctttttttcttttttttttttgagatagagtctcgctctgtcgcccaggctggaatgcagtggcgtgatctcagctcactgcaaccttcccctcccaggttcaagcgattctcctgcttcagcctcctgagtagctgggatggcaggcacctgccaccaggcccagctaatttttgtatttttagtacagacagggtttcaccatgtcgaccaggctggtctcgaactcttgacctcaggtgatccacccaccttggcctcccaaagtgctgggattacaggtgcaagccactgcacctggtccgtgtctgcttttttgctggcagcccagcatgggtccctccctgtagcatctgtgtggtgcatcatgctgttgcagagccgttgtccattccttttccttgctgtctagtattctaggtggaggtttccagcaagtcactctgtcccagttgacagggattttcctgagaacaggcttctgggtcctctcaaaacctttgtcctggcctggaaaccgagacagggtttcctccgggagcccctgcttgtgctctaggccaaccctgctcaggctcagggtgttggcatctaaacctgcctggggctgggcatggtaatggctcatgcctgtaatcccagcactttgggaggccgaggtgggtggatcatttgaggccaggtgtccgagaccagcctgggcaacatagtgagaccccatatcgctaccaaaaaaaaaaaaaaaaaaaaacagggccaggcgcagtggcttacacctgtactcccagcactttgggaggccaaggcgggtggatcacctgtcaggagttcgagaccagcctgaccaacatggtgaaaccccccctttactaaacaaacacacacacacacacacacaattagcgggatgtggtggtgcacgcttctagttccagctactcaggaggctgaggcaggagaatcgcttgaacctgggaagtggaggttgcagtcagctgagattgtgccactgcactccagcctgggcgacagagcgagactccatctcaaaaaaaaaaaaaaaaaaaaaaagaatcgtcctacctcctggagttgttgggggtcgaatgagctaatgtgtgggacatggttccctctgacatttgatgaataggaaacgagtagacctgaagtcagtgagctcagcagatggaatccactcacactgctggctcagagaatggggaggctgcaatctgggcaggcttcctggaggagggagtgacctcaagacaggacgctgatgtgccccctctgccctgcacacagggagctggctgtaccgcgctcgtggtggctgtggtggctcggaagctggagctcaccaaggctgagaagcacgtgcacaacttcatgatggacactcagctcaccaagcgggtgaggaccgcggttcccatggaggccgcctcctggccttgtcagcgagcgtagaacttccctgctttccctctgtacgtgccgggcatgctcatgtgcccatgggttaccatgcagccccgtgtcaagactgtgctggctttgggaggccaaggcaggtggatcacctaaggccaggagttcgagaccagcctggccaacatggcaaaatcccatctctactaaaaatacaaaaattagcctggcatggtgacggacgcctgtagtcccatccacttgggagtctgaggcaggagaatcgcttgagcctgggaagcagaggctgcaataagccaagatggcaccactgcactcgaacctgggtgacagagcaagactccgtttaaaaaaaaaaaaaaaaggactgtgcttggctctgccaccacgcacccatctgtgagtaatgcacagagagacatcgtggcatcaacccttgtgcccagtcacgtccagccatgagcattcagtaagaggcttgagccagaccgccatatgcaatttgagagctgcctgaccctagcgggttgactgctctgtacctcagcttccccatatagaaaatcagggaaataaaaacacatgccgattcactgagttaacatctgcatcatggccgggcgcggtggctcacgcctgtaatcccagcactttaggaggccgaggcgggcggatcacttgaggtcaggagttcaaaaccagcctggccaacgtgatgaaaccccatctctagtaaaaatacaaaaattagctgagcgtgatcgcaggcgcctgtaatcccagctactagggagagtgaggcagaagaatcacttgaacctgagaggtggaggtcgcagtgaggcaagatcatgccactgcattccagtctgggccacagagcctcaaaaaacaaacaaacaaacaaacaaacaaaaaacattaaaaacatttgcatggtgcatagaaggggcctggcccatcatgagtgatgtgtgttaggtatacacacactgcacagatgttgttgtacaagcatggccctgccttatagcccagggaccctgagaggcatttccagaagtttctagaggtttctggaagattctagacatttctggagccttttggaatttcgcgccaaccctgaggaattgttctttttctggccccaggtaaaaaacgccgctgctaacgttctcagggagacgtggctcatctacaaacataccaggctggtgaagaagccagaccaagcccgggttcggaaacaccagcgtaagttcctccaagccatccatcagtaagtccagcacctttccagctcacgtttctgtgtccacatggcgcggaggcagccctcgcagctctgtgtggcctcttcacggctccctgccagggacgggtggtcagttggttggggcctgcatcttctgagctgggtggatgggaggatcttcagagggaggcagatgatggggtctgctaaatcatggacacgactcagtaagtggcaggatgtatattttattctctggaataaccaggataattcttaccctttagactttgaagcgatttcctctttttgctttgtctgccaggaggctcatagttaaatccatggtctgatccatgggatcatgtaggataactagaaatgaattgggccaggtgcggtggctcatgcctgtaatcccagcactttgggaggcaggaagatcgcttgagtccaggagttcaacaccatccgtggcaatacagggagaccccatctctacaaaaactaagaacttaactgggtgtggtggtgtgcctctgtggtcccagatactcgggaggctgaggtggaaggatcacttgagtctgcagggtcaaggctgcagtgagccatgattgcgccactgcactcagctgggttacaaagtgagaccttgtctcaaaaaaaaaaaaagaaagaaaagaaaaagaaaaaaaaggccgggcgcggtggctcacgcctgtaatcccagcactttgggaggccgaggtgggtggatcacgaggtcaggagatcaagaccatcctggctaacacagtgaaacctcgtctctactaaaaatacaaaaaattagccgggcgtggtggcggacgcctgtagtcccagctactcgggaggctgaggcaggagaatggcatgaacccaggaggcggagctcgcagtaagctgagattgcgccgctgcactccagcctgggcgacagagtgagactctgtctcaaaaaaaaaaaaaaaaaaagaaaaagaaaaaaaagaagaaagaaattgcttgattccctatgttgtttctttgccctgagaactatttaataaagtagctctaaatccttggctgctcattgaagtcaccagggggctttttaaaaatcccaagagccacatccaacatcagttacttagtagagtctgggttgcagtctgggtttacatttaaattcctcaaatgactgcttggttgggcatggtggctcacacttataatccctgcactttgggaggccaaggagggaagactgattgaggccaagatttggaaaccagcctgggaaacatagtgagaccccactctatgtaaaaattaaaaaataaagcgaggcgtggtgactcacacctcgtaatcccagcactttgggaggctgagccaggaggatcgcttgaggccaggagtttgcagccagcctgggcaacaaagtgagaccccgtctctacaaaaataaaaaaattagcccagtgtggtggcatgtgtctatggtcccagctacccaggaggttgaggtgggaggataacttgagcccagaaggtcaaggttgcagcgagctgtgattgcgccactgcactccagcctgggccacagagcaaggccttgccttaaaaaactatatatggctgggtgcagtggctcacgcctgtaatcccagcactttgagaggccgaggcaggtggatcccctgatgtcagcctggccaacatggcgaaaccttgtctctactaaaaatataaaaattagccgggcatggtggcacgtgcctgtaggttgtactgagctgagatcgcaccactgcactccagcctgggcgacagagtaagactcagtctcaaaaaatcaaaaataaaatatattaaaataagtaaataaataaaatttcctcagttgagtccaatatgcagccagtcagcaaactttttctgtaaagggccagatggtaaatctttcaggttttatgggccagaccgtttctgtcccactcttcaactctctgctgctgaggcagggaagcagtgaggataacctggtgtggccatgttccaaagaaaccttattttccaagacaggcggccggctagatttgacccacaggccataatatgctgacgacaatgctgtccactagaatatcacgtgagcaacatatataattttaaatttgctaacagccacattagaaaaaagtacaaaaggctgggcgcggtggctcacacttgtaatcccagcactttgggaggccgagatgggtggatcatttgaggtcaggagttcaagaccagcctgaccaacatggtgaaaccccatctctactaaaaatacaaaaaaattagctgagcgtggtggcacatgcctgtagtcccagctactcggaaggctgaggcaggagaatcacgtgaacctgggaagctgaagttgcaatgagccaagatcactttgagacagtcccctggactggcttaggtacagaagggagtgccagcaggtgcagtggctcatgcctgtaatccttttggaggctgagacgggcggatcacatgaggtcaggagttcgagaccagcctgaccaacatggtgaaaccccatctctactaaaaatacaaaaattaaaccaggtgtgctggtgagcgcttgtaattccagctactcagaaggctgagccaggagaatcgcttgaaccggggaagtggaggttgcagtgagctgagaccatgccactgcactcccgcctgggtgacagagtgagactccgtctcaaaaaaaacaaagggatggtcaaaaggggcgagggcatacactaaccaactccccctgcggccagctgtccagagaccagggtcaccagtgccaacaccaacaccaagtagcaagtgtgggttcaaatcctgccggggtgcggatgggcagtggctttacccctctgagcctcagtttccccctcaggagatggtgtcggcatagttttctgaatgaaacaccgcctccggtggtggtgagaggacaggtgtgcccctgaggggctggcacagaaccctcagaggctgggcacctccccagagcaacggcagcccctcggccatctgggaaccccgcgcggggccctagggtggcatccccgggaggtgggcagggttgggtacatgccgaacaactgtgctgaggttaaaattgccttgtgatttttctcctgctctgcccggtcctgccagggctcagaagtaagtgttctcccaggggcttggtggggctgggaaatcgggggtgcatggtggtcacagacagggggtacacccggggcatgccaaccccagcctcagaggcgggcagggttcacatctgccccatggatccgtgcaggcttcaccttggtctgggatccaacttcctggggcagtcctgagttgggccggagacaggaccagccaatgggtggtgtgggcggtggccaggctgacttctggccctggcgcaccggctgtgtactgggagggaatagactacagggaatcggcctcccaactcccacctcatcctctgatgcatgtcccataggtgaccccgggtgggtgcatgaaagtccctgcccccactgcagcctccacgggaacctgcctaaccccctcccccaaccccgtgtccccacaggctccggagtgtgaagatcgagcaagggaagctgaacgaccaggctaacacgcttaccgacctagccaaggtgagtgggttggggcagggtgggccagacagggcaggtggggccccggagcagatgggatggggctcagctcctgccggaggagggcacaaggacccgctgtgggctgagtgcagtggcgggcggatcgcttgagctcaggagtttgagaccagcctgggcaacatggtgaaatcccgtctctacaaaaaaaatacaacaattagccaggcgtggtggcgggcgcctttaatcccagctacttgggggctgagggaggagaatcgcttgaacttggggggttgaggctgcagtgagccgagatggcaccactgcagtccagcctgggtgacagagtgacaccctgtctcaaaaaaatgataataattttaaaaataatttaaaaatttaaaaagagtacacaattagggggctaaatgggtgaagaggtatttctagatttaggcataccacctcaattcaagatctgaaatggaagagaaaaaattcctttgctatgggtataaattcaaatgatagccttgggagaaagctttgtataatttgtatagcaattaaacatctgtcaggaaatttaaattgattgcaagagaaattggggccagctgggttcaatgggtcatgcctataatccctgtactttgggaggctgaggcaggcagatcacttgagcccaagaggttgagaccagcctgggcagcacagagagaccccatctgtacaaaaagaataaaaaaattaaccaggcatggtggtgagtgcctgtagtcccagctattagggaggctgaggcgggagaatcacttgagcccaggaggtcaaggctgctgtgaggtatgatcactctgctgcactctagcctgggcaacagagcgagaccctgtctcaaaaaaaaaaaaaaagcaagaaagaaatcagtttgtgttatacatggatctgtgtgttgattcgaatatcaagtcatctcccacttttttttttagctttatttatttattttttgagacagagtcttgctctgtcacccaggctggagtgcagtggcgtgatctcagctcactgcaacttccgcctcccgggttcaagcaattctcgtgcttcagcctccagagtagctgggattacaggcatgcaccagcatgcccggctaatttttgtacttttagtagagacggggtttcgccatgttggccagcctggtctcgaactcctgaccttaagtgatccacccccctcagcctcccaaagtgttgggattacaggcgtgggccaccgtgcccagcccatttcccactttttgaattcttccactggaagatgtgtcactggaccagttgcaattaatcaagtgcttgagatctttgcaacactgatttgaattcccttctgaccaatgacatagtttcagaaaatagcttttgctcagtggctacatcccctgatctatcagtcagcttgaggctaatttcatgttatctttagaaaatgttaagtcccattctattttatttcttgtccccagtgcattttggactcacttcctccatcactaggaagagaatgcaatctagcttaatattaacctacaagaaatttaatttggaagggaatcttcttttttttttttttctgagacagggtcttgctctgtggtacaggctggagtgcagtggcaaaatcatggctcaccgcagcctcaacctccccaggctcaagcaatccccccaactcatcctcttgagtagctgggactacaggcgcacaccaccaggtcctgctaatttttgtattttttgtagagatggggtttcaccatgttgcccaggctggtctcaaactcctgagctcaagtgatcctcccgccttggcctcccaaagtgctgggattacaggcgtgagccaccgcacccagaaaagaatcttacagagagaaaaacatattctagacccctgaagatatacagttaactctcgaacatgggggttatggggtgctgaccccttaaaagtcaaatattcccatataacttctttttttctttttgagacagagtctcactctgttgcccaggctggagtgcagaggtgcgatctcagctcactgcagcctccatctcctaggtttaaggtattctcctgcctcagcctcctgagtagctaggattacaggtgtatgccgccacgcctagctactttttgtatttttagtagagatggggtttcaccatgttggccaggctggtctcgaactcctgacttcaagtaatccacctgccttggcctcccaaagtgctgggattacaggcataagccactgtgcccggcctcatataagttttgacgccccctcaccccaaatttaactactgatagcctaccattgaccaaaagccttactgataaacagttgattcacatatattttgtgtatatatactgtattcttacagtaaggtatggtagagaaaggaaaatattaagaaaatcaggccagatgcagtggctcatgcctgtaatcctagcactttgggaagttgaggaggggggatcacttgagctcaggaattcaagaccagcctgggcaacatggcaaaactccattgctacaaaaaaaaaaaaaaaaaaaatagaaaaattagcaggaggctgaggtgggaggatcacttgagcctgggaggtaaaagctgcagtcagctgtgactgtaccactgcactccagtctgggagacagagcaagactctgtctctaaaaaataaaattttaagcctgggtgtagtggctcatccctgtaatcccagcaccttgggaggcaaaggtgggcggatcacctgaggccaggagttcaagaccagcctggccaacatggtgaaactttgtctccactaaaaatacaaaaattagccgggtgtggtagcgggcacctgtaatctcagctacttgggaggctgaggcaggagagtcgcttgaacccaggaggtggaggttgcagtgagccgagatcatgcctctgcactccagcctagacaacaagagcgagacttcgtctcaaaaataaaaataaaaataaaaattttaaacctcagaaaagactaaaaagaaccacctgaaggctggacactgctctggcctccagatgtcaccctctggctctagggactgtggtgcctgagagaggccagggtaaggtcagtggtgctaggaggggaggcccccacaaggtgtttgcactcggagtggggtctgccttgcactgatggagggaaaagcgtagggggcacagtggaggaagctgggaggaagaggctgggtgtgagaggacagaggagctggggtgggcacctcgtcctgtcctgtcttccttccaccactgcctccatcctcccacggaggccgccgcggggtggcaaaccggtgtcctgacccagctgcgctcagagccgtggagtgatgttctagtgccacctggtggccagagtggtgtctgcacccaggactgtccctgcctggccggcctcccctgcccatagggggacagtgccagaactgggcagttgaggtggtagggatgccccactggctgctgtaacagtaattgtggctgtcgtgttcccagtctgtgattgcgtcagattctcagggcagtcaccttcgtcattagacccctgtcccctccccagcctaatgggaggggtggcagttcacgactgaacagggtcccccctcctcttcttcctaggcagccatgtccccacgctcctgctgttccccagcctggagcaacgtcagccccaaacatcccccaggtctgtgggtaccacttgagcactgcctgtggctatgtgtgccctgtggccactagacccccagggcagctctgggcatgtccccccaccccagaacctcactaggcctttcccaggcctgccagccctgagcttggcttgcttgctttctttttcttgagacggattttccctcttgtcactcaggcgcactgaaacctccacctcctgggttcaagtgattctcctgcctcatccccccgagtagcggggattacaggtgcccgctaccacacccggctaatttttgtatttttagtggagacaaagtttcaccatgttggccaggctggtctcaaactcctgacctcaggcgattcgcctgcctcggcctcccaaagtgctgggattacaggcgtgagccaccacaaccagctgagcttggcatttaagacctgtcttttaggctgggcgcctcccggaaagaggaggttgtaatgagccgagattgggccactgcactccagcataggtgacggagggagtctctgtctcagagaaaaaaaaaaaaaagagagaaagaaaagaccagtctctcccctcatccactctccaatccttccctgggcccagcaagggacctctggggctgggggtatcctcccagccacccctcacacgggccccattagtggctggcacccacctggagcgtgtgggctgtccctctctgtcattggtgtcgtggtatcgtcctttcctctctcactcagcggcgcctctctcctgcccctctctgtctccggcagacccagaccgtcatgtacgaccttgtatcggagctgcacgctcagcacgaggagctggaggcccgcctggccaccctggaaagccgcttggatgcgctgggtgcctctctacaggccctgcctggcctcatcgcccaagccatacgcccacccccgcctcccctgcctcccaggcccggccccggcccccaagaccaggcagcccggagctccccctgccggtggacgcccgtggccccctcggactgcgggtgacggccctgcccgccaccagacccctaaatcttggccatcgtgtggccgccacctccgggaagccttgtacagtggcgcctcttggagttcaagaagccaacgctgagtcaggctgagtggactgaggcctgccccgcccagactgcccaggcagagggcagggctggaccatgggtgagggcaggggagcccggagcttcctctggtcacctggtcccccgactctccccaggcccccggtgggcatggagcagcccggggaggggtccgtgctggttctgaataaagcaggacccgcctagtggctgcctgtgtgcatggctggaaggcactggtgatgtcccaggaggtagacctccagccctgggtaccaagatgaatgtgggaatcagaaaaacctgttcccatcaccggcctagcctagaatcctagcctagaagccctctctccctctgggctggagctcagtgagggacaactctctagggacacctgtaccagccccacctggcgctgagatccctcagacagcatggcccagccctggccagaagcatcgctccccttcaaccaaccgcgttgatggacacccactgtgtgccaggccccagcggggcccatgggggaggtgacctgggtgaggaaggtcatttgggtttttgtgagatttgtattgagcacctgctgtctacagagaatgtgatgatgtcaattaccacactgattcctcatcagaacttgaccatggtgggatgggggggaaactgaggcccagagaggtgaatctacctacctgggaccacactgcgaggaaggatggtgcattcaaactggaaatcccctaggccaaagtaaagaaccggactggctgggcacagtggctcacacctgtaatcccagcactttgggagggtaaagcgggcggatcacctgaggtcaggagttcaagaccagcctgggcaacatggtgaaaccctgtctctactaaaaatataaaaattagctgggtgtggtggtgcacgcctgtaatcccagctacttgggaggctgaggcaggataatcgcttgaacccaggaggtggaggttgcagtgagaaaaaacctggacttggtggaagggactccatggaggagccatggggacgtcaggaggaggggttatttggtgacatccaggggtcagagagacccttcaggggtgggctacaggggagggttccagacacaagtagaatcagaaaggtccctggaggccatgggcttgggtgctgggagcaacaggcatttacttggcagatgctgagccctgggtggggcgaggaggcctggctcctggggagacgacgctgtgcatagccaaggagccccaggtcctggcagcctctgataaggccatccatcgcctggctcaacgagataactaggccgtggctggtgcatgaatgaccagcttgggcccacgcacgagaagggtatgaggaggtgctggtcagacccgggttcgagtcctgactctgccactgctgggtgactctgagcagtggctgcccctctggggccttggttgtttcatctgtaaaatggggtgacagtctatttaaccagaactccctaaaaagggccaggcaactggtaggtgctcaataaatgctccttcccgcctgagggatcacattggagtctttggcaggactcatcctttctaccctgttgtctggctggggaaactaaggcctgagaaggaaaggggctgtccttcagggtgagaacccagggttcggttaaggaacatccgtgggtgtaccttctgtgccagtggtagctcccaggtctgatggcagaggcacagtaaacccatagtacttaaaaaaaaaaaaaaaaaaaaaaacaccaaagccataaagttatgaacaggccgggcgtggtggctcacgcctgtaatcccagtacttcgggaggctgaggtgggaggatcacctgaggtcaggagttggagaccagccggccaacatggtgaaaccctatctctactaaaaatacaaaaattagctgggcgtggacgactcctgtcgtcccaggtactcaggagactgaggcaggagaattgctagaaccagggaggtggagattgcagtgagccaggatcacgctactgtgccccggcctgggcgacagagcgagactctgtcttaaaaaaagagagagagaaagagaaaagtaaacaaggcaagaaagaaagagaaaaaaagaaagagaggaaggagggaaggaaggaaggaaggaaagaaagaaaaaacagagaaaagtaaacaaggccagaggtggcaaggggactctgaggaagtggcatttgggcgtgggcgggatgggtgggagaacggatctggtagcggaacggcccagtgcggaggcgaagagagctactcgaggtggattttgtttgagggacagccatgaagtgacaatgacggggagactgaggcggtgccgggttctgggcggcggggggggcaggggtagtgaggggcgaatgagaccatagggctgagatctgcggccgcctcggtgcctccccagccacctcc

SEQ ID NO: 12069 - DNA, 51110 bp, Human
  misc_feature (1)...(51110): n = A,T,C or G
actgaggcaggaggatggactgagtccaggcattggagaccagcctgggcaacatagtgagaccttgtctcaaataaataaatcaaatttaaagggaaaaaagccaaggctcaaatagcatttataccaagcaattgtgggaagagaagggtgacatgtctacatacttgtgtttaagaatctgcttggaaaaaaaaggaaacataaaaatgcctctgccaaaagaaaagtcttttcactctaagcctttttgtgtttttccaaaatttttttttgccatatacattcattatatttcagcattaaaatatttcacctgtcaacttggaaaagtaaaagcgtgaatacagtaaatatttaaaaacagatgaagataagtaacaggttacattaattgtatacaatcaatctagtttgaattaggtgtagatataataattctgtgtgtttatcttggtgaagaatggtcctttaggttgtcattaaaaagcacctctgggaggtaaaagacataggcatctggaagattcatatttaatgaagttaggggacatttgatgtcactccccaggtgtggggagatatggacagaaaaccagaaggaacgaatgtggtcaggaaggaattggagttcccctccaaacagctgccacaagaagtccacacacgtggagacagttgtgcaatttggtcacagagtgtcctaggtgcttttgcttcattgctcctccactgaagcacgctggcagctggcctccttcccctgggactaaggatatcttggctggaactctgctctgaaaaggggcatggccaaactttcactagggctcttcgttggggagcacgatggacaaaagccttcttggggctaggcaggtcacttcaaacttggagccgccaaatattttgggaaatagcgggaatgttggcgaactgggcaagtgcgttttctgattaagagcaaccagattcagctttttaaactacaattatactggccaaacaaaatacccttatacaaaaaccaaaactactggcaggagtcgctgccagcttgcgacccggcatacttggctgagtatccgcttctcccttgtggctccaaactgctgcagattctcggccacttcagacgcgcgcgatggcgaagagggtcctgcactttgacgcgcctggtgaagcggctcttcgcagcgctcctggtgatgctccccaaatttcggggaccggcaagcgattaaatcttggagttgctcagcgcccgttaccgagtactttttatttacaccagaaacaaagttgttgctctgggatgttctctcctgggcgacttggggccagcgcagtccagttgtgtggggaaatggggagatgtaaatgggcttggggagctggagatcgccgccgggtacccggttgtaggggcggggctggcgcacgggaggagccctcctccgctccggccccgccgctatggccccgcctccgcgcttctagagtgtcggcacaggtcgcactcgtcactgaggtccgcgaacgcgagcaggcgttcaattgtttggtcgcttgcgttctctgcgctggcccgacattacttgtcgccctgataaagttccgtttgtcaccctggataccttctcctaccgggcaccggagtagggccttgtacctgtgttctgccctgtttcttcctatgctatttgccggcggacgctctcgtaatctcgtatcattatctatcctgtttcttgtcnnnnnnnnnnnnnnnnnnnnaccagaacaaagttgtgctctggatgtctctcctggcgacttgggccagagcagtccagttgtgtgcgaaatgggaatataaatggcttggggagctgatatagacgcgagatacccggatgaggggcggactggccgaacggagagcccctcctccgatccggccccgccccgcatggccccgcctccgcgctctagagtttcggcaccagctcccaccctgcactgagttccgggaccccgggagagcggtcaatgtgtggtcgctgcgtttcctctgcctgcgccgggcatcacttgcgcgccgcagaaagtccgtctggcagcctggatatcctctctaaccggcacccgcagacgcccctgcagccgcggtcggcgcccggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtaaggagcccactctggaggaggaaggcagacaggtcgggtgagggcggagaggacctgaaagccagatctaactcggaatcgtagagctggagagttggacaggacttgacattttgcgatctttcatttaccagtggggaaactgaggctcagagactggcccaagattacccagcgagtctgtggtcgcctgtgctctagcccagttccttttctaggactctggtttgcgacagggacctcggctggagcgtgtcctgagatgccgacacaccctcaggctcttgggaggctggggtgggaaggcgcctggggttggcaggcaggaggtgcctccgcaggcgagaaaaggcggtgaaaagttgtctggctgcgcgcaacatcctagtccgggcccggggaagaaaaccttgccggaatctcaggccgggtctcccggatcggacggtacactcggttctgcctctttgcgggacccggcccgttgttgtcttcatgctcgaacacacttgcacacccactgtgtgaagtggggtctggagcggagagaaactttttttccttccttggtgcaggacgccgctctccttgcagagcgaagaagggggggaatagggacttgtcctgggggctttgacagcttccccaagggtctccaagtaacagccaactgtcctgcgtaaagcattgcacatctttcaaagcgctgtggtccttggtgtaagcgcatagtcagaagttcaagctccgaaaacctttcctgtgggccttggtacctagctttagtgccattccttcctctccctgccgcctaaaatttccgtctccttcaattaggaacacacacgttcttcatgcaatagctgtctgtcttttcttcctcactttcctttctctctcaaccccttagataatatttctttcctgcagccagtttgctgatatccagatttccaccctttgcagggtgagaaaggggaaagggtcagagaaagaaaaaaaaaaagtcgaataattcagggaaaaaaatttcttacttcctaagacaagaatcacatgtcttagaagacactcacacccacatacagtaccaggatcatctgtccatggttactgaattttctttataatgacttggttcaacgggtccagtccaccatggacactcatttgtcccagacaagccctctctctccccctttctgggcagagaatgaaggtctggaacatgtggttgctctgtattccacaaagaagtgagttgcttttaagcctggggtgtttcctagcgtagtagtaacggcaggccggtcgccctgaatataatggtgaacttgcccttttggagtgcattacttgcttaattggattgggctgtaattggtgccatcaaattctagagacagaggcactgttgtttttccttcccgtctttgagctggaagggtaacagtgcacaaattaattaatattggttatgggatttgaacatagaagggctttttattgagtagtagcatatgtacctcttacagttatttctttagaactttctgaagagtccagctcaagcttgccaatgaaaacgaatgacatttaatggagcaaaaacaaaaaacaaaaaactatgttggtctacaaatatgaatttgaagttattgagagccttgttgaatagatttttgttgtaaacgtgtctctagaatagtatggcattgtctcagcttcctatgaatgaaggacataccttttcttttttaaaatatttgttacacaggaaagtgtgtctagaatgtgatctgtggcaataaattatgagagaccttcaagagtttctgattttggtagccgagtgggcacagtttattgagaatcatttttactgccatttgttttctcacaagaatgtgcccaaataatggtttttttctcatttggatggcagtgtgaattgtacatcatgttttcagcatctttctcaacctagtgttccccagtcaagtttgaaatctgtgttatccaaatgaattgttttcattttccttttcttagacaaagtgggactccaggtttcattttgcttttaaacattttggttttttgtttgcctgttttgggggcagttatttctttcatattaaaaagtactgtgcaggctgggtgcagtggctcattcctgtaatcccagcacttagggaagcagaggcaggaggatcgcttgagtccaggagttcaagaagtgcctgggcaacatagcgagaccccattctctatttaaaacataaatgtaacccccgttccacgcacaaagtactgtgcaaattaattaaacatgaccacccagaccagcaactgtccaagagtggcccatagaccatctgtggtaggataatttgaaatgcttgttaaaatgcagatttgtagacccagggatattctgacagagtctaaagtcttaagaacaaaactgttctaaacataagtcagtaccaatgccagttaatttctgagatatattgatataacttagtttccagttttttaaaaaccatattattgacttaaaaaccatgatattgaccagttatgtcagtaacttattttgcacatctgtgtggtgtgtgagaacatgtgcagtcacttattcattttgcctgcatttgttcatattgggatcctcagattcaatgcactggatgtttgcactgggtatttacttatactctctctatttattccgtctcatacttcgtcctatttgttcatactctcttatttgcccagcaaggtcaatgccagtttaggcctagggagtcattttttcttagttgatatgacttagaaagcttgggtgcctgcccaacatcaattacttttttaaagctggtattttctaggtcttgatatttattaagaccctagcatagtggacaatttttctttctctcatgctttttcaacacctcatagctcttcacatttagttgacagagaattcagttatcttgctgtagagtgacccatggtgaggaatctatgccatggtacttttctggttcttatcccttataggtaaagacaagtttcttatgtctgaagcttgatgtcaggatgagttcagggctttgatgaataagttcagatctcccaattgtaattcattagcattgcacttaaaaaaatttatatacgtttttaaaaaagggtaatgctaatgaattacaatagagagaaaagtacattagtttgcatgtatgtgtgaaactgggaaaatttttcacgaaaatattcatatactttttaaaaaaagggtaatgctaatgaattacagtagacagaaaagtatattaatttgcacatatgtgtaaaattgggaaaattccacacatacataaaagtatattaatatgcatgtatgtgtggaattggggaatgttttctcttcctcagtttctctcccttgcttttaatgtacagtctttatgagccattatttcagctgtggcagtttggttaccaggggaagcgcactagaaaattgataaaggaaaatgagacaaggtcatagattctctcactcccttcagggtacgtagatgaactatataaaaatccgtctaagtgggattcgttaatcagcaatttagtcaaatgtgtacatcctatgttctataagaaatgtcagtgggtcctttcccaagggagtgagatcatcagatgaaggttcatttggtttcaatgtcccgtatccttttgtaagaccttgaagttggcaatgcaggaaaacaggaactccaccctagctccatgaattgcagaactgttgtgttggtttatgaccatctgcccattcttcctgttatgacacagcttgtgaacttttactgagaatggtgaaaagtaaattcccagttttatacaatgaattgctgaagaggccttttaaagtatagagtatgcattgtttatggaaggtgtttcctattaggtctaactcagtggcaactacattcatttatttaatttgtttctaggtttgcctagtgtttctcttgatctgcccaggctcagcatacaaaaagacatacttacaattaaggctaatacaactcttcaaattacttgcaggtaaggattcattctagatctagatttcttgtgttaagtaactgattgtttattgagtggaaataatttccagtagagcagaattataatagagcttgtagtaattgttcataagtggtgaggtttctaagaactgatgtaataatggaaaatgagaagaattttctctcaaaaattctgtacaattttgctggtgtttttatactattctctgccaacatgcatacacacacacacacacacacacgcacacaaatacacacacacacccacattccaataaccagtacagccacctggcgtatagtagacatacgctcaataaatatgaatgaataaatgaagttgagggcatacatttaaggaatagagttgaaaaaatttgggactatatttattatgcttggtatgattcttgaacacttattatccctttccaaaaactttgctttataagaaatttattactataattacttaggcagtaatatttaatagcaatttaatatttagtgggtaatattactgagcgcatgatctacataaataatggacttcgggccctgccttgatattctggaatgcatctttccccacttgctagcaagaagtcatgctattgatttttgataactggagaagtagacttctttgtcaagaagaagaggcctttaaattttgcctttcaacccttaccccaggacgaaagatagaagacccttgggtttaacatagtgatcacacacgaaaggcatggagccttcttaggacctgtgtgtttttggtagagactgtgacaagtggaggtgatgttaccctcctggaagagtgctgggggtccacaaaggaccttgggtaggttattgccattgcttcatacttgttgaatactaagcattaaaccgaatgacatacatctattttagactgcagtataaagaataccctagccccttaccaatacccagcccttgggaaaaaacacagtagcaggtgctgtttctctagctttacttgtttaagacacatttcccattagattttccttttaccgaccctcgataacaaggttatttgaaatccccaaggatcccatgctccctttttaaaactctgcataaacatttcttatgttctgaaaaaaaccatggagtgtgttaaaagtaacttcattgatttagctgcaacttcctggaaattttaagttctttgaatgaagggccaataatgttacattcttcttgatgttgactatcttcttatcttccttggggccttgtagagaaatgctgcagtacaagccatctatgttttaatgcgaggtccttacaaggtcctgagggactcttacttgcacctccttccttcctaacctcacttcttactcccctttgctcactcttacctggctgctctggtttcctggctgttcccttaatactccagatatgcacctgctccagggcctttccatgtgctgtttttgctcctgtaatactgctcttcatgatgttcctatggctagctttatcaagaccacctcctgcaaaattctttactcttttctttgtatcttctatatttttctccatagtactaaacactatcttttatacaataaactttccttactttttaattgcctgttttctccagttagactgaggttccataaaggcattgatttttgtctgatttgttcactgctctttctctagtccttaacaagtttggcacatagtagatgcttaatagatatttgttgaaagaaagaatgcattaattaatggaaaactcaggaatctttataagtgacttctgaagctgagtttataacttttcatcatatgtcaatctgacttgttggtagaagactttgtttttttttttttgaggcagggttgccctcttgcccaggctgaagtgcagtggtgtgattttggctcactgcaacctccacctcccgggttcaagcaattctcatgcctcagcctcctgagtagctgggattacaggcatgcgccaccacacctggctcatttttgtatttttagtagagacagggttttaccatgttgcccagcctggtctcgaactcctggcctcaggtgatccatccgcctcggcctcccaaagtgctgggattataggcatgagccaccatgcctggccggtagaagactgactgtgtctgttgaagagtttatttaagtttcaaaaccaaattttctcttttcttagaaatagcctcacagtctggcacttcatattaatacctccctgaaattaatttttcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaaggtaagtggtgaaataaaattcatttcccacgtctctttaccagttataaaagacaataggctcaaagaagaattgagtacaacaaagggcttgctctaaaggctgtttgccaagaggaatacacacaattcttctctcctgaggctttctctgagaaataagactcattgattctggagcttgggccgtgttacctcttttttgcccagttagtttgggtctgatctttgtttccaaggtaaatctgtgttcactgttggccattgagacttataaaaagtcttcctatgtttgagaagaaaacctaaaattcttgaaatcgaggaagatttgggggtgaattatggagaaatttctgtggagagataagttatctacagcagagtaggagattttcccaagaatgcataggaaagcattttttgccaagggctctggagttttttgcacataggaacctttttttcttactagtatttcataaaaaacaattcccatactcatgtgcaaataaagacattgcttcagactcttttcaggacaatgtttctttcctttgcttgtttggtctgagatcttggatgatatgctgtatctttctaggatgtgcagtttgggattgatattatgaaggctgacttaacatccatatagtataaaataaatgtcacacatattctgcatttataatgagttatgcattcttttgtgtttcaaaaatcttacactatcttatcttttctgtgaaaacctaacttaactaatgagatccctatgatataaatttaaggaatgtaagggctgcatcatagtttggttggatgtaccaaatatttttcttttcagtgaagataaacagacattttatgtatttacgtatatgcctttttacatcccagagtatttgagacaggtgaagatgacttagacttttttcccagaagcagcttttacagggcaagaatttcatcagctttgggaaacacacttgcatatctctgcttacatttcagtagtgtaatatggtcagtgcaatgaaaaagtggagaccacatcaaaataacctatgccactggattcacaatgtttgagaaatatctttgcccagagtaagcactgtcaaagatagaattctgtgccctcctccttccctccacaagatttgaaagagacaaggctcacatcttggagaatttctggctccttttgacctggcagtcttgagagatgcagctcggtcagaagattgcaaggatttcctgctttcagcctgtctagaaatactacaagatgaacatcccccatatctcattatttacttcttcctaagtcaggaaacttggagacatgtgaaaattcatttcatgagtttcagtaaatattttattttgagaggctgggtggtggtttgggtttcttttgtttatttcctttttttgagataccgaaatagaattgatttactaaataggtttagtcttacgtcaaagggttaatttagcttccaaaggcttgctctgtaagcaagttatgtaatatttcataacatgtggatgaaaggtaggcaatattaagaagtggcaatccctagcactgtttattggtacactgcctgtctttgggtataccattaaattctgcttcctgtctaagcttaaagttctaggagttgggctgtccaagattttggccatgaagttaaacaatgggaaaggaaacactgaagtattctctatggataggtgtttaatgtcccctctggtcgccaccttacttccctagtcttctgaccccattctcttcagcaatggatggagccaggaagtgagccctggcctcataagataatggctatggcatgtggtgggctagattggctgcttttctgtgctttccagctgggaaggaaatcaaacttctgctgttgcagggaattagctgcctttgtcccctgtggtttaattaactctttcttcactttgactgactattatgaagcactctgagaatgcttgatgagatgtgttgggcatagcaatgtgaaatgttatctctctgagatttcaagcatgactccacaccacatcatctctatctctgaggaatggactaggtttccagcagcatgttaacattgtatgagtaatgtttgattggccttgaaatctttttttttttttttttttgagacggagttttgctcttgttgcccaggctaaagtgcagtggtgctatctcagctcactgcaacttctgccccccggttcaaatgattctcctgcctcagcctctgaaatagctgggactacaggtgcgtgccatcatgcctggctaattttttgtatttttcgtagagatggggttttgccacgttggtcaggctggtctcaaactcctgacctcaagtgatccacctgcctcagcctcccaaagtgctgggattacaggcgtgagccaagaacccagtcagaatctcttcagttttcttctcagtctttggagtggtgacttttcaaatgtttgtcattgaagatatcaatgactgctaaatgttaaactaaatgcaaaaacaattaaacatggttttagaaagaatcatatccctagtcttcagaatcttaaaatgctcacatgaatggtcctcttgaataaccaaattcaaaagtgttagctgtttcctgttaatctaaagatcctttgggatccattcatttattttcatggaatttacattatttacctaaagagagagcacatgagtattttaaatattagtaaaacttgtcggtaaagtgtatagatttaactttaaattttaaagtaaatattatccttcattttgaaaaaattataatgattaatcttttaaaatgtgaaatctataaaaatatattctgcttgtcaataaaccttgtgaaaggagtcaatctcaattgggagttttttttcaaaatttttatacacacagatatatacacatgcatgtgcatgcacaaacacacacacacacatacacacacaccctcatgtagcacagatatctatcagcagaataatctgtggatgcctttggttgtgtgaggtgtcccttccagtcattcacttgtctggttagagtttaggaacctgaaaaatgaccaacttttctagtaaatactattaactcattaataaaactaaattttcttctagattacagatctccatttattgcttctgttagtgaccaacatggagtcgtgtacattactgagaacaaaaacaaaactgtggtgattccatgtctcgggtccatttcaaatctcaacgtgtcactttgtgcagtaagttgcatctcctccaatcgtctcttaagtttttataattttaagctaatattaagatgggtaacctgtttataatattcacaatgagttttaaggatcctttaggaagggtcaaatgcaatgaataaaactaattagtattcttaaaaataagatgaattcttcagtgatcattgtacatggctctcatttttggtactggattaaatatttgatatgtctttttattacccagagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtaggtaagaggacatttcctttccatatcattaataacatatccttgtattaagatcttggagataacaacatagagtgaagaaggatattgaaaagtataggaactcaggatatggtgttgggcaattcatctgctcttctctaccaaataaacccatgtgcaattgaggttgtctcttttcttgccaagattaaggaagaaaaagaaaactttttaaaaaaaggatgaaagcgaatggtattactcgagcacattttatgaagaattcaatgttcagagcattgcttgctatcaattatttcaattatgactattttatggaaacttcagcaatttgctaaagctggccctactggcctagggctactgaccactgaaagtttactacttttctgtccactgggttacaacatctttgagatctgtgaaggtagtgctttgtaaacctctgttggccattttcctgggagctaccaagtattggtgaggcctgcagggaaaaacaatgtggcatgttttaaagttgcattactttaaaaaataaatctgtgcaaagttataggcttatttgctctctcatgttctgttttttcaatttacttgctctagggtataggatttatgatgtggttctgagtccgtctcatggaattgaactatctgttggagaaaagcttgtcttaaattgtacagcaagaactgaactaaatgtggggattgacttcaactgggaatacccttcttcgaaggtaacgctaatgattcaaagccagacctccaaatacttagataataagccccaatgaagtttgcttgagagataggggcctctttggccagataaaatgtaagagccttaaacacacacacatacacacccactcacacacacatacacacacacacaatttaagggaattgcagaacagatagcacccaccaaaaggtgaaataccaggaattttgtcctattctgcaatagccaggctatgaatattagttttctctaggtgattacatctttccacattatgtcatttctctgttctccaaagtttttgatctacattccttttaagggaatttctctttaagaggtggcatgagatacactgctccttaaacagtggtcacatttacttgtgtttctgcagtttatatccatctcactttcaccacgtgaggttttaaaaatcctaattcagttggttccatttatttctcctgaaacaaaatatatttgttgtctgcatgaggttaaaagttctggtgtccctgtttttagcattaaataatgtttaccaaagcccagatttaattctgtgtgttactagaagttattgggtaatgttatatgctgtgctttggaagttcagtcaactctttttttcagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatggtaagctatggtcttggaaattattctgtgccttgacaagtgagataatttaaataaatttaggtcacttagtgattcctattttgttcattcagaagatagtttctagtttttcttgttagggaggccacatgacctagaggtcaagagcatagctttgtagtcaggaacttgggttcaaacctcaactttaaagatgagatgtgctgatatacagtaagagttcatttagtattacttattatagttattgctgctattaggattgttactatgataaatagtattagctaaggtagtttttaaattttcattttattgcaaggctgagaggcctacttgaataagcatgagctttgcaaactggggaaacatttagcaatatacagttgacctgtgagcaactcagggattgggggaactcaggggagttcccctaactttccctcctctgcagtcaaaaatccatgtataggccgggcgcggtggctcacgcctgtaatcccaacactttgggagtctgaggtgggtggatcacctgagatcaggagttcgaaaccagcctggtcaacatggtggaaccccatctctactaaaaatccaaaaaattagcctggtgtggtggtgggagcttgtaatcccagctactcaggaggctgaggcaggagaattgcttgaacccaggaggtggaggttgcagtgagccaagatcgtgccattgtaccccagcctgggcaacaagagtgaaactccttctcaaaaaaaaaaaaaaaaaaatcaaggtataacttttgacttccacaaaacataactaatggcctactgttgactggaagccctactgataacataaacagtcaattaacacatattttatatgttatatgtattatatactgtattcttccaataaagctagagaaaagaaaatgttattaagaaaattgtaaggaagagaaaatatatttactattcattaagtgtaagtggatcatcataaaggtcttcatccttgtcttcacgttgagtaggctgaggaaaagggggaagaggagggggtggttttgctgtctcaggggtggcagaggtggaagaaaatctgcttataagtggactcatgtagttcaagtttgtgttatttaagggtcaactgtaattgaactggaattaaattgaactggccttgagaaaatcaccttaattttttgtttattctctttcatttacataaatgtctgagtttacatggtaatttgtgtggcatcctacttataagccttggaaaggattttggagtttatattatgagaatgcatcaatacagtgaaattttaaaaataccttagataatgctatttattagagttgtaatcataaaagtggcaacaactataacaagtatgatttagtgagcacttactttattagctcatctcatctttgaagctgagattggaactcaagttcctgactacaaagctatgctcttgacctctaggtcacgtggcatccctagcaagaacttgaaaatttcttctgaatgaacaaaatagaaatcactaagtgtcctaaatttatttaaattatttcacttgccaagatgcacttgtcaaaatacacagagagagatgtgctctggcttatgtttttatagaattacttttgttctccagaatacttcagggaaataggggcagaaataaggaggtcagttgggaggctaattgcagttatccaagtgagagttgaggggtggcttagacaagggtagttgaggtggaggtagtgagaggtgatctgcttctggatatattttgaaggtagagtcaacagggtccgctgatcaattcattggttgtggagtataagagaaaaagagtggaagatgactcgagcgttagcatgagcaactgagtaaatgatggtgttatttactgagatggcaaagatcgagaaggcagtgagatttagggaaacagtgttagatatgtttatctggagatgcctgttaaacatccaagtggagatatttaacatatcaacccggaacccagaggagtcagggcagaagataacacatttaggaggtacgtgaatgatactttaaacctgaggctagaggaaggtgtaaataaagaggaggtctgaggactgagtcctggggcctcatggtggaagaggtgtgtggaggctgtcatgggagcagaggagaaggagcacccaagcatccctgggggacttagagaaagctgcacagaggagcaagtgtttgagttgagacttgagcaatcactaggcttgtgggagtgcactagcggggagagaaaagcaaatgcaaacacaggaggtgtgggagaaacacgggaggtgtgggagaagctgaaaagtgacccactgaaagatagtacaggaaatcttggaactgcagctactcagaccctcaaggtctttgacgtttcacttgaaatgaaaaactaaatcaaatgaccatttacagtaagttgaccttttttttttttttattttcttccagaaaaaccttttgttgcttttggaagtggcatggaatctctggtggaagccacggtgggggagcgtgtcagaatccctgcgaagtaccttggttacccacccccagaaataaaatggtaactactggaaataaatgcaaagcatcatttcgtgtgagagcaaatcctttgactatactaattcctgagaattttttttcataggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatggtgagtccattcaattttcctctctgcccaagatttattatgatacattgtcttccaaatcagccaaaccaccgttcctctgcctcctgctgcttcactcatatcatggctgggcctgtgtacaaaagtcatctggcgtggtgaagctgaagtgaaacgtaggaccatgtgctctggccatgtttgtttaagaggccgtgtaaatgagctttgtggtggacaaatgcaagattaaagtagtgataccctcgatagctaaatgttgtgaaataagaatgcccacagggacagttgtcaagctaagttatactaccatgttcccctctcatggaattgcccacctggtacacagatgtgtaagacccttctccttagattttgtgcaaagcttctagtttgatattgtagttgatgtatcagagatgtgcaggcacgttccaactctgaaggcttttgaagttgacactgttggcttggttgggagcttttcttttttcctttttgacaggagttcaggatctgattttgagtctgtaaaggaaagatagtaagtttttgatgtaaagataatttgaactttgttttctgaaactgaaaggtacaaataagtgtttggaatggagtggggagaagggtgccatggtcaagtgagtgtgagaggtgctaaggtgatgtgtagatgtgtaacaggtttctttattgcaggacttcgcagaaccttttatatgctaatgtatattggtattctccaggaggagagacatagagtattcaaggtttaacaaacctatttgaccagagcaccttttttcccctgagcaaattcattaatctctcactccaaacagttcgagaaatgcttctctgttgtaattctttgttcccccttctggtacggcatattaaaacttcaggatattttcccatgacattaaggtgcttccctacgtgtcctgatactcttctgtaggccgctgaacttggctttattattttttttcagggaatattttaaagataggctgggtgccgtggtttgcatctgtaatcccagcactttgggaggccgaggcggatggatcacctgaggtcaggagttcgagaccagcctggccaacatgatgaaaacccgtctctactaaaaatataaaaattagccaggcatggtggtgggcacctgtaatcccagctacttgggaggctgaggcaggagaatcacttgaacccaggaggtggaggttgcagatagccgagatcgcaccattgtactccagcctggtgacaagagcaaaactccgtctcaaaaaaaaaagttaacaggttccaaaaaggttgtttagaagcagcataggtgtaggggactggggagaggagaaactggaaagtgtataagtaggatgggaggaggaaatgaacaggaaataaaaacaaaacacggacagcaaatagcccatttcatcagttcatgaagccactaaatattttattcactttagcaaattctctgctatatgaaataaacataaaaaagaagtcaagtcttcaaagcataatctgaggctttaggttgacagtaataaggaaatagttttgactttggagtcaaaaaagaaagaaaggaaaaagggagagaagaaagaaggaagtgagagaagggagaaggaagaaaggggaagagggaaagggagtggagagggagggaggaagagggagagagaatgaaaaactcagatgatggtggcaggaatgcattctctaaagatttacaccttcctttaacatgaggtggtttacgtgtttgggttcagaagtcagagtgtctaggtttgttccaggttttgccgttcgttaactgagtgaccttgggcgagtcatttttttctgtttcatttttttctcacgtataaagctgtggacagtaatagtggttgtgaggattaagtgaatgaattcatgcaaagcacttcaaacaatgcttggcacataataaatgtatttactgtgctatttcagctgttttctgtagcctttccctgatctcctaaacttgagaggacagagagaactatctctgtaatacagatgagaggcacaggatttcaacacttccataaagtcattcagcttgttagtttattattattattagcttattgtcatttttattttatttcgttactttattccttttttttttttttggtagagatggggtctcaccatgtggcccaggctggtcttgatctcctgggcttaagcgatccacctaccttggcgtcccaaaatactgagattacaggcataagcccccatgcctggctagttgttatttttatgagtatcactagaactcaggtctcttgtttccacatctaggtgttcttcgaaaaagaaagtggaagcaaaatcatatgcttaaagaaagtcagctttagttgctaaaatcctctatttcccattcttcaaagctgactgacaattcaaaagttgtttttcccatcttcagtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccaggtgagtaaggccacatgctctttgctttcctgccatcttgcatttcttacagctgagctatgatatgactccatcctaaatggagaagcctaaaccaaaaaaagttttctctcaagaggtagcctgaatctccatccatctttctctgtgtcttacattttaggggatgtctttgcttggagtatcctcctttggggttagctaagctcagccttgttaggttagccgtgaggtacacttctccaaacacaggctatttgctcagtttgctaattgccagtctttggtttttctcccgataccaatcggctggtgaataccacatccctccttcttgtgtgtgtgaagatccatctctcagaggaaatgctgatagatgagaggcagtgatagacccagccccagtcctcagggtctcaggcccagcttatcatgctctgacacaagtccagacatccttagggaaaaacacaacaacagcagccaacccaccaccaccctaagcagtccacttcctgttgttgtttttgaaatggccactatgagcttcttcctcagctgctgatcatttccttcacagagaccatggtcccagagaaattactttaaggagcccagtggcttctaagtttccttgccttcctttgaactaaattaacttgaattgtcttgtcgatccaatttatgaatgaaggtttattcccagaatagctgcttccctcctgtatcctgaatgaatctacctagaaccttttccttcattgtcaatgcctatttttaattggcgccaagtcttgtaccatggtaggctgcgttggaagttatttctaagaacagaataaccaaagtctgaatcttttccttactcttgactctaattaaagaaaaattaaatcataatatgcgctgttatctctttcttatagccaagctgtctcagtgacaaacccatacccttgtgaagaatggagaagtgtggaggacttccagggaggaaataaaattgaagttaataaaaatcaatttgctctaattgaaggaaaaaacaaagtgagtttgaagttttaaaatttgaaaatctctctctctttaatggaaggatggtacaataatatgtgaggcatattggagattaataatcaaatagtctggatgattaaatagagcgtattaagtcactttgaaaataccattgacttttagcagtaccattaacttattaatagcttatcagagaaaaataaaaacatctatgacattaaatctatgcatctgtgtagggtgattctgattttataaacatgagaatgaaaaaatgtgtatcatatcatattaaaacacatcattagtttcatggcttccaaagccctttttatataatgtgtgagctccacagcagcataattatacaaattgagtaaatatcccaaacctaaaaaccccaaatccaaaatgctccagattctgaacctttttgagtgccgacatggtgctcaaaggaaacgctcgttggagcattttggattttcagattagggatgctcaactggtaagtatacaatgcaaatattccaaaatccaaaaaaaaaaatccaaaatccaaaccacttttggtcccaagcgttttgagtaagggatactcaacctgcaattgcataaatttgagcgtgtccaaccgctgcagaagtgggaatggcataggcaggttggagtgattgtggagactgctggactgagtgcttgtgcacaaacagccgcgttgtttatggcctgggatttgttttttccccgcacagactgtaagtacccttgttatccaagcggcaaatgtgtcagctttgtacaaatgtgaagcggtcaacaaagtcgggagaggagagagggtgatctccttccacgtgaccagtaagtactcttctctggaggtttgggttggatcactcacacagtgggtactaagctatgtaattccctgttgtttttgccattcatgtgagtggcatggcatttaggaaagaggacttggattgatcattgatgctttcattcataaattacaacttctcaggtatctcctgggcttatgtgaagtcagtgcgtctaactacactggagagagaatggtttcacagatgctttaaaccacaagctctgtgtggtatttacatctcagtcttcagagtctggcacagtgcctggcttattgagcttcagtacatattggtgggcttgctgtggaacagttgatgagggtgggctttatggaggcaatcagaaggacataggagcagtgccctcccaatgctgccgattttgcctgtgcatcttagttttatggataagctttagctgattgtgctgaatggaatattatagccagggctaattcattggcataaatgtagctttcatatcattgagtgttagtgttaatgaagacctaattttaaaattctgttagaattagagattttgctttggatttttaatatattaaacattgcgtagagctcatagtggagatgtggtaaatatctgaggaattcgtttacattttcaagtaatgtgtttggccaaataagatattttgggacctgaattgtctagtttgtttgtcaagttgtagtacatcacctggaacggatagagcttcatttcttttggtactttgtagtagtctgaaagcagcaagatgatagtgagctgtaccaagttaaatcaccattcaataactatggcctcttcattttagggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctaggtagggagacaattctggatcattgtgcagaggcagttggaatgccttaaatgtagtgcaattcaggtgctatgcaaagattactgtcctctaggagattatgttgtaaactggtgcacacttcttcaccgaaagtccttgaggaagaaagaagctaataataatgaaatgatatatcgaaaggagaaaataacaaaacctgatgatggagtaattcactagtatatgcaagggatattagcttgaaccagggaaacttctgccttatcttgggcatccatttatttaaatagacaaatatttgtggaatgcctgctatgagctaggagagtgtcagaaattcacagtggtaaacatgaaggaaaggaggagaacataggcaaccactgggaagtcacagcacagtgaggtctctgtgtccatgagaacaggaattgttctctgttttgctccctgctatagctctagtcatagagcatagcagcatatactaactgctcaataaggcacctgctgcatgaagagtgggatgatgggctgcgtttaagacctagaagactccatgggaaggaagctacattcactgtctgtacctctgggtcatcccacatgatccagcgtagcccaaggtcaatgggacgatcacttcagtgagcagatagctctgtaaattcctccatagaggcactgtctaccccttgtctaaccgcatgccttgtgcaaaagctgggcagccatggctttgtctgtgggaaaatcaggcaaatttggggagcgtctctttgtgccacttctctccattttctcctcttgtggtgtccctttccaattcctaggatatatgtgccctctgttttttttttactgttaggaaggaaattgcccaagtaaattcatctataccacagttttagagggtaacgtcttcatcagaggccttggcgtatttgaagaggcaccttctgacagacactagcataaagttcgctagttttaagactcaggtgtcataataagagatactttggggtcaagtcatccccagcatccttcaagtcacaccacatagatcacatggattttctgttggcttgtctggcttcaaggttatggcagaattgagaaagagatgtgaagtaggctcctggcctagctgtgcccagaaaatatgtgctcgcagttagctgctttgcttccctaaggactcctaacttgttttcctaaaacctattcttagaaataggctagaatccagtacatttgcttagacttcaatgtagtacgctgttgaggtaatctcattttgctaagtgttgacgtggattttttcagcatgattccttttgatgttcagttggttgggacaagatatttccacagcactttgatgatctgaagaaagaataaatctaaagtgttcttgtacacttaaacaaatactcatgggcttcattttctttaaatccaagacttcccttagggtattgttgttttgtttgtgttttagtggaaatagcactgaactggtcttttagcctcaccagattctgtaaacagttcaactgtttacttagttgcagggacatggacaagtggtttaatgtcgctgaacatcatttatttcatctgtgagataacgctaacagtcctattctgctcattacataagatcactagtgaggaacacaaattgtgtaaacaagttttataagaattgccaaataaatgtaaggcattattggttgaatgatactaaaatttggcacttccaagagaaatttgaagggattctagggtattattgactagaatcttcatgggagggaagttttcacctggggaggctgtgtctaattagaggaaaaatccataaaggtgaccctgaacctttcttttgtgatgggattaccagctagtatcactaatatgaatgttaaaagccattaatctgtttgcagtgtcctgactgacttgtttcatttaactttacccagtgaccagtgtattttcccagaagttaatatatcaacaagttcctttttactaaatttaaactgtttaaaactttgctgataccagaaccatttcaaaagttataattccatgttctgtgattttctttttgtgtgtctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggtaaatagaatttggctatcactcttgggttgcagaactttcccagggatgttatctaaaaagccatattatttcttgatgtaatgtagaaaaaaagcagtattggtgtccatgacctggctcatttcacagacttagaattggagtatggggccctgttgaattttcatgaaagccatataggagattagtcagcagtagatcccatgtgactctacagagttagataatagaacaagatgaagggcagcatttatattttctaaatttccctgaaaaacttcacagactacatcatcataaatgagaatgatcgttttcttcctctgttaggcattgtattgaaggatgggaaccggaacctcactatccgcagagtgaggaaggaggacgaaggcctctacacctgccaggcatgcagtgttcttggctgtgcaaaagtggaggcatttttcataatagaaggtcagtgggataaaaaaaaatgtggtacatatacaccatggaatgctatgcagccgtaaaaaggaatctgatcatgtcctttgcagctgcatggatggagctggaagccattatcctcagcaaactaacacaggaacagaaaaccaaacgccacacattctcacttataagtgggagctgaacaatgtgaacacatagacacagggaagggaacaacacacactggggcctactgtgggttggggagaaggagagcatcaggaaaaatagctaatgcatgctgggcttaatacctaggagatggattaataggtgcagcaaatcaccatggcacatgtttacctgtgtaacaaacctgagcattctgcacatgtatcccggaacttaaaagaaaaaaagaaggtcagtgggaagtcatagatacatcctgtggtttttgaagattagtttgtatcttatagacacacattcactttgaatagggcaacgacagatgatttttaatattctttgtactttgtaaattttctcagtgagtatgtattcttttaaccagcaaacataattaatgttgttataattctgcttgcatcacatttcctattcctgcagttcttattgtggaaaaattcttaatcaggcaggatgaatagcctcttctccctgattctgtctttgtttgaatggcttgattaacttatagaaatgatgcctttatatttatttggaaaaacattagaattgctgcctaatcatggcagtcaatgctatccagatagtcacaaggattccgagttttaattggactagagataattaagattcacttgtgaacaatagaccattgctcttctgacatggaaaatttttggtttttatctcaattcgtgtgtatgcagaagtgatgtgaaatctgtcattttcttagctaggaaaagtaatttgtggcagaatattttatcttaagaagtatattcctatggcttttttttttatagcccaccagggaaagaataaaactgtgttgtggggtaaaagaatggtatgcaagggtaagaaagaagtatggtgatagaagggatcgatggatttctatgaactcatcctaacttgtctctcaaagtctagattttggtccctttactctgccaaatctatgatgccaagtattgcatcgagatatgttgacatattttcaaatgtataagcttattagcatttcataaactacacttgcaaataaagatttcaaagaccatggcagttttgtcatttccaaagtgattcatgttttagggcaaatccgcagaatgacgtctagattgtctctgatgctctgcattacctcttgttggtggcctgcagctggttacagatgcctaactaggtaacactggcacagagattatagttacttcttacctggagtgaatgctaagaaaggcagagctagatatttaatactcctgctgggttcccaaatgttatgcgagaatattaatatacaaacacatagaaaacagactctttgaactttttatcctctatgttcaactggacttttaaatctgtgtgtataaatagagaattacttccctaggaccaccagagaaacaaaatttactccaagcataattgtgcttgtctctcaatggttaagttaacttttattttgcaaaccaatttgttacttattttgcaaaccagtttcttacttgtcttcttctctcttgaggccgtagtgggccatccgcacagcttgtggcccggtttgattctccttgcactcttctgatgggaggccccaagtgatgactgcttccttatcatctctttgctaatcactcttagtggaaagcctgtttctgtattttgtttcttccactcagagctgtcctctgaagccctgagcatctgcagctttgcttgctgacttctagtttcctcttctctttcctttcatgagtgatttgaaactcccattaccaggccatgcgtgatgtgctcatcttggctcttcctcttctcctcactcagactcctgccacaagggatggggtagtgtatgtaatggttagttcatgttggacaggcctctttatctcttgactgaaccactgactagctgtgtgccctcagtcaagtagcttaagctctctggtcttctgtttcttcatctgaaaactgagagttgttgaggagattaagtggaatggcatatttaaagtgatgagtgcatagtagatacatggtcattagtaactctcaggtcaaaaaattttgtttatttccctacttggtttcttatgtgatccttttgcaaactctgcacagatcaaaatattgactatcagtttaaaagaagacttttgttttcctcaaatagaaatatttttttttctctgtagagaatgatctgttttctttccatcaaagactgctcttcctctaaacactttctatgtttggcttttaagacattactacttctatgcttaattacttaagaattttattgttgtaagtttacatgagcaatgttttgcaagctttaaattttccattaacaattctgtaggccaggtgtggtggcttatgcctgtaatccctgcactttgggaggccaaggcaggggggatggctagaggccaggagttcgagactagcctgggcaatgtagtgagaccctgtctctacagaaaataaaagaaaaattagctgggcttggtggtatgcacctgtagtcccagctactcgggaggctgaggggggagaatcgcttgagcctaggaattggaggctgcaataagctatgattgtgtcatggtactccagcctggaacatagaaagaaaccctgtctctaaaaataaataaataaataaataaataaataaataaataaataaataaattaaattcaaaaaaagaattctgtagactccattcaagttacgggtgtgtaactgttgtcctctaggatttttccaagttggtaagcttgggattttgctttagtgctaaaatttgtcatcttacaaacaaaaagtataagtttccaactgttgatactcattcaattgtgtctttccaggtgcccaggaaaagacgaacttggaaatcattattctagtaggcacggcggtgattgccatgttcttctggctacttcttgtcatcatcctacggaccgttaagcgggtaaaaaaataatttcccttctgcccatgcacattggttttcatgattaatgaaaactgactggggttctttgagttgtttcttcccattgttattggctcaatgggcacatttttatttcaatacaataacgttcctgcccactttcttttggctggatctcagggatttaattgatagaagccactagagaggaaaagggcttggactgtctagtgtaattaagctttaaaaccttaattctgagctcctttgggggacaagggaaactagaagcagggttataataggaccactctcaaactccatgagttttattggaaaatgagacaggaatgaggctccaataaacagcaataacaagcacacaaaacaacagccaaacaacagtgtgtttatgactggaaggattgatgctttccaggccaatggaggggaactgaagacaggctacttgtccatcgtcatggatccagatgaactcccattggatgaacattgtgaacgactgccttatgatgccagcaaatgggaattccccagagaccggctgaagctaggtgcattttcaattgctattaatttgatattgtgtttaccaggccatctcttcctccattagaatgatgacaaatgtggtgtattcagatgttggattctggtttagaaatattaattccatttcttgaatttgtataatcattcatatagccacttagaggtagggtccctatgtaatcatccaaagcaggacatttggagagtgaagggggagttattaaataattaagccaggacaaaggagtaaactggactatccatgttaaattgggatgtatggtcaccctatctagttgatgtctctgcgtatcactttggttgtatagtaatccaagtctgttttcttgttgctgttgttgttgactctaggtaagcctcttggccgtggtgcctttggccaagtgattgaagcagatgcctttggaattgacaagacagcaacttgcaggacagtagcagtcaaaatgttgaaaggtaaaagcaaaattatgtggtgatctatctttctgttttatctagtctttaaatatgttgcaaggcttgtatcagtagctttgtgcttatgtgggcctactagccacacatgcagtcagcctaaataatgcccttgtgcaaattggaaaaaggatcctcctttgtagctttatgccaggatgcatggtctggcaagcaaagttgggaatggctttcaccttcttgcctggttaccctcgtgcagggctcagccaacacagttgtacttagtggttctgggtacagggaaaaaggactgtggttatattaaaattgtttcttaatatattgtggaatcagataattatagaccatctagagacatggaaaggaagatagtgaaatacaaaaatagcatgttctccagaattggaatatgtaaaagatgttcatatgtaaaagataatttgcaaaacaagaatggttgtgttagaaaaaaatataatgggttatattttttaaattaaaagctttataaataattgttaattctaatagtaacggaattctggtctggccattttcattttaggaggttagacagtaaagcttctttcttcaattgtgatgttctttcattgatgaaggcagtgccaatgaccctttgccaataggttttgtgcatttcaaagctatctttctccatctgccttttttctcttgtggccaagggagtgtgtaattttgaggtggctcatcagagccttagatgtggaccatgcctgtgaattagtgggaagtgtagcagtccatacaggatcaaacacatagtcttagtgccatcagcctcatgtgccaactggtctttccagctggccttaattcgcctgcacagatcggcacagattggctggaacattcggtatagcccctaacacgtgaagatatttaatacatggtgttgcttccttatgaggaagtgctgaaatgatcagaccctcagaatcatagtgaacctgaaatgcaaaaatccagttttgcagaagaagagaatctgggcatgattccactgcagatgtattctccgctttgcaaaaggtttcacaatgggttcctttaaatatcaaactttctggctcacttaaaatatgaattttatttcaaattagaaaatagaatttacacttcacttttgaggaaatgcatgtggtctgtaaactaggtcacagctgtgttaccccggagggtaagttgtatagtggcatgcagggagggagggaccccaattattgaaggaaatgtccatacctatgatttccctctttgtactgtatttgtagaaggagcaacacacagtgagcatcgagctctcatgtctgaactcaagatcctcattcatattggtcaccatctcaatgtggtcaaccttctaggtgcctgtaccaagccaggaggtgagtaactgtgggtggttttggtcacccaattttaacatgcctctctgatagtgtttgagggaaagcagtcaactcctctggccttgattttcttagcttagaatactttgcggattcctaggaataaatatatttcatggaggtttaattggcactagaattaaattattgtaaaactttctctgaattaagaaatgtcatgctactatgatacagtttgttacttgtgtaacagatgtccagagaagagtaaacttccctaaaacttgaaagcttaagggtagttacccccaaaatggaatcatatcaggagattgcactgaaaagcaagtagatgggtgggttttcttctgaaattttggttaatcttgtgaaaatgtgttctggaaaaaagaaaagctacaatataaggggattgggaccagctgatttctacactcctgtcccaatgaaaggttgtagccttcttctaaggtgtttttgggttcatcactatattaaacgcttagtgaggaatatgagtgaaaacccattttccttcctggacatgctgcctgcagggccactcatggtgattgtggaattctgcaaatttggaaacctgtccacttacctgaggagcaagagaaatgaatttgtcccctacaaggtatgtcatctcctaatcctgctctggccatgttataaaatgaagggaaactcaaaatggtacaggttagttttttagttgaaattttgtgaagaacttgtgaggaatcttctcatattacctcttggctgttgtaacttcctcttttaccttctgggggccatatgtttctgttttatgtatgtgattttaatctactgacccattacagagtgtggacatgggggagaaggcaggtatgagcgaggaaaggggagggcagagggtaggacatctctgggttattctgtctctcccctagccatatttggccccgtggagtgtaaatccctctgtgaagagcatcctaatgctgaaagtgtgtctgaatgcaactcaaaatgtggcatttgtcactttaagctaaagaaggagctaggctttgtggaagaaaccctattatgcacaaaacttgccccaagtttcagctcagagattgcataatcctgaaattgatgtcctccttgtctgctttttagtagtttcaattatctccatggtttactacattttaaaggttgtaaacttttaaagactcattttgtattcaaggagtttgtttgttcctttgcttttttatagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaaggtactggctagtgcttcctgcatgctatggcatgctcttgtcagagcagacagggtgatagggtgttacaaggaatttgatcatgggaaaagtccaatactacctcataatttgaaagagacctgaatttctataatagactgcctccattctgtctccccaaaagtgaagtgtggaagccctagactgggaagtgaagcagggctagcctgagaaatctgggtagtccaagtgggctaagcagtcggctacaaccacagcagtgttcttaaaatactggttcagcatttattagtgagagaggccacaagttttctggtagttgactagcctctccattgccttggagagccccagagtggtttgccccacgttgcatgctttacctgtgcaaaagtcttttcattatacctaaccttctcaaaggcagtttaggagccatctgttgtttctaccctaccccaagcggcttatcaagtcttccttccaaccatacttcctcaggcgagtcttgataaatatcctggcctttattaagttatgtttccagtgatattttatttatttgtttttatgtttatttttatttttttgaggtggagtctcatgctgttgcccaggctggagtgcaatggtgcgatctcggctcactgaaaccttcgccttttgggttcaagtgattcttgtgcctcagccttccgagtagctgggattacaggtgccttccaccatgcccagctaattttttttttttttgtatttttagtaaagatggggtttcaccatgttggccaggctggtctcgaactcctgatctcaggtgatccgcctgcctcagcctcccaaagtgctgggattataggcgtaagcctccgtgcctggcctgagtgatattttagtgctctttttgggtggagctgtggtcccagcctaacttccaggacttcagccggctccaggacacactgtatttctgcctccttcagaaggagcagagatagcgttgtggatgtagagatgggtgacaggctggctccccttgaggcataagtctagaagaatagtggaagaaacccactctgtttcccttgacatgaggctacagagagaatttgcatttaactccttttccttagaagctgagaaggtagtgtgaggctgggacttggtctagaagcacatggggaggtggtctaggcttcatttagctgggcccacactgagtggtgctgcctctaccctgctctttgtctttcaaaaaacagtggccagtgagccagaaacctaagagattgagttgttgagaaaaaggctcacagccttttaaatacttacgaatttattactacaactaagtttttgtttactctggtatttgtctccaggaaagaagccataagtcttatctgaccaaagagatgattttgaaacacccatttaatatcttagtgtttatttgtaccagttgcactgaagtaaataccaccaatttacgtaaatttatctttccatgtttctgttatctctcaggaaaaaacaccctcccaggccagatttaatgtatttacagcactttttaagtttgaaaatgaattaaatatatttctagtatttttagttatctattgcagattatagtttgacttttggcctttgtcccaggacaaaacctggagagaagagattcaatgaccctgaatattgttgttttatttttagagttcttgatatgaaactattgtttatccctctgggtacatgacaaaaaacagtgtaagtggcaaatttggaaatgtcctctttatttcccagattatctaggtcagtgttaccttattctacctcctggatttactggttcaatttggctaaaatggaaaaaccagtattgttcctaagggggtatgatgaaggctaatgatactgggattcaggagatttacagaagatagaagcattgactctctgcttctatttcctaaaaacttaactcccaagtcttaaaaagattattactctagcaaacttagaaacatcacactaactcatggaaatactgatctccatcctcctgcctctttggacagctcctgaagatctgtataaggacttcctgaccttggagcatctcatctgttacagcttccaagtggctaagggcatggagttcttggcatcgcgaaaggtaagaaaggttgaggggaaatcagctatcttttcagatcacaggtttggaaataagatgtccagtgtcagccattggtgcttgtttgggattgtaattcattcaccacttctacgtcttttagaagagctctactggggaggctctgtttctgctgagtaagagtggttaaggagttcatgaaattaagctgtataataaaggcttgtcaagcatctactaagtgtgaggcagtcttctgagcactgaggatactgtggtgaacaatcaggcaaagctcttcaccttcatggagtttacagttctagtgggtagagcaaacaataagcaatataaacaagtaaaacgtgttgtaggttagatgagagtaaatgctatggggaaataaagcaagaaagggttatagaatacacaggagcaatgcacttgtgtatgtttatgcttctctgtgtgtgtacatctactttaaacaaggtagacgaggaaggctttactaagaacttgacatttgagcaatgacctggaaaggggaggggctgagccttacagatatcttggcatgagaatcatttttaatttattttacattcatcaacatccatcaaaaagtatttgttaggagtataattagaaacgaggaaggacaggcttcagatgagagcgattaaaagagctaaaattagaaaagtaggccaaacaaaggctgagatggggacgtgacaagttacaactattccaaaggttgtaaacaccaagcggggagcaaggctggtggcagtgattcccctggaaaggataaaaggtgtaattttatattaggtaacaatacttcaaattaaggatcaggaagaactatcagttgacagaatgtattcatgcagcttaatgaagaaagaaagacttaagtcatatttttttttgtttttcctaaattagaatgaaatcttcaacccatgttttccccttctcatagcattaaaggcctcaggctctttgatgtttctgctaggtagctcttatgttctctctcccaaggggaaggaggagaactgggaccttatagggttttcccaaagagaaaggccctttacacttcttggagattatgacttattattaccatttttttatggccggaattcgccacttagtcagggttccttttggggactaggaagagaatggaaatgaatgtgggaatgctttaactttccttacatctaccagactatttcttgaatccacttggttgtcgggttaaaaaaggaaactttttgtttggggggaaaagtcaaaaacactgtctgttttttggaattgccagtgttgctcaattgtgctagataatgtgcttctgaatatgccttgttcagaggagagtgccatacagatttgaggtgtgggaaggtcagcaatgcctggcttacatgatcacttctccaatgatttaagaattctccttttggctgggtgtgttggctcatgcctgtaattccagcactttgggaggccaaggtgtgtggatcacctgaggtcaggagtttgagaccagcctggccaccatggtgaaaccccgtctctactaaaaatataataattagctgggcgtggtggcacacctgtggtcccaactacttgggaggcagaggcaggagaatcacttgaacctgggaggtgaaggttgcagtgaactgagattgcaccactgcactccagcctgggcgagagtgagattccttctcaaaaaaaaaaaaaaaaaaaaaaagttttcttctaagccattgattcatttcttgtgctccccaagactcattttcttacaaaatatcatgtggagctaaagctgccgagtagtaggaagttagctgaagtttggaggatacagagaaaggagaaactgagaagctaaaaggaagagaaagaagtcaagatgaatctcattgtattattaatgcactagaaaatcaacctgacttgtgataggctgaaattgccttaatagacctttataataacccagcactttgaaatcaggggaagccacattgggaattgtttatcagagccagtctggcttcagcttcatacggaagggggaaaccaacaaagagcactaaaccaatgagagccccttgtttctgatttccgtgcattcattcaaaaaacaaatcccgttctcggacctccttagaataacacgttttaaaccaaatatggggccaggtaaaaggaatgtgtggatgtgaccagaaacacactcttttgtgtcctagaggagcctatttatgattccatcatcatattataacttaattatttaactccaaaggctggggctgtttatggaataagcagatgtgtgtctcagcaaagctcacagacttttttcctgaagtgttgataaaagatactaacccagtccttgttaatcagttggctttctgatgtgggatttttttttgatgcatgaggtcacaacagatgtgaaagagatcagctgtgccgagacctaatgcacacatgattctctttgcagtgtatccacagggacctggcggcacgaaatatcctcttatcggagaagaacgtggttaaaatctgtgactttggcttggcccgggatatttataaagatccagattatgtcagaaaaggagatgtaagtttcaaatatgaacccagtgcttggttaagtaacagaattaaaactcctcgtagagagcttcaggacctgtgttcaggaacagaggaagtttttttcttcagatatttgctaatttgggttctgaatccttgtcttctacccctgtaggctcgcctccctttgaaatggatggccccagaaacaatttttgacagagtgtacacaatccagagtgacgtctggtcttttggtgttttgctgtgggaaatattttccttaggtaagtcatttctttttgtccttccatccagactccaaagaggaagacaaaagttgtcttttcctctcctgtacttcatgtctatcaggcaaaacttctcggaagctttgaaaaaaaaaaatagatacataggtgatgaggatgtgcaagattcaggctcagggttttctataagagaaaatcaaatcaaagaatgtctcctccctgttttattctaggtgcttctccatatcctggggtaaagattgatgaagaattttgtaggcgattgaaagaaggaactagaatgagggcccctgattatactacaccagaaatgtaagactttaagaagtattcctgtgttctctttctttgctcgcaaattctccttgcctggaagactttccattatatagaccttcttcattgcccagttagtgtcctgcttttactttggggcctttcttgataatttcaagcatggagtcatcacttcttgaaaagatagtactttattattcaaagcaaccagttagtttttattagatgttgctttaaatgttttctatacacattgagcctctggagtatgggactctgtgtcttacacagttttgtatccttatttagcatctcacctcgtcggctctttacaaatgtgtactcatttaagtgcttattttcagcattcaggaagaaagaggcatttaatgaaatcagtgttttgcttctctaggtaccagaccatgctggactgctggcacggggagcccagtcagagacccacgttttcagagttggtggaacatttgggaaatctcttgcaagctaatgctcagcaggtttgtcacctccatccaagaagcacctacaaagagtacttagatgtcaaggactttcctactgcctgaactgtctcatggctaccatgccatcctctcagccattgaataatctactgtattcttctacatctgagtaataatgcttttctaaaagctgtaattacccttttagacagataggattctaatttataacccgggagcagaccactctgatttctacctacttatctttttgttatattttcaaatcctcttctaaagttaaaacaaagaaaaaatctggttgatccacagaagatcaacaatggaagaaatttcaagaaatttttaataaattctgcaggcaaaaatacatctaagctatgcaaaagagatggtttctgtcttggtatcatcccaggttcttataacttccactggaagattttagagttgtagtgtttactattagaatgttatttaatctctagtcaatgcctcttactacaatggaagtgaatttcctctttcttttcttttgaacagctgggggacgataggtcagctctatttttatcaataaaccttccaaacatttacagatatcaaatagccctttatttctttttcttgatgcaataatattaagttgtgcaaccttttctcaaaagacccattttcctacccatttgttgcttttctttagactgtcatcagtttttccattgccttgaaatgtggtggctaaaactggatgccatgccctttgaagggcttggctcgtgtggttagggctttgtgaatgagtgattttttgttctatgtagctccttgtgttctgttgttacctctctgaccacagcctgctttctcttcattgtaactgcacttccctgtgggctgcttacccatcttgtttttagttctctcctttaatataccttccatttcaacagctttttgtttctgacacatgatttgtattgttgtcttaaagttctatgttcagatatgaaagccacacaccctatgtagccaagaagtccctgtgccctttgtttttaatgaaaaggcacttgaagaactgaagccataacaacagtcttctgtgtttattgtttcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcaggtactgtatatggcctaacatcccccgggggagggtgacttcaaggccatctcgggagggggattggaagtggaaggaagaccttgtctaaggctgttgcatcccacttccacataaccttagccctgaggttaacataatggggaatgctcctggaagagggcctgggtaggtgtgcttcctcccatctgtagcccacgctgctgccacagcattgcctttaagaattccaagccctgcagctgcaatagctggaatgccacagtttgctaatttccagaataaagagacgagttttacaaagacatctgcatttaaattatccccgtgtatgcttttattaatgtgaattaaatggcttaggagagattcagaaaggaagagttctgtgcttgcatgagaacatgcttatggctctctggcaaggatacagaaagccatgggtctgtgtccggaattagactggacactgcatctcagaagcccctcccacgtctgattttcagcattttatttgcataatgggatgtctgggcttatttaaaacacatgcactgcagtcctttcctgatttgcagaggggttctaaaggcagctttcttttttctctctcccagcacctgtgcataaggaaagagttggtgtggttttctacaatatgatattaaaattgccctttactaaggctgggactacttcattttgctttgtttctttcctaacccgtttgggtgttttcctgctttaatggaacccctgacagcatgggtccagcctgccagcccgagtgtgcctgggctgcagggaggggcagggagctctctcatgtccagaacttggccaggttgccacatggcaggggatgctaaggagaaactcgtggacagtttgccctctagagtcgtgtggggcagcagaaacactgatgggaaggaagaaagcttagaagccagcaagacagctgaccgttccattgaagtcaaaagcattaggcatgtttttaaagaactttgccgtatattatcagatgttgcccacatcatgacactcagagtcaggcaaggtagaaacaatgatctttttttttgatgtattattgaacatgaggctcagttctattacctgagggcagtacaaacttgtagttaaagatcaggtattagagtcagatagaaatgagtaggacccccaagtctgtcttgtagcagctgtgcaacttggggcaaatcatctaccctctgcctcagtttctttatctgtgaaatgagacaaggtcagtggtgctgtttgaaaatggctgttttgagagttataagatataatctatttctaagcacctggcccttgaaagcactcagtaaaagatacctattaagtgagctgcttaaaatcacatccttgagatgaatccagttcctctgacccctaagtccatgttgtttcctcccatgccaaggagggccctcagagagaaacagtaatgagatgagactacaattccactcctgtgtttacacatttccagttcaagttgagctggccttttagtgtgacagttgttcccacacaccattattgcctccccctttatcagaaagccatttgatcatgaactacattccatgtgttttctgtgaccaagtagagtgatgatccgagtcggcagcctcctggctcaccgggtgctttgcatatggtgctgagcaggagaagaaatcatgtttgtgtaatggaagcaccaaatacgatgttggatatatagaagggctgctaacgtttatccccagaagcgtggacaaatgtgacaccacactcccagcacaggcctggctcctattttctgtctgtgatttttgaattggtttttccagcccagtttctcttttatccagccataatttgaaaaataaaatggaaattggaatcttttgtctgcatctcctctccacctcctccaccttttttcctttctataaaataaaactcacggtcacattttaatcatctggttttgaagaaaagcagatagaggcatttgcacacggcatgcttcattctgttgctctcctggggttctgtttctctggggagaatgagttgaggctggggtacttctcagggagcttgttctatcctcttacgcatttctggccaagtacaaaagctgagcagtctttctccttctaattttcaattctattgcattataaatagagttggacagagatatcactgtgggagctagcttcatgatttgttgcccctttaaaccatttgaaaaatatttacttagcatttatttagagaaaaggctgagaagtgtgtgggggagggaccactcatgtctagacttagctttgcctctaatttcccctgtggaccagctctggcctcaagtttgcatgcttcctgcaagaaaacacatacttgctgggctcatctttctttgagggcagtttggggaccatcggcaattgctctgtcattttccctgggagtttcacctcacacatcaagcagcttatcaaaaatttctttgcagttctctcttagagaaaggttttggtacataccattttcttcattttgtaattgttagggatgattaaatggcccttgtagattgatgcttggggcagcctgctagctaggtattcctgagtttggctctaccattagactgtttgcagtgggactgtcctttctgcactttttgtctgtttcataccccgtacttacacccctgaccctgctactgcatgatcagtgcatgcatgacaagagaacagtgctgtgcacatactgggtgcttaataatggcttgaacaattgtgtctgctgttttcttctttcttttccctcctgatactcttccaagggagtctgtatggagtagagtaaaacaaaacaaaaacttcacatgggctttagtgtctgaaggcctaagtttgagtcccagttctaccttttattagccattttctccctaatccttgactccctcatctccaaaggggaaatagttaaaagacctgtttctccgtcttaggagaaacagatgcaccattgtctgtgaaaatgctttgtcaatcatgagaggatcatgccatttaaaaaattactggattaagaatttaaggagctgtcctttctaaggcagctgaattattgtccaaactcgccaaccctagttgattctatcccctagatatctctagaatgagcccatgtctccaaacctcatgggcattccctttttctagccaagctgcctttctttctcctgaagaagtgcagtatttgtctcttgggtcttatgcctctagtcttattcttttcaatccagagtcaattctctaaagggcatatctgatcttgtcaatcccatgcctaaaatccttcagtggctcttcattgccctcaaaataataatccaaacattccagttatgtgattttggataagttcctcaaattttctatgccttggtttcctcatctgaagagttgggatagtaatactcacccctagagaggtaccgtggtgaacacatcatgagatgctgcttagacagcttctggcacagtgtcaggcttgcggcagattatcagtgagggcttcctgaacaagtgaatgcaggaatgattgactacggtaccagtagtgtttgacaactgttacttttaggggttggacttagaaagtaggctttgcttgcaccctgtgtatcatatcctcttaacttgtggagtttcctgagtgaggatgtcaccggaaaatctcattctctcctctctctatagggaggaaccagcctcttggggtaggggagagagaattaatttccattcttctcctttggcccaaggtctatgcagcatgttccagaagtctgcttgtagtgggaagtaggctggtataggaatgaagaatgtattttctgtctcggtgggcccttccagtgaataggacttcccttccctccacttgggctgtaagtgattttgatagcatcaactagactcacccaaagccacacggccgggaaggagcattctcaagaaggagaggatctgttgttcaacaagtcttattctttggactcctgaaggaagctttggaagtcaaaggagaaaaatgagctttgtttgaagagggcattattcttcctaagagcaataagcccaacattctctatgtcattcatcttcccaacatccctgtgagctggggagggagtgctactgccaacacatcttatagatgggacaagagggtcacagaaatattcatgactttctcaagtttctgcagtcagtggtagactctgaaataggcaaaatatcttgttattctcaaaccactgctctttcctgagacagcaactctgggggcgaaaacgaggggacagtgagactcagcccaccttctctttgcacaccaagcctctgttacatggaggaggaagaggttgtcttcaaatcactgctgggttcagtatcctttaaggagaccttcagatgtttcctctgcctatctttcattgaatggttgctctgtgagcattatccagaaaaactttcccaggagatggccagacagatgtgaaacactcagtaatatatccagagctcgatggaggaatcccatgcaatcaggaagccaagtagaaggcagttgatcactccatctgctgttgttgtctttagtccagaactggacctcagaagtaggattcaaaagaacaggctcatcgagactcctcagttatattatacttttaaatgtactttctcaggaaattaagccttccatgtgtgctagcagagaaagatttttattttgttttgtttttctaaaggatgttttgaaggttgctattaagtttgtggttgaaagataatgaacttaggtagccgatctgcagtcaaatataccaccactaaaatataaatatttgttcttttgcagtcagtatctgcagaacagtaagcgaaagagccggcctgtgagtgtaaaaacatttgaagatatcccgttagaagaaccagaagtaaaagtaatcccagatgtaagtacgtcttttaaaaatagtcttagaaataatacaaaggatgaaacactagctagataaatattagcctaagcattaaagttttggagcctcattagaaggctgccctcgagtgtgtgtatcatggggtcattatggagatggaactttgtttttttcataagtaaagcccttggtccaaggttcaagacagtgtagctttctgaccaatttcactaaagtgcaagtagtgtcatagtgaagacagcgatggtaacaggcattctcagctgctgatttgtaaattttctcttctccctggcctgtgtctactcataggaagcagttgcttccttttgtagcttggacaatttgtggctatgatacctttatgttcttccacaggaccttatttgatagacatgatagatgggttgagaaatcagcttaattaaatagttggtcattttatatgctcaattaactgtgccatctcattgtctcttaaaaaggacaaccagacggacagtggtatggttcttgcctcagaagagctgaaaactttggaagacagaaccaaattatctccatcttttgggtaagactcagccacattaaaaagacaaatttcaataggaatttttggaaggaacttaggactttcagtgtaagtgcagaattttccctatggggtctttgttggttggagaaattagcatcaatttaacaaataaagaatggaaactaaccacacaataaaattaagtgataaatctaaaaataatctgaaataaattagagaatttggtcaatttttatgagaattcatgaatactagggaatttctgtgtatatttactgtggtcagtaatggctaaatgaaaaaggtgattggatgtgatccgtaaagctgtcaatatgattacaatctttgtggactctgaagaatttttaagtctgtatacaaatgggtgcatctgtgcttaagaagtatgatatataaataagccaatatctatttgtttgagacatttaaatattattgtctgaattcgaagtatttcattgtgagaaaagtattaaaattagttttaaatataatctcccttctatggctcagtaggaatttgtaggtgtcttgaatacgtgtacgttctcttaacataacaaatcaatgaaaatctatatttataagaataatagaataagtgtagttatgtatttgctggagtttatttgctagagtattcttacctaaaggtaagaatagaggaggttttgatctgcttataatcttttatataaaatgggaatactcatgggtttttgaataatgctcataccaaaaagaaaacaaacaaaaaaaaccccaacatattaaaaggtgccattgtgctattttattgttttctttaaggcccaaggtaagaaattgtgaaagtcaatgatatgtttcattcattgattcaaaaaatgtttattcggcaagtatcatgtgcagagcaccatgccattgcttgagacacctacattagttttgttggggttgaattgaaagaaaaaattgtatttctcattatttgaagtaacttttaaactatgtataaacacgagttactaaaattcccttttgcagttttaacatgaagaagttggggaaaacacctattaccgggaaaaaacaccttagaatggcttgtgaaagtgtaaatcctgaagttttagatcaacacagcctgcatttctaggctttgacatgattaccgtctgtcaggattccatgccattgaaaacattttctagttgctgctgagtgacaggggttctcagtccttccaaggaatgtggttttgatgagtaaaaagcagcgtttgatatgtctggcttgactgcacacatgcttcaagttattaaagtttaaagttgctcaagagctttattacaaccatacacatgccccgtaattcccaaattgccacaataggaaaagcacaagtgaaatttaagaacatcccaatttccttgaatatcatgcaagtggccctttggcgcctgtcactgtatacaaatttgtcaatctgcgaggccataaacatgttccatcagttggggcctttgcataactcgagagaactgcctttcatctcatttgaggcttgaaagacttggacctgagtaagaggacttatctgcaactactaattcatgcgagtacctgaaaatagaccttgtccctgtaaacctgctatgctgattaacaactgggagagatacggggctgcggtctccagggagatggcagccatatggagttgggaatggggtgagggtaaaaagcaaaagaattgtcttctctctgccaactcctttgtttgccatttcttctgcagtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcccggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaatccctttgcaaggttgcattactgtacccatcatttctaaaatggaagagggggtggctgggcacagtggccgacacctaaaaacccagcactttggggggccaaggtgggaggatcgcttgagcccaggagttcaagaccagtctggccaacatggtcagattccatctcaaagaaaaaaggtaaaaataaaataaaatggagaagaaggaatcagacataatttccatgtggttgttttacatttttactggttttcttactcttcttataagggatattttcataaactgattatatattttacaaaccaataaatgtatttgtagtacaaagtatgagggtataatatcaccacaactattttgaggataagtatgtctggtttaaagtttaactgcttcttccctcttcttcttcattacaaagaattcacacacacacacacacacacacacacacacgccacgcatacaccccccaacacccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12070 - DNA, 57392 bp, Human
  misc_feature (1)...(57392): n = A,T,C or G
atgttttgtggaaagactcttctggtgcctctgtgaagaagggtctccaggtttcagataacagcacctctcaatctggttctcatatggagagtaaggacagacagcttgggctcagtccacagactcaactgccctctgcagagtggaccatggataggactctggcttggtccttggccttgtggaattacactttatttgtatcctacaggaaaaaaaaaaagattaagactcccatagaggaacaccaagcacagacatggtctatccaggatactcaaggaagcaggagctgtcaggcaatccaagccagggcaggacttctcatggtacagtacttcatgattcattatttcatttgagcctcccaaccattccatgaagtagttgttaattatttctttcccgcctcgaatttttaaaaaaataaatgaggaaactaaggctggagcaaggggagtgactgctcaaagccactccattggatggccatcagaactggaacttcaatccaggttttgtcttaggtaaattctgtgcctctttcactatagaaaaaaaaaaattgctaagggaaggcttcgtggaggaggaggtgcttgaactgcccaagtggcagggcactaagtgccgaagggtgaccaggcctctgggcaaaagcacaaagatgctgcacagcaaagccagttaaagaaacaaaacacggttccgggaatgtgcactgcttgaggacaggaaggacccagatcctagaatggggcctggggctcagcaggcgctggataactgaagaaatggctgtctggaacacagatttttctatagaggagtagtggcggtgaggctgcgaaggcggaagatggagaggctttcacacaaggaaggcggtggaggaggagcgagggggctcccgggtgcttgtgcggacataaggtgcgagagaatcagctggaaggtgggctccagcagagagaagaggaaggccagaagtagaccgggacagggggaggaaaggacagagtcaaggaacatttaggagttcggttcccggaggcctggcgacaccctgacggggaggggtgacgcgcacccatttgcaggcagaaaggcaggagcaggggggtgtccgaggatggtggctcggagggaccaggcataggtggtgcaagctcagcagtcactcaaggggtggcatgcggatgagggaggcgcctcccggactgggggaccgggaaaggcattagcaacctgccagaacccggttaacaaaggcaggactacaattcccggcatgctcgggctcggtggggtgacggcgggcggtggctgcgctgcacccgactggtgggcgcaggacctgggtcggcaccggagcctgtcatcccggagcggtcggcgggggtgcagagacggcgatgcgcccctgtcccccgcacccgggccgctccgggctcgcgcctcccgccccgcggccccgccccctgccccaccccagtcgggaggcttagctggggccgcagcgcggcggcaacatcactctcgctgccgctgctccgccccatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggtaagggccccagaggagctgggcactcgagatgtccgcaggggatcccggcaaggaggctcttctttgagagtctgtgacctggcctgaagtggaggttctccctcagcaccgcacactgccctcctgccaaatgtgcccccagagcagccaggcaaattgctgtgataccgggctgccaggtacatgcacaggcacacacacacgaagcaacgtggacaggcggtctctcaagccagtgagcttggggtggtctgacctgctgtgggcatttcctgctggtggcctcaggatcagtcaggtctgtgggatggccaggcagcctcttgtgaatgtgggttcttgttccttcacagcctcctcccctgaggcttcctccctctgcagcatcttcaaacctcacgtcgttttaataatatcatttggttagtgcttcagttcaaaaaatgccccatatatatgatccatacatgatctcattggatcctttggccatccagggtcacagttctgaaatccccatttcagaggtgaggaattaaagcttggagaagtgacgtgaccaaggttccatcctatgaagtggcagagctgagctggaacccatggacctcatgctgtttcagttcttagctgggcaaagtgggaccatgaacagattctgctccctgggaaaatggtcccctgggccttacagtgcaggagccattgcttgctatcattaggaaagagatttgggggttatgcaggaggtagggtggaaaaagcaccaaactctataccagagaccaagagactggcctagccattctacagctcattgagtggccttgtgtaagttgcttctctcttttctcaggcctcagtttacctttctgtaaaatagagggttggcctgggtgatctctgaggctctacctatctgataattctatggcctatattaatctgagcagcaaaccaaccgacccctgccccgaggcctcatcacagttaatatccaattccccataaccctgagagatgtcaggacctcagcatccttcctgagctgtttcctcacccccgggaccttccaggctctaatggggctaactacagaggcccctccctgtccagtcatagacctattaagttgcattgctgaggatgccacaactcaatgttccaggcatttccaggcccctggagccttcaacactaggggtggaaggaaggacacaggaagccatgagcttgctgggaagagcaaaatattgccatttcttattccttctcaggaatgtgggctggggagcaggggggcccagcctacagccactgggagagtgacagatgagctgtatgccattgtctgttttgggaatgtgctgctgcagcaggggctctggccttacatatttaatatttaattcacttctttgagcccaggaagagttatgctgagctgtttcctcaaggaaaggatcaggggcctggaacctttagggacatcctgagagaagcaagatattagaggcagggccgttagattgaagccctccctaggagggagggaatccagtgtttgcttacctggtcaatctgccattgattttgctaagaagaccccccacctccctgaaagctggaaggcaacaaaggctaagaagggaggaaaatgcaataacacacttcggctgcctgagggatggggtgaaggtttccgttgttgggaactgaccagtttccctcagtgagatccttggatctaaggcagtatggggcacagatgatagaacggccaagagatcagggcggccagcaccagaattcttgcaccagaggcatagcccacaaaatatcacagtcttagagttggcaggagctttggaaaactgagacctggacttgcccagggccacacaggtgagttgaggagagcctagcccctttatatatggaagagcccagcctctttccactgcttgagtcctaatgttacctgtgctacttgataatcagagtaattcatttttatataaggcgttgacatcttaatctcattcgatcctcccaacaaccccaaggggtgggtactattatttccattcaacagttatgaaaactaaggctggggaggtggagtgagtgtcttatcagctcgtgaccctgggtgataggcagcagagccaggactggaacccaggtcttctgatgcccccagccctgtgctctttccaaggcatctcagattcctccatgtttgctcactgtgtgactcagggaaaccgcctttccctctccagccctcaggcttccattcacctaatgaggaggagaagcctgaccttgctccctggggagtgggtgaaacagtcactatgtaccaggtgttcagatggaagcaaagggggaggagtgcctgggaaattccacaacaggaatgattccataccctgtgacttctcatcacactcagcctaggacaatcagcagccagcaacccaaaatggaacctagacagaggacccaagttccccatagccccaaggcaccgcctggttcagtgtcggatgtttctaggctggtggaaacaatttgagggctcttgaggaatctacagggtaaagaggggaggagcatgttagagataccaaccccagtcctgcctatttcccagggttgaggattaaatgagatcattagcacgagggcatttaaaataagttgaaagcaccaaatacatggaaggcattagcagctatggggtggcttctgtccaccaagctggggtccagtgatctccaggacagacatctttgttgttagcttgacttcttctttaccctgccatcccagctgccttgccataaccctgcagcttgctgggagtagagccaggcaggagaggtctaggagatttcagaaggcaggctccccatctgcagctcactcctgtcccccctttctgagttatggcatcaactccgcttcttccctgaccagctcccattcccttcttccagttcatgccaccctctgggggcagctaagtggtagttgatgcgacccagtgccctcattcactctctctgactcatctcatagtctgtctcgccagctctccctgcctgccacctcccaggctccctgttctctttgttctcccctcactgtgcacaaacaccatgcctgtctccttggaatctcatttcatccctcctttcatgtttactgtgggcctcaggggatgttcgggtgtgcaaatgtgtgagagtttgtgattgtgatcagtgtcctgtttatcagtaatcattagcaatttatacttatgtagtgtctgggggagggagggtgtgggcgggaaatgctggtgggagcttgataacatactaggcctgtgaggtaggaggaataggtaacatcacagacccacaatgcacagtgaaaacttcaaatatttggtactgcgcagtgaaaacccaaatatttgtgcgcagtatacatactgcagtgaggacaggtgaacacacgtagattggttgggagaaggcctactttattcaaatgtaatcatgcaagacaatttttaaatgactgctttaattttgaaattaactttttttttgagatggagtttcgttcttgttgctgaggctggagtgcaatggcacgatctcagctcattgcaaccctgcctcccgggttcaagggattctcctgcctcatcctccctagtagctgggattacaggtgcccaccaccatgcccagctaattttttgtatttttagtagagacggggtttcatgaggttggcaaggctggtctcgatctcctgaccttgtgatttgcccacctcagccttccaaagtgctgggattacaggcatgagccactgcatctggcttagttaattttttcaaggagttggactagatgattcctaaaactttgattttagctacttaaaggaaaaaaagagtgtttgtgtacagatgatacagaatgcaggcacgaattgaagacagaaacaacagcatcggatgtgatccccaataagaaggtctggagggagaagagctggggttcttggctggagcccactctctctgtggtgaatgtagaaaagagaacctgcagaagcagccccggaagccagagggatgcggtcataaggaggaatgcgaactgtgttgaaattgtattgtcccttttgtgggtcctgctttctcccacccctcagcagggggattaaccataaatgcaagagagaatgtttcaagcctgagcgacaacagtaacagtaataataatgacatttactgagcacttgctttgtgccaagtgctatcctatatacagattatctcgtttattccacatgagcaccctccaagaaaggtgctgttattgttcttgttttttttttgaggcggagtctcactctgtcgcccaggctggagtgcagtggcgtgatctcggctcactgcaagctccaccttctgagttcacgccattctactgcctcagcctcccgagtagctgggactacaggcgcccaccaccacgcccggcttactttttgtatttttagtagagatggggtttcaccacgttagccaagatggtctggatctcctgacctcatgatccacccgcctcagcctcccaaagtgctgggattacaggcctgagccactgcacctggccttattgttcttgttttatagatgagaaaacagagctccattgaggtgaaataactctcccaaggccacatggttggtatagtaaaactatgtaaacccagctggatttgacacaaaatctgatgctcttttaggcttaaaaaattaggaatatcaggttgggaactggttcctgaggaggtgctgaaaaattataggagtaggctgggcaaattataggagtaggagtggctcacacctgtaatcccagcaatttgggaagccaaggtgggtggattccttgagcccaggagttccagaccagcctggacaacatggagaaaccctgtcttgacaaaaaatacaaaaaattagccaggcatggtggtgtgtacctgtagtcccagctacgcaggagactgaggtgggaggatcgcttgagcccaggaggttgaggctgcagtgagccttgattgcaccattgcactccagcctgtgtgacagagaggaaccctgtcttaaaaaggaaagaaaagaaaactgataggagctgctgtagatgtgtcacatttgaggtgacagagtccagtgggcagctggagttgggccagtggagtttagaaagaagcccgagactggaaatggagattgggtctcattttttttttttttgagatggagtttcacttttgttgcccaggctggagtggaatggtgtgatcttggctcaccgcaacctctgcctcccaggttcaagcgattctccttcctcagcctcccgagtagctgggattacaggcatgcaccaccacacccagctaattttatatttttagtacagatggggtttctccatgttggtcaggctggtctcaaactcctgacctcaggtgatccacctgcctcagcctctcaaagtgctgggattataggcatgagtcaccatgcccagccctgcccctctatttttgacactctatccctctgtgtaaatgactcccagatcgaggtctcctctctggtctctctgctggccttattatatgaagtgctatgttcagggcatgggcatcagagtcagccaggtctggatttagtgacttaccagttctgaggcctctgagtaccagtttccttagctataaaatgggatagtaatagtatctttgttacagtgctattgaaataattaaacaagggccaggcgcagtggctcatgcctgtaatcccagcactttgggagacagaagcaggaggatcacttgagcccaggaattcaagaccagtctgggcaatatagcaagaccttgtctctaggaaaaaaagaaaaaggccgggcgcggtggctcatgcctgtaatcccagcactttgggaggccgaggtgggtggatcacgaggtcaggagactgagaccagcctggacaacatggtgaaaccccgtctctactaaaaatacaaaaattaggtgggcttggtggcgcgcgtctgtagtcccagctgctcaggaggctgacgcaggagaatcacttgaacccgggaggcagaggttgcagtgagccgagatcacaccactgcactccagcctggtgacagagtgagactccgtctcaaaaaagaaaaaaagagaattaaacaagagaatgaacataaagcactttgcacagtttctggcacacaagtgttaagtaaataattattattgctatgtcaaaccacctaatagatgttttcacttggccaccttcctgatatattaaacacatcacattttagtttggcattcaaggcgcttcagagtctgactgcaatgcatctcttctatcttgcctgcccaagccggttactccaataggaaaaccctgcaccagctgttctaccccttcctttgaaatcaacatgggcctccctatcctactgctgattgcactgtttttgtgtcctggattgttgctggtaaccagggagtacgaattatggaagcaggttaagcttaatttaaagatctctttaacagttaaaattgggctgtttcaagaagaaataggtggccttgatggtggtgatgatttcacggttgtatacctgtccccaaattcattgagttgtatacattaaatatgtacagctttttttttttttttttgagacagagtctcactctgttgcccaggctggagtacagtgggacgatcttagctcactgcaacctccgcttcccgggttcaagcaattctcctgcctcagcctcttaagtagctgggattacaggtgcacgccaccacacctggctaagttttgtatttttagtagagatggggtttcaccatgttgtccgggctggtcttgagctcctgacctcaggtgatgcacccacctcagcctcccaaagtgctgggattacaggcatgagccaccgtgcctgacctaaatatgtacagctttttacacatcaatcatgccccagtaaagtcatgggctcccatccctggaagtgttcaaggagagaccgaatgtcagtggtgcactaagggcttgatatatcagaaaagccgttgaaccagatgatcttcagaatccctttctcttaaaggcccttaattgtttaaaatgttattttttaaacagtaaaagagaaaatatttagctttctgaaaattaagaccagaagatttaaattttaatgtagtatgaattcaaacaataatataatagaggatgtttttcagctctctgtcataaccagttagagaagagtcaaagacaatgggaagaagagaagagagaaagagagagataataggagaaaagcaagagagaaatagagggggacaataaagaggggaaagagaaagaggtggggaggtagagtgggtaaagctgtggacgacagggtttttgggaagaagaaacctcgattgggagaggaagtgctgtagtggagagagtgaaatactgtgtatcattccactgtcctgatcttaatgttagtcttcaaatagggctatctccagtctccagagacttccacaaagctgatctggttccatccacatgtccccaaggacaccagccccatgctagacactctgagatttgtggggctgtgtgatcagctgagtcctgtatgatcagacccttgaaagaagccttgagataacaagtgacccatactccaggctgggtttggatccaggtcacagtccatgacctcttggtgttggtgagagcagtgtcttgtattccttctcatccctggtgggtgtggtcagttaacagaatcgttgcgtcctgggggcattttgtaacacaaagatttgactagtgggaagtatatgacactaatggatttccatatgagattctgggcttcaagtgacattgaggctcagcaggccttttggtccagtgttaggtttctcgtgctatgtgttggctggaggagggtattatcatactgccctgagtcatttccagcctccgcagagcacaagattggatgaagtggctttgacaatattctcattgtgctctgaagactaggaagaaaggcctggaattcagatagagaggggcacttttctctgccagcccactgcgcctggccagtctggggcacctcttctggagctgctgaaccaggtggcatgtttgaatgaataaggaaatgcttccccaggtgcagtggctcatgcctgaaatcccagtatattgggagggtgaggtaggaggatcacttgaggccaggagtttgagaccagactggacaacaaagccagaccccatctctacaaaaaagtaaaaaaaaaaaaaaaaaaaaaaaaaaaagctaggcatggtactgcatgcctgtagtcctagctgctcaggaggctgacatggaaggatggcttgagcctaggagttcgaggtttcagtgagccttgatcttgccaccgcactccagcctggacaacagagcgagaccccaactcacaaaaaaagaaaatgaaacaaaatggtctctctttccacagatccagctctgcagctatagaggctgtacaaggcacaccctcatgctcagaccttataggacacccacacttgtggtttggtatatctagaatttttaatatcctgagaagttcctgggcattaactccacctcatactaaaaaattactttctagttgtctcactttcttcccagatatactcaacagaagagtcccaggccctgggctgagctatttcttttttctttttcttttttttttttgagatgtagtctgtctctgtcaccaggctggagtacagtggcgtgatctcagctaactgcaagctctgcctcccgggttcaagcgattcccctgcctcagcctcctgagtagctgggactacaggtgcgcgccaccacgtcctgctattttttttttttttttttttgagacagagtcttgctctgtcacccaagctggagtgcagtggcgtgatctcagctcactgcaagctccgcttcccagcttcacaccattctcctgcctcagactcccgagtagctgggactacaggcacccgccaccacgccaggccaattttttgtatttttagtaaagacggggtttcaccatgttagccaggatggtctccatctcctgaccttgtgatccgcccgcctcggcctcccaaagtgctgggattacaggcatgagccactgtgcccggcccttttttttttttttttttttttttccttcatagagacagggtttcaccatgttggccagggtggtctcgatctcctgacctcatgatccacccgcctcggactcccaaagagctgggattacaggcatgagccaccatgccctgccgggctgagctatttctatagcactagctaatgtacatgcagggtttctcctttcttcaggtgggccagcagaaaaataacaacagtggtggtaataatgatagctaccatttcttccatgcgtgcttaatgccaaccactctgaggtgttctttttttttttttttttttttttttgagacaaagtttcactcttgtttcccaggctggagtgtgatggcgtgacctcggctcactgcaacctccacctcccgggttcaaccaattcttctgtctcagcctccagagtagctgggattatagtggccaccaccacacctggctaatttttgtatttttagtagagacagggttttgccacgttgaccagactggcgccgaactcctgatctcagctgatccgcctgcctcggcctcccaaagtgctgggattataggcgtgagccaccgcgcccggcctgatgtgttctgatgtgttctttatgtgtatcattttgcttcatcctcacggtagcgtgaatcttcatctgactagtgaggatactgaggcacattaaggaatgaacattccaagttcgcacacctagaaagtggtagggccagagttacgagcccatgtctgcctgactccataacccatgatcttcacctccacactgtaatgccagctcagacaggaaggatttatgccagatccctgactaataagccccagtgggaactcttgtctcctgagatatttaactcatctttgtccttctgtatgatgcaaacccccagcttctaacctcagcccagcaccattcgttcgtataatcaacaaatctttggccgggtgcagtggctcacgcctgtaatcccagcacttcgggaggccgaggtgggcagatcacttgaggccaggcattcacgactatcttggccaacatagcgaaaccctgtctctaccaaaaatacaaaaattagctgggcatggtggcgtgtgcctgtagtcccagctactccagaggctgaggtgggaggatcacttgaatccaggaggcagaggttgcagtgagccaagatcacgccactctcttgcctgggcaatagagtgagactctgtcttaaaaaaaaaaaacaaaaacccaacaaatctttttaagtaaccatggccaaggacataaatcagtaggtatagttaacttcatctttaaattctttaaatttctggaaggaatcataagaactcgcaataatggttattgctagggattttaatatggaggggaatttttatttttcactttatacctttttattttatttttcacaataagcatgtaatactttaaaaagtcatctgggacttttttttattttttcaaaagttttgggggaacaggtggtgtttggttacatggataagttctttagtggtgatttctgagattttggtgcacccatcacccacttttaaaaaattaaacaaaaattaatctgaattttttaaaggaaaaagccctttgtcagggttctatggtttaaaaaagacgggggggacatataaaagatatatgttaatgcctagttggaagatttgcttaaaggtaatgaataattgaggaaaatccagggttgataataatgctcaattatactcagttattggtaatcctgtgaccttggacaagtcactttccctcccaggagctgtaaggaatgaccaatagatgattcctgaccggacgcggtggctcacgcctgtaatcccagcactttgggaggccaaagcaggcagatcacctgaggtcaggagttcgagaccagcctgaccaacgtggcgaaaccctgtctctactaaaaatgcaaaaattagctgggtgtggtggcacacgcctgtaattctagctactcaggaggctgaggcaggagaatcacttgaacccggaaggcggatgttgcggtgagccgagatcacgccactgcactccagcctgggtgacagagcaagactctgtctcaaaaaagaaaaaaaaaaaaaagatgattccttgctttctgtaccatttgctgattcaccttggaagcaggccagggttagaaaccagcctgagtgaaggacagtgaaggacagagaggaatgacccagccttgactgggagcctagaggctgtgtgacccaggaccacgaacctaacccctctgggccccgcacctgatctgtaaactgctcagactacactatatatatccttaggttcatccagttctgacactggaacattctgttgtctggatttgctgaagagaaaccctctagaaagtcacaaataagcaagggaaatagggcggaaaggtgaagataagcattgatctgaggggctcatggttttttcactaaagtagaagggctgattagtttccttcctgctttttttcaaggtgagctgaggcacttctgggcatccttgccttgttcagtttaaggctggtactggagtccagctcgcctcatcccttggccaatagtttcctgatctcaaattgttctttcttcttgataaggaaattcctagcacttgaaccattcgtcatttttgttgtgttttgagccatccaaggcggagactcagactcagtctcctgatttttgtctcccagggaaggatatcattgaaaatagcattattcatctgaaaatggtactcttcatcccctccccattgtctctttcatttcttcttcccttactgctgactcctcaagatgtacaatcagggcgctggaaaaggagaaataggtctgtgagggaaggggtggctatattttctaagagatggaagcggggtctgttgagattgttgttttggttttgctttttgtggcaagtggtgggtaaaataccaatgagataccgaaacagcgagtaacgactaccatttgggtgtaatttatcacttaccaacactttcacatctattctcaaactcgctggttgttttgttttgtttctgttttttgttttgttttgttttttgagacagggtctcactctgtcacctaggcaggaatgcagtagtgcaatctcagctcactacagcctccacctcccgggctcaaggaatcctttcatctcagcttcccaagtagatgagattacagagatggaactacaggcacacaatactacgcctggctaatttttaaaataaatgttttgtagagatggggtctcactatgttgcccaggctggtcttgaactcctggggtcaagtgatctgcctgcttcagcctcccaaagtgctgggattacaggcgtgagcctctgcacccagcccaacttgctgttcttacccaaggcctgaaaggtagcaggtattctccccattttacagatgagaaagtggaagtccaaagggctgaagagctaggttttgtagcaaagagagtggcagagtgtgtagcccgactggagcaccctgactcccacacccagccacctttatatcattccaccacagaacttgtgcaggggcccttcccacaaatattttcccagagtttttagcctctctctgggactctagggatcctgacaacctccctgccagcacacagttaagagctctaacccacttatctcagagacccccataagactctcacacaggcagaagcagcagcagcagagccctgcctatttcagccaaaagagaaagcaaggaggctctgagctttcctgatggttcctgagttggcaaaggtacaaataccaaatgctgcttctctccaaggtgctttcctgtctgaacctggaagaaagccatggaacagagaaaaggacattgggcttggagttagggcggtggtggtcaaatatcactctgccatttactggctccaaaccttgagcaaatcacttcgcctgtctgggccttagttttcttttatgtcaaatggggatcataaccattatctcataaggttcttgtgagcatcagataggacgattaaggtaaaaaggagttaacccagttgaggcacatggccagttgcatctgagactcctgtctcctgcggaatgtcacagataggtggcagtggcagggcagagcctgtttggcttctctgtccttgtaaaatcatacttgatgctatctttccagaagagtggctggctgggcctggctgtctccattctagctttccacgtcagtgctttatgagtactggggcctcctttctccccgctctggttttgcactccatttgctcctggaatagttaaaggtgagtctctgagtatccccggctgtgtctacaagctggcattgtccctgtagtgacctggctgttgtcacagcagctgacctgcctctgatacctggaatcagagccttagtcaaattgggaagttatttggaaagcacatagtcaatataagagcagctagacaggtggggcgtggtggctcacgcctgtaatcccagcactttggaaggtcaaggtgggtggatcacttaaggtcaggagttcgagaccagcctggccaacatggtgaaaccccatctctactaaaaatgcaaaagctagctgggcgtggtggcaggcacctgtagttccagttacttaggaggctgaggcaggagaattgcttgaatccaggaggcagaggttgcagtgagccgagattgtgcctctgcactccagcctgggtgacaaaatgagactgtcttaaaaaaaaaaaaagagcatctagacagattccttaattaggagactcaggcttcaaggactccacttctaggcctttgtttcccatctataaagcatgggggttggggttgatgattcccaaagtccccttggttaccctgcccttcatatccatctctcaagtgagagactatggtgccctggagctcccagccctgtcttttccacccccacagcctgtgctggccttttagttacactggacttgtttagaatcagcagaaccaaacccaatcctgtccccaggcccacccacctatagtcttttgctctgaaatattacaaaagaagcattgactggaatggctgagagcttcagggaagttctcttgaagactaggaactccacattctcatgtcctctgcttggtatattctagactgaattaggctcagggatttcaggcatccctgtccctccctatcctcataggtgatggttaaggatagagatctctaaaaaaattagtcgggtgtggtggctcatgcggctatttgggaggcttaggtgggaggatctcttgagtctggaacatccaggctgcagtgaaccactgcactccagcctggacaacagagcgagatcccgtgtctcaaaagaaaagaaaaggctcaagatctctgagagaaaggaggagatggccactggtatcctcagacaaatgtggaaataaaaaagtaaaggaaaaaaatctatttctaagccaagaaaggaatctcatgcatgacatatttccgagcatgggagtgaagcagacagcttggggtgagactggggagaaggagggagcagagaccctgcacctggactgaggcccacccacagatttcatgccagagccaaccccatcttcccagcacaagactggtctgtcagccaggcttggctgagagtgtgggtttgagcaagtgggcaagacttggccagtgactgataaggcaaattcagttgacattcagaccacgtctgtgctgggtcccggcagggctggcagagaaacacaggggcattggacagacgggtggagtgatagtggccagttagtcatcgtccaggattctctttatggagcccagggcccagcccgcaggagagattgtgaagcagagttctaggtccacagaggagatccaacgcggaagcagatgagcagaaaccagcccaggagctggtcttgagactcctgtaatggggaagagggaggaaggagggctgggacttggggactcagcagtcatgcttggctaatgcatcagaccccaggcctgactggcagctcaaattatgcctgatagtgtccaggtggcttcaagaactgggtgagttggtagcctttgagtgagaaggacttgggcctaggtgtggatagctggggaaggtggaggctgaataaacaaaaaatttcattttgaatctgaggtccatctcttcacttgaaaatcaccaaaaaaattagccggcatgctggcacatgcctgtagttccagctactcagaaggctgaggtgggaagatcttttgagcccaggagctggaggctgcagtgagctctgatcatgccactacattccagcctgggcaacagagcaagaccccgtctctaatggaaaaagaaaaatcaccaaaaagtttttaaaaacacaatatagagtatgttgggaaaggaaagcctcaggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgcatatatgtgtgtgtatgtgtgtatatatatttatatatttatatattatatattatatattatatatattatatattatatattatatattatatatattatatattatatattatatatattatatattatatattatatattatatgtattatatattatatatattatatattatatatattttatatattatatatattatatattatattatatattatatattttatatattttatatattatatatattatatattatataatatatattatatatataacatatattttatatatatattatattatatatatattaggtaaagtggaaatagcaagacataagcttgtgtttatactatgtccatagaggtgaaaaaagggccaggcacagtggctcatgcctgtaatcccagcactttgggaggctgaggtgggtggatcaccataggtcgggagttcaagaccagcctgaccaacatggagaaaccctgtctctacaaaactacaaaattagccgggtgtggtggtgcgcgcctgtaatcccagctacttggaaggctgagacaggagactcatttgaacccaggaggtggaggttgcgtgagccgagatcgtgccattgcactccagcctgggcaacaagagcgaaactccgtctcaaaaaaacaaaaacaaacaaaaaaaaaccagggaaaatgaaagaaaccaagtagccatggtagggaatatgtggcatttgtcattttatttctttggtgattttgatgtttgtgcaattctttttttctgaaaggagagaaagacaataaagggttaaaaacgtgtccccagaattctttaatagactggtatttcctccagggttaactcttgaagtaacaaatttcgtaaatgtattaccttctataaacagtaaaactccttttcgtttgtcctaaaaactgctgctgtcaaacctcaagacgtgagctcttactctatgtgccaggatggattggaaaagcctggatctttccttttcatccccagttttgattgtttcatttccagacttatcctcttaacttttctttgtcttttcagaacagagtcttttttttttttttttttgagatggagtctcattctgttacccaggcaggagtgcagtggcacgatttcagctcactgcaacctccgcctcgggttcaagcgattctcctgcctcggcctcccaaagtgctgggattacaggcttgagccactgcgcccggcctaagcctcccttctcttgatcttctctctgctttatgtctctggagatgcagtaagagaactacacacagtactcccaattcagccacatcatggttttatatgagggtacaatgttttgtttctaaaaagccttcatgatggtgcctgggcagatgctactgacttttttagctgtggcagcatattcagccagtgtcttctgggaacagtggagtgttactcctcctcctcctcccctttttagggcttataattgattgcccatggctatcatttaattagtagagttaggattccttttccccaaaatgtaaaattgtaattgatgctcatctgccattttttgtcagctcacataggctagaaattctgttgtactttaccacctaggaggatttgggggtgtctgtgaagttgggtatttcacccatgcactccttcttgcacagcttcagagattagtcctgttgtttcacacttgagtgctttccatccagagaaatacctgtttatttctgtttcctttccctagttcacttcccctttctccatctcttcactccccatgtaactttgaataacctctgatgtgcagccttgccaggagtgctttaacctccagagttctggtcattggcttccccatgtgctgtaataacctattccgtcccattctgaaagaactctcagagattagtcagacaccatttcctcttgccggaaacatgttgatttcctttagcaggttctgcttcctaaaggagtcaccacagcccctgcaataggaagagcttgggctttggagccaggcaggcctaggccaggtctccatttaagttttttgtttttaattctctttctttttttgagacagggtctcactgttgcccaagctaaagtgcattggcgcaatctcagctcactgcagcctcaatctcccaggctcaagtgatccgcctgccacagccttgcgagtagctgggaccacaggcccacaccaccatgcctgacccatttttatattttttatagagacgggttttgccatgttacttgggctggtcttgaactcctggactcaagggatctgcccacttcagcctcccaaagtgctgcaattacaggcataagccatcctgctcagctggatctccatttaaatttaatgagaggcatataactatcatttttccagtgaaagctcacagatggttatctgccaagcagtgtgctaagtccagggaccctgagatacgagtaagatatgattgctgtcctaagggagcttacaggcgagagagcatgtaaacgaataatgattctatcatgagaaatagtaggaatatggcctggttactgagggggccatcatgtgaccttggatgggttatataacctctgtgagctttcactggaaaaatgatagtgctaataatatgcatgccccttacaccagtccttttcagacatttatgtgcatccaaattacctgggaatctcagtacaatatggatctcaattcactaggtctgaatttcttatttgatttgcttatttatttttgagatagggcgttgctatgttgcccaagctgatcttgaacccctgggctcaagcgatcctcctgcctcagcctcccaaacaatggggaccacaggcataagccaccacacctggctctggagtgttacaaaatctccccaggtgtttctaacatgcagtgatatttgagagcaagtgtcttttgattataaagaataaagaatgctagagccacataaaatgctggggaaaatgaagggtctcagggttgaaatggacaagcgtgtcccagattcagaggccaggccagacagcaggctcctgaagacctgtgacccagtagttaggggatcaggtatccatggtccacaacagtaggggcctcctccatgtggttcttctcttttctctcacacccaccccacccctcctgccaggttccccagatgatcgggccccatgacagtgagtgtggattgatgaatgggaggagaaactgggataaagagagcccaaggtggccgggtgcagtggctcacacctgtaatcccagcactttgggaggctgaggcaggcggatcacttgaggtcaggagttcgagaccagcctggccaacacggcaaaaccccatctctactaaaaatagaaaaattagctgggtgtggtggcatgtgcctgtagtctcagctacgtgggaggctgaggcaggagaatcgcttgaacgtggcaggtgaaggttgcagtgagccaagatcgcgccactgcagaaaaaaaagagagcccaaggaagggacctggaacccactctgggacaacccccaaggattctgtttggttcatcaaatacgtattgagcacttgttatctgccaagcactgagctaagtccagggacccagagatatgagtaagatatgactgctgccatgagggagctcacaggggggacagcatgtaaatgaataattattctattatgagaaatagtaggaatatggcctggttactgagggggcccgaaagagcaatttcaaggggatcagggaaaatttcccaatggtcaaggtgtgtcttgcagaaaaagtggcagttttccagttagatgtggagtgggaggaggaacccaggtgcttgtgaaatgccatggcccattgagggagctggaattcttttttttcttttttgagatggagttttgctcttgttgcccaggctggagtacaatggcgtgatctcggctcaccacaacctccgcctcccgtgttcaagcgattctcctgcctcagcctcctgagtagctgggattacaggcatgtgccattatgcccagctaattttgtatttttagtagagatggggtttctccatgttggtcagactggtctcaaactcccaacctcaggtgatccgcctgccttggcctcccaaagtgccgggattacaggcgctagccaccgcaccgggcccccagggagctggaattctcttggtgaggctggagtacagagcatacgcagagcatgaatagtaagaggaaccgggaggccaggccagctcccggggcctgtcactgcagctgaccttggatttcatcctgtaaggaatggaggtccattcagtagtttgaagccaaggagcaagcattcagagttgtgctgttttttgttttttgttttttgtgatgaagtctcactctggcacccaggctggagtgcagtggcgtgatctcggctcactgcagcctctgcctccctagttcaaccgattctcctgcctcagcctcctgagtatctaggactacaggtgcacgccaccacacccagctaatttttgtctttttagtagagctggggtttctccattttggccaggctggtatcgaactcctgacctcagatgatccgcccacctcaacttcccaaagtgctgggattacgggcatgagccaccgtccccagcccagggttgtgtttttagtggatctgcctgggtgtcatgtggcagaggggtggaaggggacactgaggcagtggggagaccacagcagtggtccaggagagttgtgggggctgcaatgaagccagcaggtagcagtgagaatgaaaaatggggggtggtgggagccgcactgaggagcagatttgatggccttgactcactggccagatgcaacggatgagaggcagggcagggatgaggcgaggcaggtgagtcgctgaggatgcagtgtaagggattcttccctctcatggtcctgcaaatgctgacctggagtgtgaaggaggagcctaggatgggtttaggtctgtggcaaggcaatgcggtaagaggggagatcattaaccaggagcgcaggcggctgcagtgtggcagcatggacagcctccagggctcaaggcctcttcctcctgccttggcctctgaggctgtgtggggctggaatgaagctcgtgcctctctggcgggcccaacttgctcagcgtctttgggtgacaaagcctcacacagcccattccttgacctcccaaaagccactgttaacccctgtctggctgtgttcccaatgatgtggctcttacaggtggtctcctgctccccaagtctgacagcaccccctgctttgagatccctcaggtaggtcagctgtttccactgggaaaaattccagtggagaagcagccagctttttccactggttcaaggtgatttcaaccttccaggaggcccgtgatgaagccagaggacaactgggtaccctgggacagcaccttcttcttattttattttcattttctaaaatttcaaatcgggcacccccccaaaccagaataggttttgaaaggctgccgacagcaccctcttgaaaatacattttatgtagtcacagtttacacaaatctgacattatttcagcttcagattccaaagcactgactaggggctttcacagagtgagactgggggtacgaggttcaaatctctcctctttgctactcaatagctgcatggccttaggctggtcattctcaatgtcttcatttattaaatgcggaggagaatagtccctcttagggggggatggaaaccatggtgttaaaggcttagctcagcatctaatagatacttagcgctccacaaatgtttgccagccatcctggaacataggcggtgttccaatattgtagatgacagacctgaagggattaatttgcccaaagcctcgaggtaagtgggtagaaccaagtcttcccggccctctccaaagctcctgctgtgctgggcccgtgctgttccttcttgctgtgcagtctgctccctttggcttttcttctgctttccacatcagctgaagatttagaccctttcctgctgcctgtgttgagagctgtcttcctgagttggaagccagttagctaaaggctgggctacctggtgactgtatcttatctttcccaatcctcaacaccagctgggtcctggttgccaggattaggttgccacccccatcctcctcctagccctggtggaccaacctttcctgtgtacccaaagcaaacagaccagttgccctagattccccgaggggcaccctctgtgcctccctagtgttcctgctgacaataagagccttgtgctgggacctgagacactagaggggaaaactccattctccctgaaagccacaaggccccatctgggacacatctggtgtccactcccagaaggaccacagagcagggaagcaaaatctctccagctagcaatgttgtggaccctttgcaaagcccacctcccaacccctctgtgtccccaggccatggagagcaagctcctcatcgggggcaggaacatcatggatcacaccaacgaacagcagaagatgttggaactgaagaggcaggagattgccgagcaggtagggcctccaggtgccaggtccccttggagagtgtggcctgcagctcatgtctgggaggtgcagggccgtaaaccatggtggactctggatctctggaattacagtgctgagaatctcagacatgccaccctgggtcccacaggtctactagcccagggtcttccctttggcaggggcactgctagctggtgggcgagaggacgtgatagctctccataacatcagcctccacaagccacctggtactaattcctgggccttccacaaggtggtgtgagttctttgccaactgtatgactgtttccctaaatcatcaagagccacagtttgttggtcttaccaatcaaccattatactacttggggagagggtgaggcagcttggaaggcagtgtgatgtgcctccatctgtgtgactaacgcctctggagtaggccagctcttaggggctggggtctccatccacatggggcagagcctggcaaaggcatggccctgggaactgagaggagggttcccaggggctctgcaggattgggtgggagcagtggatgtgggccatgggccatggtgaagccaggtcccgagacaggcagagtgagccagtcccctgagctttcctggccctcccgagtatgcactgctcctttgagccacactgcccgtccttggcctagaaacgtcgtgagcgggagatgcagcaggagatgatgctccgggacgaggagactatggagctccggggcacctacacatccctgcagcaggaggtggaggtcaaaaccaagaaactcaagaaggtgagacgctgcagcaggaccggttaaggtgtgctggaggcccagcagtctctgcccaagggatgtgtgcttcagggactcctccccatttggctggaactgctgaacccctgagtgacatggcttggcctcgggggtgagcaacagggggaggcaggaggcgggggctgggggtggagtagagccttttctcctgggccagggtgggctatgacaggctgcaaactctgtcacttgcagtatccagcgttaccatcttcatggtcctgggtgattaccccgttcagtgtcaccagtgagtcacagttgggatagctgggcctggagcagggccaggggaatacagagaggctgaggaggagactggaaccccgggaagctcaggtggggagtgtaaggccctcaaggacatgtcaagggatgagaatagccgctcaccagaaccctgcaaagcccgtggcaagggaaagacatgtacatgtgaggggggtctagggcaggaagcagcaaagctctagcttggattctgggaaaaacctggaggcccttcggggtgggtgatgtggctgcccaggggcaggcctggcagaggcactgccactgtggcagttaccacggacccagccctcagtggctttggagaggagcaggatggccatgctacctccacaccccacttttgagagcccctgaagagactggagtgggaggggtcaccttccaaactcgttcaggcttcctgcttcctgagctgggtctccaaataagccccgggtcctagttccggctcttctattggctggttgtgtgaccttgagcaagtctgtgcctggcttcctcatctatgaaaggagggtattggaccaaaaggtccctggggtcccctcccgtttgaacattccacgatgctgatagcagctgagaaagagcagacaatggtcacaggcctcagtgaaggagggcggggcaccactttaaatagcccagcccaattcgtggtgggttgggcacagcggggagttcagaaaaggacccgcagcctcatcctgggctgagtcggtagactctgagcctgcagccctgcggcccaggctgggtgactggggcctcgttgccacaccaagcagcctctgagtggcacctgtccccacccagctctacgccaagctgcaggcggtgaaggcggagatccaggaccagcatgatgagtatatccgcgtgcggcaggacctggaggaggcgcagaacgagcagacccgcgaactcaagctcaagtagggcccgcagctcttttcatcccgggtccccacagccagccatcattactcaggcctctcctcccctaaggcctcatcctgactgtctcctctcccatgagtcctttaggaataaaatgcgtctgagggctgagggatgggcccacgtgctggagtttcttctacctcctctgcctgtatttgatgaacccctcaaaatggacgctaggtgctggccaaaagtaactccgaaggccctgaggctaccatctttgcataagaatcagtgattttaaattttttaaaaattatttttagggccgggcgcagtggctcatgcctgtaatcccagcactttgggagccgaggcaggtggatcacctgaggtcaggagtttgagaccagcctgatcaacatggtgaaaccccatctctactaaaaatacaaaaattagccgggcatggtggcgcgcacttgtaatcccagctactcaggaggctgaggcagaattgcttgaacctgggaggtggaggtggcagtgagccgagatcatgccactgcaatccagcctgggcgacagagcgagacaacgtctcaaaaaaaaaaaaaaaacaaaaacaaaaaaggccgggcgcagtggctcatgcctgtaatcccagcactttgggaggctgaggcaggtggatcacgaggtcaggagatcgagactatcctggctaacacggagaaactccgcctctactaaaaatataaaaaattagccgagagtggtggcgggcgcctgtagtcccagctacttgggaggctgaggcaggagaatggtgtgaacctgggaggcagagcttgcagtgagctgagatggagccactgcactccagcctgggcgacagagcaagactctgtctcaaaaaaaaaaattatttttaaatttgttttaaaaattattttaaaaaatgtgtgtatatagtagttgcatatattaatattgatgggatacattagattttttttttttggagatggaatattgctctatcatccaccctggagtgcagtggtgcagtcttggctcactgcagcctccacctcccaagttcaagcggtcctcctgcctcagcctcctgagtagctgggactacaggcgcccaccaccacacctgactaatgtttgcatttttagtagagatggagtttcgccatgttggccagggtggtctaaaactcctgacctcaggtgatccgtcctcctcggcctcccaaagggctgggattacaggcatgagccacctcgcctggccacatgagatgttttgatacaggtgtgcaatgtgaactaagcacatcatggagaatggggtatccatcccctcaaacatttatccttcaagttacaataatccagttacactctttaagttattttaaaatatacaatttgctggcttatacctgtaatcccagccttgtaggaggctgaggcaggtggatcacctgaggtcgggagtttgagaccagcctggccaacgtggtgaaaccccatctctactaaaaatacaaaaattagccaggcatggtggcatgtgcctgtaatcccagctactcaggaggctgaggcaggagaatcacttgaacccaggaggtggaggttgcagtgagctgagatcgtgccattgcactccagcctgagcaacaagtgcaaaactgtctcaaaaaaaaaaaaatatatatatatatacacacacacacacacacacacatatatatacaattaagttattgactatagtcaccctattgtgctatcaaataaaagtatttattcatttttctaattttgtgtacctgttagaagcagtgatttttcaagctgcagtatttctgtagggatcctttccccttaacttcttgattttccccacctccacattgcctctgcctctttttttaaaataaataaataattaattaacttatttttttttgagacggagtctcactctgtcgcccaggctggagtgcagtggtgtgatctaagcttactgcaagctctgcctcccaggttcatgccattctcctgcctcagcctcctgagtagcttgggactacaggcacccaccaccacgcccagctaatttttttttgtatttttagtagagacggaaatggtgtttcactgtgttagccaggatggtcttgatctcctgacctcgtgatccgcccgccttggtctcccaaagtgctgggattacaggcgtgagccaccgtgcccagccccctctgcctcttggcttgttgcttctaatccttcaaccctcacatgcaccacgtggtctctcgctcacccattttcccatcactccttcattcctgctcccaggtacctaatcatcgagaacttcatcccgccggaggagaagaacaagatcatgaaccggcttttcctggactgtgaggaggagcagtggaagttccagccactggtgccagccggcgtgtgagtctctaacccagctgtctgggctgggggacttgtgggtccactccaggtcggggctggtgaggggcctgaggccttgcctgcagggagacagatgttttgtggattggggaaaagatggggaggatgccgatgggggatgaatttctcaggatctaattgtaggggtctctatgatggaagggtgttctgggaaaaaaagtgtctcattggcctgggatgcagaaaataccttgtgagggatctcgggagggaggaagagcatctcagcctcttgacaatcctagcgaatgctaacatctggccaggtctggtgaatattcatttgtcagatgcccgaaatagcaaccacagttaatatttgccaagcgctactgtgtgccggatgctgtgcaagactcaggagacagaagataaattagacatggtccgagctcacagtccagtgggaaataagtaatcagatcatgatgtgatagagctgtgatccaatctcagtgcgctcgctcatccgggtgatttcagcatttccacctgtttccatgtcctagtccttgggtgcagctgcggccattggctgggtgtgtggctccctctgctggtggccatgaagaacatcccaacagagtgaggccttgcccggctgaaccatgggcccttaattgcaaatatatagagagaggtgcttaggaggctggacaccaatgcaccttcctggagattatttgctctctctagaatattaatgttaaaatagggcaagagtctccctaaatctgggatgggaagctagcaagaggtctacagcttctcactgaagcatcagatgcctacttggttattttttttttcctttcttccttttcttttcttcttcttttttttttttttaacaactatagcttagatgcctatttgatctttcttaaaggctgattttacttaaggtgataccacataagtttgtaagtggcaagcacgtgaatagaggacttttcaatggtattactttgcacctacaatccacctttccaatctaggtagagattctcaatagtacatcagctgtcatagaggttttccaccctggctggagctagaatacctgcagagagtctgatttaaagggtcccaggtcttaggttttgtgattctgcatttgaagccaggctagaaaaccactgctccaatgacatttgctggagttggatgctggcgaggcttcactctgaagggttatcttatgcttagaaaagttctttctagctgggcgtggtggctcaagtctgtaatctcagcactttgggaggctgaggcaggtggatggcctgaggtcaggaatttgagaccagcctgaccaacatagtgaaaccccatctctactaaaaatacaaaaaaaaattagctgggcgtggtggcaggcgcctgtaatcctagctactagggaggctgaggcaggagaatctcttgaactcgggaggtggaggttgcagtgagccaagatcactccattgcgctccagcctgggcaacaagagcaagactccgtctcaaaaaaaaaaaagaaaagaaaagaaaaggtctttctgctgggcatggtggctcatgcctgtaatcctgtaatcccagcattttgggaggccgaggcgggtggatcacttggcgtcaggagtttgagaccagcctggccaacgtggtgaaaccccgtctctactaaaaatacaaaaaattagccgggtgtggtggcatgcacctgcagtctcagctcctggggaagctgaggcaagagaatcacttgaacccaggaggcagaggttgcagtgaaacttgctctttcgcccaggctggagtgcagtggtgtgatcttggctcactgcaacctccgcttcctgggttcaaacgattctcgagcctcagcctccccagtagctgggattgcaggtgcatgctaccacgcctggctaattttttgtatttttagtagagacggggtttcaccatgttggccaggctggtcttgaactcctgagctcaagtgatccacctgcctcagcctcccaaaatgctggaattataggcatgagccactgcaccagtccttagaaaagttcttgagtttaaagtttgcaggtgaaggaatttctttacattggatgtagtagtgccaccaatgtgctcaactagttgtgggatgggagaggctttgagaaggtgtgcattaacttttgttgttgttgttgtttgagacagggtctcactctgtcaccctggctggagtgcagtggtgtaatcacagctcactgcaacctcagcctccccaggctcatgtggtcctcctcccagctaatttttttttctttttttttggtattttttgtagagacagggttttgccatgttacccaggctgatctcgagctcctgggctgaagcgatctgcctgccttgtcctctcaaagttctaggattacaggcgtgagccactgcgcctggccacgtcagctttttattttgaaaacaagaattgcaagaatagtataaagaattctcgtatacccttcaccagattattaacattttgccatatcttgctttaactttcccccaaccacttgagattaagttgcagacattttgaccttttacctgtacttccgaaaaatgagaacattcgtgttccacagtgcaatgatcaaactcaggaaattttgtattgtcacaatattattatataggcaatattaaaatttgccaatgtcctttatgatgatttccctccctccccacctgcagtcatgcatttcatttaattgtcatgactctttggtctcctttaatgtggaactgagaagggattttgacttgagtttagcagtttcttgcttcagaggaatttattcatttctcaaaacactctgcaattttgacttgactgcctcaagcacatgatccagactcaaagtgtggcaggtgctttacctgaagttcgaatgagctttctgcataatgattatgaatttccttccctccctccctccctcccttcattccttccctttcttctttctttcccttccttccttccttctttccttcctttctttctttctctctctctttctctctttctctttctctctttctctttctctctctctttctctctttctctttctctttctttctttctctttctccctttctttattttcttccttacttccttgcttgctttcttgctttcttttttcttgagtctcactctgtcacccaggctggagtatataactcactgcagcttcgggctcctgggctcaagtgatcctcctgcctcagccttctgagtagctggggccacaggcatgcaccaccacaccagctaaattttttatcttttgtagagacagggtctcactttgttgcctaggctggtcgtgaggtccggggcttaagcgatccccctcctactgcctcccagggttgggatcacaggcatgagccaccccacccagcctggacttcccctccttatttatgttatttatttatttgtattatttttgagacagagtctatctctgtctgcactcaggctagagtgcagtggtgtgatcacagctcactgcagccttgacctcctgggctcaagtgatcctcccactcagcctcccaagtagcttgaaccagcaggcagtcgccaccatggccagctcattttttcttaaatgttttttaaaagtttgctttcttccaccaggtgttcatgcctgtaatcccagctactctggtggctgaggcagaaagattgcttgagcccaggctattgtaagctaggatcatgccactgtactctagcctgggcgacagaatgagacttcatctctaaaatttttttttaatttactttcttccttttaagtaacccttacttcaattgcaaacaatgttttcattatggaaaatttaaataaacatagaaagaatgaaaattccacctagctagtagtagtgtttactaacaattggatttgaactttccaccatcttttctttttttatacataaacttttctccttttgagggttaaaatggtttgtatatgctgaaaaaaaccattcacagattttaaaaattaaaatagctaccttaaaacagcatactttaattaatttttacagtaatacctataataactttttttttttttgaggcagtctcgctctgtcacccaggctggagtgcagtggcgctatctcagctcactgcaagctccacctcccgggttcacgccattctcctgcctcagcctcccgagtagctgggactacaggtgcctgccaccacacccggctaattttttgtagttttagtaaagacagggtttcaccatgttagccaggatggtcttgatctcctgacctcgtgatctgcccgccccggcctcccaaagtgctgggattacaggcacaagccactgcgtcgggcccctgtagtaactttttaaaaagaaagaagcttgctagaatacagatctttctttattgtgtaaatgttgccaatttctagcccattgtcttttttaccctgatcttctgctttaaaggcaagtttgtgctctttattaaaggattctaatgctctctgctcttgttgcccaggctggagtgcaatggcacaatctcggctcatttcaacctccacctcccggattcaagcaattctcctgcctcagcctccccagtagctgggattacaggcgcccactaccacacttggttaaatttttttgtatttttagtagagacagggtttcaccatgttggccaggctggtcttgaactcctgatctcaggtgatccgcctacctcggcctcccgaagtgctgggatacaggcgtgagccactgcgcccagccttctttctttttttttttgagatggagtctcgctctgtccccaggctagagtgcagtggcgcgatctcggctcactgcaacctccacctcccagactcatgtaattctctagcttcagcctcccgagtagctaggattacaggtgcacaccacgacacccagccaagtttttgtttttgtttttgagatggagtctagctctgtcgtcaggctggagtgcagtggcgcgatcttggctcactgcaacctccgcctcccgggttcaagtgattctactgcctcagcctcctgagtaaccgggattacaggcatgtgcctccacgcccagctaatttttgtatttttagtagggactgggtttcaccatgttggccaggatggtctcgaactcctgacctcgtgatctgcccacctcgcccaccaaaatgctgggattacaggcgtgagccaccatgcccggcctaatttttatatttttagtagagatggggttttaccatgttggccaggctggtctcgaactcctgatctcaagtgatccgcccaccttggcctcccaaagtgctgggattataggcacaagccacctcacctggcccccacctttcctctctgtgattcttcccactgtccttgagcagggaaagttgtgaaaagagagtcagttctttgccagtggaaacctggaaaactctgatttttcctcagaagctatttgctttatttttatttattttattttattttatttattttttgatacggaatctcgctatgtcacccagactgtagtgcagtggcatgatctcagctcactgcaacctctgcctcccaggctgaagcaattctcctgcctcagcctcctgagtagctgggattacaggcacccaccaccatgcccggctaatttgtttgtatttttggtagagacggagtttcgccatgttggctaggctggttttgaactcctgacctcaagtgatcttcctacctcggccttccaaagtgctaggatttacaggcgtgagccaccgtgcacatccaaaaactatttgctttaaatttacctccatagtgttaagttgtattattttgctgttgttgttgagatggagtctcgtctgtcacccaggctgcggtgcactggcaccatgatagctcgctgtgttgcctgggctggtcttgaactcctggcttcacgctaatcctcccacctcagcttcccaaagtgctgggattacaggcaggagccactgcatgcaactggccttaaattttattctttttttttttttttttttttttgagatattctcactctgtcacccaggctggagtgcggtgacactatcttggctcactgcaccctccgcctcctgggttcaagcaattctcatgcctcagcctcctaagtagctgggattacaggcttgagccaccgaacctggccttagttttatcctttgtaaagggactacccagaccaagaattattgaacccaggctgcagctgtgaaaggacaggatttttaactaccagactataaagtagagcagcttttatagtgttttcttttccaagattctttgcaaagaattagtcctaacacacactcattatgcccattaatttaaatctgcatatagttgcttccactttgcatttgtaagtttgtgttggcaactcttctaaatgaataccaattggacagtgttcccttaaattttttttttttttgagatagagttttgctcttgttgcccaagctggagtgcaatggtgtgatctcggttcactgcaacctccacctcccgggttcaagtgattctcctgcctcagcctcctgagtagctgggattacaggtgcccgccaccacgcctggctaatttttgcatttttagaagaggcggggtttcgccatgttggccaggctgatcttgaactcctgacctcaggtgatccactcacctcagcctcccaaagtgctgggattacaggcgtgagccacagtgcccggcctccctgaaattcttatattgaaaatttaaagctataaatagatttacaaggttttccgaaattatggttaagtatattcataacttaaccatgctattttatgcagaatatgtttgtacctgttcagaataaagaccaagtacaacatatgtgaagaaaatatgcaaatacatctgggtagggtaaaaggcaattataggctgggtacagtggctcatgcctgtaatcccagcactttaggagactgaagcaggtagatggcttgagcctaggcatttgaaaccagcctgggcaacatagcgaggccccatctctacaaaaaaatacaaaaagttagccaggcattagcacatgcctgtactcccagctacttgggaggctgaggtgggaggattgcttgaacctaggaggttgaggcttcactgagctgtgattataccacttcactccacctggcctggtcaacagagtgagaccctgtctcaaaaaaaaaaaaaaaaaggcaattatgatttaccaatgttctctactacacttaaatacaaattatatgaacagtaattacagaatgctctaatataataaagaattccaagaaataaattactttaaaacagttattaagaaatatcaggtagctgtgcacggtggatcacacctgtaatcccagctacttgggaggctgaggcaggggaattgcttgaacctgggagacagaagttgcagtgagccgagatcatgccattgcactccagcctgggccacagagcaagattacatatctatgaaaaaaaaaagaaagaaagaaatatcaggtaatcatgaatatattcttttctttttctttttcatttttttgtcactgtccactttgctatgtctgatgactgcaatttgcagtatttaatatttatttcagaactttaaaaaatacaaaaatagaaaaggcaagtaaaaaatggttctaggattttttttttttttagatagaattttgctgttgttgcccatgctaaagtgcaattgcgcaatcttggctcacccctacctctgcctcccaggttcaagtgattctcttgcctccgcctcccgagtagctgggattacaggcatgtgccaccacgcctggcaaattttgtaattttagtagagacggggtttctccatctctactctccatctccagcctgttggtcaggctggtctcgaactcccgacctcaggtgatccgcccacctcggcctcccaaaatgctagtattacaggcgtgagccaccgtgcccggccagttctaggattttttatatgaaacaagtttttaaaattactctttttaaagccaagataagatggttagaataaagtaaaaacaattccacggtaattgaaatcccagttgtgattctgacttagcagagagagtctggtggggcacagtagggggcagggagctgctggcctggatctctgaggtcatctgccccatgtccctcatttcaccacagaaggttgagggcagggaggtccttgaacaaggcagctttcctcatttcaggaaccatggggtctgaggctgcagctgtgaagcaaacttctccactccccagagaaaaggtcctttcttcagcattggatcccaccacttgccgcatcacttaattagggctaaaaaacaaacagaaaagttatttctctccaaagcatatttaactaattagggcgttgttccatttgctcaactcaagtgtggaatattttgctttatttcggcctgtggtattctggggatgagaacactaagagctgctcgaagtgagaggaaaaaacattgtttgtaagaaattacctgaagtcatgctgtcccattagaaagcttctgttcaaaaaacattcttcctccacctactccagctctaagcatccatcccaccctctgaccagtgcctctctctcaaacaaggagttgtcaggcagctcttgagaaatattcctaatcaacttattttggaagtttagccctttcttttttttctctaccatctccatgtagccattatttgatataaaataatataaggtgaggtgccttccacagtcataatcttgtataatattaaagttactttaaaaaacatttttgcactggcgcggtggctcacgcctgtaatcccagcactttgggaggccaaggcgggcagatcacctgaggtcgggagttcgagaccagcctgaccaacatggagaaaccccgtctctactaaaaatacaaaattagccaggtgtggtggcatatgcctgtaattccagctacttgggaggctgaggcaggagaatcgcttgaacccaggaggcagaggttgcagtgaggcaagatcgtgctattgcactccagcctgggcaacaagagtgaaactccatctcaaaaaaaaaaaattttttttttgcaactaggtctagcaataaatattttacaagtacaaccttttatttttagtttctcataatagaccgtcgcctaagctggagtgcaatggcgtgatctcagctcactgcaacctccgcctcccaggctcaagcgattctcctgcctcagcctcccgagtagctgggattataggcatgtgccaccacgcccagctaatttttgtatttttagtagagacagggtttctccatgttggccaggctggtctcgaactcctgacctcaggtgatccgcctgtctcggcatcccaaagtcctgggattataggcatgagccactgtgcccaacctagatttttaaattttatttaatttttatctatttttttgagacagggtctcactctgtcacccaggctagggtgcaatggcatcatcttggctcactgaaacctctgcctcccaggctcaagcaatcctcccacctcagccccctgagtagctgggaccacaggtacatgccacgaggcccagttaatttaattttttgagacaaggtctcactctgttgcccaggctagagtgcagtggcacaatcttggctcaccttcttggctcaagtgatcctcccacctcagcctcctgggtagctgggacctcaggcttgtgccaccatgcctgactaattttttatttattttagagatgaggtctcactacattgcccaggctggtcttgaactcctggattcaagtgatacccccatctcagcctcccaaagtattgagattacaggcgtgagccaccacacctggcctagactttaattgtgtttaggtaaaattgtcttcttcttctttttttttttttcaaatagagacagggtttcactatgttgcccaggctggtctccaactcctgatgtcaagcagttcacccacctcagcctgggattacaggtgtgagccagccccacaaaattgtcttctaaagggtgatatatgtgacagcatccataccctgtggtttatggtacacaaaattccattgcaactttagccctttgacctttgtaaccccagccaccctagattcttttctttgtttcttttctttctttttttgagacagggtctcactgtgttgcccaggctggaatgcagtggcacaatcatggctcactacagccttgaccttctgggctcaagtgatcctcctgcttcaacttcccgagtagcttagaccacagtacagacatggaccaccatacccagctaatttgctttcatttttagtagagacgggggtctcactatgttgcctaggctggtctcgaactcctgagctcaagtgaactcctcccaaagtgctgggttacaagcgtaagccactgtgcccagcccctagattctttttaaaggcatcatggtgcagtagagagagactagactttggatttagaacattctgaatttggccgggtgtggtggcccacgcctgtaatcccagcactttgggaggctgagacgggcagataacctgaggtcaggagtttgaggccagcctggccaacatggtgaaaccccgtctctactaaaaatacaaaaactagccgcgtgtggtagtgggcgcctataatcccagctacccagaggctgaggtaggaggagaatcgcttgaacctgggaggcgggggttgcagtgagctgagatcgcaccactgcactccagcctgagcaacagagcgagactcaaaaaaaaaaaaaaaaaaaaaaaagaacattctgaattctagcccctgctctgccacttactagtggccttgagtaagtttttttctgttgtttttttgttttttgagatggagtctcactctgtcgcccaggctggagtacagtggcgtgatctcagctcactgcaacccccactcctgggttcaagcgattcttccgcctcagcctccagagtagctgggattacaggcatacgccaccacacctggctaatttttgtatttttagtagagatggggtttcaacatgttggccaggctggtctcaaacccctgacctcaggttatccacccgcctcagcctcccaaactgctaggattacaggcgtgagccaccatgcgcctggccttgagtaagtttttttaacctctctgaacccaaattttttcatctgtaaagtggggataacaatatgtaccttgcaggactgtcaaggttgaaatgaaataatgtaaggttccaggcctgtgcctggtgcggaggagatgatcaatgaagagttgcactcacactgataaaccaatattctaattatggggactctggagaaaccggcctgctctatcccttagaagtgccctacaagggcagtttgactttatgtttttgttttagatgttgattttttgttaaactgcctctgggtttattttatttatttatttattttcatttttatttttttgagacagagttttactctgtcacccgggctggagtacagtggcacgatcttggctcactgcaacctccacctcacaggttcaagcgattcttgtgcctcagcctcctgagtagctgggattataggggtgcaccaccatgcccagctaatttttgtattttagtagaggcagggtttcaatgttggccaggctggtcttgaactcctgacctcaggtaatccatctgcctcggcctcccaaaagtgctgggcttacaggtgtaagccacctcacccaggctctgcctctgggtttaaagagagagtgtttcttgctataaatagaatcaggaaagaaagttaaactggttttgtcacagaggcaaagttcaccccagtaagaacattcctagctctgcgttgagtccctggatttcttcacagacctgtgagaattgaagacagtgtgaagcagggagcagttgcagcttcccaggcgggtcggggacagcatggaggggaaatgggaaggctgagagttcagacaagcagggcagtggaacaaggtggacagatggcctaccaggagaaagcagccagatcgaagaggaaagcctgactgtcagtgttgaatgcacaggaaggaactagaaggaaacacacccgatgatgtcggatgcctgctttcagaacaagagggggaggccagccgcggtggctcacacctgtaatcccagcactttgggaggccaaggcaggtggatcacttcaggccaggagttcgagaccagcctggccaacatggcaaaaccccgtctctactaaaaatacaaaaattagctagatgtgatggctgtcacctgtaatcccagctacttgaatctgggaggcagaggttgcagtgtgccaagatcttgccacggcactccagcctgggtgacagagtgaggaagggagggagagagggagagcaggaaggaaggagaggaaggagaggggaaaggaagtgatcaaacagccaggaaagagaatgatgtcaacccctgagatggagctgagagatgactttttaatattaaaggggaaaaaatgatagtagccaattacggagggagggtcctaggagaacgcgtcagatgtactgcacgcaggataactgtggttgtggggccctgctgggaggggtgcttaaagggaggggtgcataaacgcagacccaggcctcagctccgggctgccaaaacctgcttcctacagaggatcaatcatggaaagtaggcctggggcagaagagggagccgatgggaaggtcggtgccccaattacagactcccttcccccaacccttctctcccacatgccacccagaatagccctggcatctttattgggtcaggctgccaatttgcgctgatcctctgctcacccagccctgtccctctgtcctgttcccagcgcctgagctttcaaaggcactcactggcccatctgttctggcccagtgtcctcctgagagatgatactagagtccttggggggaacccccaccctgtggcatagaatgaggtgttgcccgattcaaaaatttcacaaaataatttttttttttttttgagactcagactcactctgtcgcccaggctgaaatgcagtggcacgatctcagctcactgaaacctccatctcccaggttcaagcaattctctgagtaacctcctcagtagctggggttacaggtatgtgccatgctcagctaatttttgtatttttggtagagagggggttttaccaaattggccaggctggtcttgaactcctgacctcaggtgatccacctgtcttgtcctcctaaagtgttgggattacaggtgtgagccactgtgcccagccacaaaataataataattttttttttttgagacagagtctcgctctgtcacccaggctggaatgcagtggcatgatctcggttcactcaacctccgcctcccaggttgaagtgattctctcacctcagcatcctgaatagctgggactacaggtgcatgctaccacacccagctaatttttatatttttagtagagtccgggtttcaccatgttggccaggctggtcttgaactcctgacctcaggtaatccacctgcctcagcctcccaaagtgtgggattacaggcgtgccgtgagccaccacacctggccaataataattttaaaaggagtatatgggaagattcagattcctagtctctccctaattgcatgaccttggacacaaaaggcgctgcacctccctgagcctcagtcttctttgctctatccacacctccggaggttgttaagttcagatgaactgtgtagaagcacgttgtaaataagttgccattttcctaattttcccactcccctcttagaggggatggctctgcatttccagcagcgtctgcagcaggactgtctccttgctgccactgccactgaggctgcctctcctcacgggcacgcctcccggcatcctgtaagctcagctgcagacccagctggggcttctggagccttatctttccttgttttcatctatagagagggtcagcagggaccactaatggggtacggcacctttttatatgcatcataaactaaaccacaagaatgttatttcccatcactgccagctgcagaaggcagccattgttctgtgggcccctgcacagcttgttctgctgttcaaggacagaatgtcctaagctttgagttactcggcctgtttcttctcctcttccaactgtcgccttttgacttttatccttgctcatttcatttgtatccccacttgaaattagcaagtggaattgaaaataaatcataatcacagctgccatgtgttaagccctgtggcaggtgtactgtgctaagtgcttgtcttgtttaatctcagaaattctgtatgatagggatgatatatctgaggctcagagatagtaagccacttccccaagtaaaagagcttgaaggggcagagccagcattcaaacccaggtctgccttactccaaaacctgtgttcttttatttttttaaatggaagtagctttcttgttttctttcctttcttttttctgtttgtttttgttcagggtagtaaaagtattttaataatccatcacactcaccaaattgctgaaagtgaatagcactcaatgagctctctaggatgtagaccaatggaaacttccataagtgtaatcactttgaaaagcaattgacaatatcaagtaaagctgaaaatccacataccctgcaatgcaacacttccattcctggatccataccccagggaaaatgttaaatataagcatgaaaatacctttagaaatgttcacagcagcattctttacaaaactggatggcaggcatacagatacatatttcctgtagatgtttgaactaattaattagtataaagttatacatattcattgtaaaaaaatttttgagatattgcagaaaggcagagagaaaataaaaatcacccataatcacacaattcaaagattataactgtcaacattttgttgaatatctagactttttcctaagcagacacacacacacgcatttccttaaaactggccaggtatgctggcttatgcctgtaatcccaacacttggggacactgaggctgggggatcacttgaggccaggagtttgagaccagcctggacaacatagcgagaccccatctctacaaaaaatttaaaaatacaaacaaaaacttcatctttttatttgctcttttattaatatattgtggcagtctttctgcatgtatgtagagccacacacaaatttttttgttttgttttgttttgttttttttttttgagactgagtctcactctgttgtccaggctggagtgtagtggcgtgatgttggctcactacaacctccgcctcccgggttcaagcgattctccagtctcagcctcccgagtagctgggactacaggtgtgtgccagcgtgcctggctaatttttttttttttgtattttttttagtagagatggggtttcaccgtgttagccaggatggtctcaatctcctgacctcgtgatccacccaccttggcctcccaaagtgctgggattacaggcgtgagccgctgcacccggccgagccacataaaaattttattgactacataaagttccttcataggactgaatagtaatgtaactgggtcctaataatttaaccaaccccattttggttgtttctaattttttgcagttgtaaataatgcttcagggccaggcacagtggctcatacttaaagtcccagcactttgggaggctgaggtggaaggatagcttgaggcaaggagttcaaaaccagcctgggcaacagagtgagaccctgtcaaaaaataacaaaattagccaggtgtggtggcacctgcctgtagacctatctactcaggaggctgaggcaggaagactatttgagcccaggaatttgaggctgcagtgagctatgatgttgccatcacactccagcttgggtgacagagcaagactctgtctatagaaaaaaaaaaggcttcagcaaatacccctgcatgtaaatttttctctttacctctgattatttgcttagtgaagttcctaggaggagaaatttgggtcaaagaatatgcatttaaaattttattatttatttttttttaagactgagtctcactctgttgtccaggctggagtacagcagtgtgatctcagctcactgcaacttctgcctcccaggttcaagtgattcttatgcctcagcttcccaagtagctgggactacaggtgtgagccaccatgcccggctaatttttgtattttctgtagagacggggtttcaccatgttggctaggctggtctcgaactcctgacctcaggtgatccacccacctcggcctcccaaagtgctgggattataggcatgagccactgcgcctggccataaactttttttttttttaaattagagctgggatcttcgctctgtagcccaggttggagtgcagtgactattcattggcacaatcatagcacgctacagcctcagactcctggcctcagatgatcctcccacctcggcctcccaaagcgtggggattacaagcatgagtctctgaggctggcctgtttgttcattgtttaaataacagctctgttgagatgtagttgacctatcataagttcaccattttaaagtgtacaattcagtggatttttttttagctctactgcttaataatgtagtggattttagtatattcagagttatacaaccgtcaccactatctaattccagaacattttctttctttttcttttttttgagatggagtctcgctctgtctcccaggctggagtgcagtggggtgcgagtcggctcactgcaacctctgcctcccgggttcaagcgattctcctgcctcagcctccttaatagctggaattacaggcatgcatcaccacccctggctaatttttgtatttttgtcagggaaagggtctcaccatgttggtcacgctggtctcgaactcctgacctcaagtgatctgcccactttggcctcccaaagtgctgggtttataggcatgagccaccacgcccagcctaattccagaacattttcatcactccaaaaagaaaccctgaaccaattagcagttactcctcattctcctcaaaacccctttccccagacctagacaactgccaatctactttctgtttctatggctttacctattccagatattttatgtaaatggaatcacacaatatgtagtccgttgcgactgagttcttccacttagcaaaatgttttcaaggttcgtccatgttggaacactcatcagtacttcattcctttgtattggtgagtaatattccactctatgaatataccacatttggtttatcaacacatcagttggtggacatttcggtaatttccactttttggctattataaataatgctgctatgatcatttgtgtacaagttttcatatgaatacatgttttcaattctcttgagtatatgcctagtagtggaagtgctgggttatatggtaagtctatgtttaacttttttttttacattctcactaatagtgtatgagggtttcattttctctacatcctcaccaacatgtgttactgtctgtctttaaattatagtcatcctagtggatctgaactggtatccattgtgggttttttttttttcttttgagacaaggtcttaaccctgtcacccaggctggagtgcagtgacatgatcacggctcactgcagccttgacctcccaggctcaggtgatcctcccacctcagcctctcgagtagctgggattacaggtgtgtgctaccataccctgctaatttttttttgtattttttgtagagacagggtcttgctatgttgcccaggctggactcaaatttctgggctcaagggatccacatgcctcagcctcccaaagtggtgggattacaggtgtgagccaccacacccagccaccattgtggttttgatttagatttccctatatgactaataatgttgaacatcttttcatgtgcttatcaaccatttgtatatcttctgagaaatatctattgagatcctttgcccttttttttttttgaaacggagtcttgcagagtctcactctgtcacccaggctagagtgcaatggcgtgatcttggcctactgcaacctctgcctcccaggttcaagcaattctcctgtctcagcctcccaagtagctggaattacagatacatgctgccacgcctggctaattttttgtattttactagagacggggtttcaccatgttgcccaggctggtctcaaactcctaagctcaggcagtccacctgccttgggctcccaaagtgctgggattacaggcatgagccatggtgcctggccctggagtttcagttctatttcattaatctatatgttcgtcttatgcaagttctatagtatcttggttactatagctttgtaataagttttgttttgttttgttttgttttgttttgttttgttttgtttttgagatggagtctcactctgtcacccaggctggagtgcagtagccagatctcagctcactgcaacctctgcctcccgggttcaagcaattctcctgcctcagcctcctgagtagctgggactacaggtgtgtgccaccacacccagctagtttttgtatttttagtaaagacagggtttcaccatgttggccaggctggtctcaaactcctgacctcaggtgatccgcctgcctcggcctcccaaagcgctgggattacaggcatgagccaccacacctggcgctttgtaataagttttgaaactgagaaatgtgaggcttctaactttgttccttttcatttcaagcctgagtttttaaccattttattatgctaactcctatgaagaaaaataggctgggtggagtggctcatgcctataatcccagcactttgggaggccgaggcaggaggattacctgaggtcaggagtttgagaccagcctggccaagatggtgaaaccccctgtctctactaaaagttaaaaattaccggccaggcgcagtggcctatgtctgtaatcccagaactttgggaggctgaggtgggcggatcatgaggtcaggagatcaagaccatcctggccaacatggtgaaaccccgtctctactaaaaatacaaaaattagctggatgtggtggcatgcgcctgtaataccagctattcgggaggctgaggcaggagaatcgcttgaaccagggggtcggaagttgcagtgagccgaggttgtgccacagcactccagcctggtgacagcgagactccgtttccaaaaaaaaaaaaaaaaaacaaaacagaagaaacaacacacaatgaaggctgggtgacagtgagactctgactcaaaaaaaaaaaaaacagccaggtgcagtgattcacgtctgtaatcccagtactttgggaggccaaggcagggagatcacttgaggtcaggagttcgagaccagccaacatggtgaaaccctgtcctctactgaaaatacaaaaattagccgggtgtggtggtgtttgcctgtaatctcagctgctcaggaggctgaggcacaagaatcacttgaactcaggaggcggaggttgcagtgaactgagatcgcaccactgcactccagcctgggtgacagagcaagactttgaaaaaaaaaaagtatataaagctacaagctaaagtgagactggatttcatttcagccttcaatcagtcctttctactgcagaaacaatttaaagcaacaggagtgaagaaatattaatatgtacctctttgtgttacacagtagtctccacttatccatgggggatactttttttgttttgttttttgtttgtttgtttttgagatggagttttgctcttgttgcccaggctggagtgcaatggcgtgatcttggctcaccacaacctccgcctcccaggttcaagcaattctcctgcctcactctcctgagtagatgggattacaggcatgcaccaccatgcccagctaattttttgtatttttagtagagatagggtgtcttcatgttggtcaggctggtctcgaactactgacctcaggtgatctacccgtctcggcctcccaaagtgctgggattacaggtgtgagccactgcacctggcaggggatacgttttaagacctctagtggatgcctgaaactgcagctagtaccaaaccctatatatgctatgaggtttattttaaattttattaatttttttaaattgttgtgggtacatagcaggtgtatatgtttgtggggtacatgagatgtataagacaaaacaattataacaatatactctaataaggctgggtgcagtggctgatgcctataatctcagatctttgggaggccaaggcaggcagatcacttgaggtcaggagttcgagaccagcttggccaacgtggtaaaaccccatctctactaaaaatacaaaaattagccgggtgttaggccaggcacggtggctcacgcctgtaattccagtacatcgggaggttgaggtgggtggatcacctgaggtcgggagttcgagaccagcctgaccaacatggagaaaccctgtctctactaaaaatacaaaaaattagccaggcgtggtgccacatgcctataatccaagctactcgggaggctgagacagaagaatcacttgaacccgggaggcagaggttgtggtgagccaagatcatgccattgcactccagcatgggcaataagagcaaaacttcgtctcaaaaaaagaaaaaataaaataaagtaaaattagccaggtgtggtggtgcatgcctgtaatcccagctactcgggaggctgacgcaggagaattgcttgaacctgggaggtggaggctgcagcgagctgagattgtgccactgcactgcagcgtgggtgacagagtgagactccatctcaaaacaacaacaaaaacacaatatactctaatagaagtgatgcaggtgtgtctgtctctcgaaacatctgattgtactgtacttgcctattttcagaccacagtaactgagactgtggaaagcgaaaccacggatgagggggacaactgcactagcttcagttgtcaagctgtattagagcaaggagaagaaaattccagaacttgcagtctgcagggcctcctagctacctgaatgatatttaggtcctcatgatgtcatttgctgtttgtgttccacagaaatcctttctaatatagcctctttcctacagcagtagcagccagatgaagaagcggccaacatctgcagtgggctacaagaggcctatcagccagtatgctcgggttgccatggcaatggggtcccaccccaggtacagggtaagaagcggagaggggagaaagagcctacgggagggaggccgggcgaggtgtctcacacctgtaatcccagcactgtgggaggccgaggcaggtggatcacctgaggtcaggagttcgagaccagcctggttaacatggtgaacccctgtctctactaaaaatacaaaaattagccaggcgtggtgatgggtgcctatagtcccagctacttgggaggctgaggcaggagaattgcttgaacctgggaggtggaggttgcagtgagccgagattgcaccactgcactccagcctgggcaacagagtgagactccatctcagaagaaaaaaaaaaaagagcctatgggaggggatgctcacagcctctgcttcccctaaccacctcatcagccctgctacacccaagactggctgagtccctagaaggcacagtgactgggcactgttcaagcctggcatgatattcccaccacaggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtcagtacctccatggtcccaggcagcactggacccaggaggcaggggaactgcaggcgctgggtgatgctaaagagggttttgctggtacccgaagggcaggaagggcaaggggtgactggggatgtcagaaggattcctgcagcaacaggatggggcaaaggagaggacccactttcctgtttcctgtatttccctaacctcccctttcgcctgcgtcatctcccctgcaggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccgcagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcacggagttgactgccttacttctcttccctttgtttcttcctactttaactccctccctttttcattttctcctttctctctcttccatgtttttccagtaggggctcaagagtatatcagccagacgtggtggctcacacctgtaatcccagcactttgggaggcccaggcaggcagatcacctgaggtcaggagtttgagaccaccctggccaacatggtgaaaccccatctctactaaatatacaaaaattagcctggtgtggtggcacacacctgtaatctcagctactctggaggctgaggcaggagaatcatttgaaccctggaggcagagcttgtagtgagctgagattgtgccactgcactctagcctgggcgacagagcaagactccatcccaaaaaataaaaataaaaagagcatatggattccagctgcagttatcagcactttggaaaagaactggttgcttaataaatggagatctgtttgcccaatagggctggggagcaggtcccaggcactagtcggaagtctgtgccgggactatggcagcagctgtttgtgttctaggctggtcgtccccaaccagttaattctgagcaactggcagatttcagaactgcctcagtggtgtccagattagctgtcactgtcatactccctatgccctcattgatccaccaaaggggttaaaggaggaaagaatgcatgtaaaccacacagatgtgcctgggcctgatgggtgctgaattacaataacttgaaagtctaggccgagtgcggtggctcacgcctgtaatcccagcact

SEQ ID NO: 12071 - DNA, 11543 bp, Human
gagagatacagtacatggaaatcattcacctgtctacgtacaaaaataaatagaaagaacagaggccgggcacggtggctcacgcctgtaatcccagcactttgggaggccgaggcgggcggatcacgaggtcaggagatcgagacaatcctggctaacacggtgaaaccccgtctctactaaaaaaaaaaaatacaaaaaattagctgggcgtggtggcgggagcctgtagccccagctactcggtaggccgaggcaggagaatggcgtgaacacgggaggcggagcttgcagtgagccgagtgagccactgcactccagcctgggtgacagagactccatctcaaaaaacaaacaaacaaaaacaaacaaaaaaagaacaatcagagttggcagctcagaaagagttaaagaggtatatacatatatgtttactgtgtgtgtgtatgtgtgtgtgtgtgtgtgtgtttaggtatcttaaatatttaagcctggagttcttgaagtaaacttgtatttgttggatttttatttctaagtcagtgaactaagatgaaaaaaaggacaatgactgatggacgtattctcaccaaacagggttctaaaaacttagaacctctaacttccaaataaaggtggttgtgttagtaatgaaagtgtagtaataatccctattgcacattctgtcataaatttgtactctctcaagagaaaaactaaaagcaaacccctaatctcctatattttgaggcaattttacatgggggaaaaatagtatcagacaggtttcttccagaccagctttttctaacactaaaaatgaatagatttcaagtaagcaaaggatttttaaataaatcacttcaactaagatttgcatacagtctggatgaagtagattttacgcttatattcttcagtgaggatttatagctcaacaaatttgttggtgcaatgaaagcagctctaggcacacaatgcaaactgaaaagatggaaagttttgacttcataaaaactgagaagtcaaagtagtcttttctttcatttttttctgttgttggttgaaagcccatcttttacaaaagggtttatctatagtaatattataatgcttgaacataaacaatatacaaaatataatacacaaaacgtttatttgagtgtctgcttttgtatgggggtgcatggtagattgtatttccagatactaaatcatggatcgaaatctctcctttcaagattcttattatagccaatctcttccacattggaaatttgacctgttccacatttgatattcctattaacaaggttactcttctgtagatgaaaaagtgtatatcgaagtatcagtatagtatctgaattagataacacactaaacaatataataatgtattagtaaaaataaggaaaataaagaagctgaagtcgtgcttaaagaactttaagaaaatgaaaattgaggtgttgaaaaaagcttttaaggctaacgtgaatgaggcgtccaagtgggaaacccatccagttctacttttttgaactttgcctgtcgtggccaggataattaggtagagatcagaagaacagagtgagacatggaaatcccaatttatgtgaccttgggcaaattacttagctctgtatgcctcagttttctctttgatagattgaagatatttatatatctttactatcaagccatttacagaaataaatgagctaagatatgccaagtgctttaaattgtgttaagtacaaggtaaataataaatgtttattattaaaagaggaaaattctgtaagtaattttgttatgctaagtaaatttacctttggtttgcccatcatttccttcattttccagataaccctttaaaatgaatttgattttcaaacaataaaaaacaaaacagcaacaaaactccctctgacctcctctcaccttctttagtccttgccaaagtgttaatattgcaaaagtactgtgagaatttcctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcaggtatgtgtgatttcagtcactaaattaaaaataaccagaaaagctatttcttggattggctgattttggggtaatgctttaagagaaaaggacatgattaacagtggatgtttttaggattttcatgcattagcactttccacattcattatattttcctgattcttcattgtataacttagacatgatttcatgaagttttttccacaggtttgaagagtggtttctgacagggctacctttaaattctgagtgagaactgaactttagcctggttaaattgtgagcaacagtgttctagtatagcaatagaaaatgccaaatattaatgacacaatgctgaaaaggttttaattgactatttatgttgtgacatccaaaaattacacaaatgaacagtttgacacattgtactgttgttaatgacatcactctttgagagtgtgttcacgttagcacagaatctcctaatgttgaaatgttttaggtgaaaggcctaaaagcaagtaattttgagtatgaacaaatggaatgttctaggggaaaaaggattgtttatgtatgttcaatatactgtgaaatgaagccaggcctcaaagttgttacccatcaatttgttatcagttatcacaccaagtccagaatgttcctatgtcttcttttccctataatatctctacgaaccaatgagcagctagacatttatcagagcaaaacctgcactgagatgaggagagggcatactctcaactagtattattgtgacaatggtagactacgttgaatgaaagattcttgagctagacacactttcatgtgatttctgacttggatacttacttgctttgataccttgagaaaataacattattattggaccttatgttttctcatctatgtaatgagaaccatactatctatcttgtgattttgttgagagaataaaaataaatgcctgttatgtaagtccataaaacacaacgtggtgcttgttaatatcttctacctccagatctttaagcacctctgccaatttaaaataaatggtaaattcactttactgcaacagagctggtagagaagaaaatgtttgaataatcttcctgaagaataagatacatcacataaaaatgttggtattgggtgaagtcccgattggaaagtcttcagtgttttattggcaagatgactccgttatcgaatgaaagaatgttgtggattctccgtcactagtttctgcttttaagaactcagctcctgagtttgctctttaagtcattactctgtctgtctttctctacagtgtttaagaccactctgtggaggttaatttctgggaccttagggataatatgcctttcgttgatggctacgttgggaattttgttgaaaaattgtaagtttttctaagcaagtctccataaaaatcaaaactgtgaagacatcatttaataataaaggcttcatcttgctaatgtgtaatattttagtatttcataaacccatacctaattaaacaaatttctaatcatttcttatagcttttactaaactgagtattgagccagcatttactccaggacccaacatagaactccagaaaggtaggtcacattttttggaaaacttagcattggtaaaagattaaataggcagtttcttgtttttcacacagagaggcatgatggaatattatacttagtaatagaaatttgcctaccagtgtaggatagtctcattttacattgctcaatctaatgtaaaaatgattaaattacactgaatgtgtatcatttgtacatttaactaatcaggaaaatagtagcctgaaacgaaagatatgtttcctatatgagtgctcataattaagtaacaaaaaataaaccacaggaaatgttacagttaatcctcattacctgcctgaatttgcttataacctatacttttgcatctcactacttttccttttccagaatatactgcacagatttctaaaccttacttatccagtgaaagccagctcaaagtccaattttcgtttttggagatggagttttgctcttgtcgtccaggctggagtgcagtggcacgatcttggctcactgccacatcagcctccctggttcaagtgattctcccaccttcctgcctcagcctcccaagtagctgggactacaggcgcccgccaccatgcccagctaatttttgtgttattagtagagtcagggtttcgccatgttggccaggctggtctcgaactcctgacctcaggtcatccacctgcctcggcttccaaagtgttgggattatgccgtacccagcagagccactgcgcccggcctcaattttctaaatatgtatttttcggaatgcgccccaagttgtctcaccatcatcttgattatatagtgtttatttacagtgcaacatcttggccaggcacagtggctcacgtctgtaatcccagctctttgggaggctgaggtaggcatattacttgaggtcagaagttcaagacaggccaaccccgtctgtactaaaaatacaaaaattagccaggcatggcggcacgcacctgtagtatcagttactcaggaggctgaggcatgagaatcacttgaacctgggaggcggaggttgaagggagctgagatggtgccactgcactccagcctgggcaacacagcaagactctgtctcaaaaacaattaaaaaatataaaaataatagtgcaacatcttcagcactacttatatggcaaagatttgagtgcctatgacgtgtcatgtttttattaccgtgggtaacaaacgttgaagacactattattgataaactgtataattaagcctcaagataattggtttatttatattcccttttcaaaaataagatatccaaacatatatcaaaattctccaaatgtaccatattcttttctgactcagaaagtatgctaaaatgttttcctcctttaaatctttttcatctagttaactcctatttatgctacagtacttagttttgagtcacttcctcaaaaaaaggttcttgtaactgcccctcatcttacactctgctacatgctgttttaacatacttaatttttttgtacttatctaaatcatcactaaatatcgttaataaattattgaaaattatataattgtaattctatctctagaatataatctccatgaggaaaaagcatcatgttcatgtctaattagttcacattagtagcccctgaagtgtggtgtatacagtagattctgaatgttaaaagaatacacagcaaataatttttgaataattaaatagcattgaaaaaaatgtctagtctccagtgtcattagtcatgctttatgttttctgtcagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggcatgtgctgagtctgattttctacattttctttgatctagaaaaatatactatctaaacaagttaaatactttggtttaagtcattaatcacatagtaagtggatggttatattggaattgagttatctgttctgtgtaccttaaagtagtcattgtaaaatctttattaaattccttaatgattatatcatgggaatacaaatcaagataggtgccaaataaagtgaaagaaacttttcaggaagaattcaaagaagataataggtcattatatttacccattttatttgaagaaccaactaaatgactgtgattcttaactcttttaattgaatttataatatcttttataattttatagtttttgtcatctttctgggatataagctagtatggaaatatggtaagaaaacgtacccaattcttttcttttcttttttttttttttttttgagacagagttttactctgttgcccaggctggagtgcactggtgcaatttcagctcactgcagcctccacctcctgggttcaagtgattctcctgcctcagcctcctgagtagctgggattacagacacctgccaccaggcctggcactttttgtatttttagtagagacagggtttcaccgtattggcgaggctggtcttgaactcctgacctcgggtgatctaccctccttggcctcccaaagtgctaggattacaggcatgagccaccgtgcctggccctaattacccaattcttttttgtttgtttgtttgtttgtttgtttgagatggagtctcgctctgtcgcccaggctggagtgcagtggcgtgatcttggctcactgcaagctcctcctcccgggttcacgccattctcctgcctcagcctcccgagtagctgggactacaggcgcccacaaccacgcccagttaattttgtgtatttttagtagagacgcggtttcaccgtgttagccaggatggtctcgatcttctgacctcatgatctgcccacctctgcctcccaaagtgctgggattacaggcgtgagccaccgtgcccggcccctaattacccagttcttaagaaaaagtgcggccgggcgcagtggctgaaacctgtaatcccagcactttgggaggccgaggagggcggatcacagtcaggagatcgagaccatcctggctaacacggtgaaaccacgtctctactaaaaatacaaaaaattagccgggcgtggtggcgggcgcctgtagtcccagctactcgggaggcggaggcaggagaatggcgtgaacctgggaggcagagcttgcagtgagctgagatcgtcccactgcactccagcctgggcgacagagcaagactccctctcaacaaaaaaaaaaaagaaaaagcgaaaaacttctcctgctgcacgtggcacctttgcggattataggttgagtagattatacccatgggattcctccttcacaataccatgattttggaatcaaatttaatctttgatcccccgtgaagaaagtgttccatgaaaactctatctccttttagaaggtttttaattcttcaggaagtgagattttgtggtattttttctccatatatgaatgggcctgataaatgagaactttcagtcttgtgattataccttttaaataggaagttaaaaataatttccgtttgtgtgatggacaggctgaatcttattctaaacactgactttccctcaaaatatgttattcccagaatagattaaaattagattaatgtgattgtcttttacttgaagcaggattttatgagctccagtcaacaattttactggattggactctcttacagtgaggagcacaccgcctggttgtgggagaatggctctgcactctcccagtatctgtaagtttctggcaatcatggcgttttttgctctttatgaatttgtccttaaatgtgactagtaaaggtaacatccaggagcactgtggctgaaataaccttgtctagggcatgagaatacagtaaaaggaaaaagtacaacaaaataacaattttagatctaggcagatctaaaccactctaagtgttaaaatcaaaacagaagataatgcctaatgaaaggaggtcggggtataggatagttggtgcaaaaaaatactgataaccattacatgcttgcctgtattattttaaattttttaattaaaaatatattattttgtagtcacatggacaacaaaaccaaaacattacaaatctccagaaagtgcaatgcataagctctcttagttcaaattaaacatttgaaaggtattatatttcatcctatatcttttgtcagttaactgaagtgcatttttcctaaatcaatcttcatacaagaatgtgaagagggccagggatggtggcttgagcatccaagttaatgctcaagtgacatgaaatttagtgtattcgtggccataaaagaacttttaacatatgctttatttttgccttagtaccagcacttggaagtatatgtgcatgtacagatactcatatacacagaggcagtccaaaaaaatagtatatttattattttatttattctggtagaccccaatattctcagcatgctcttatgttttatatactatagactcattgtctgtatgtgtgtactttttgaatctcattttcatttataaacatgagatttgcagcatcacacagggacaaagtttatgctctggtttgttttcctagactagattagataatacatcttaaataaaatagaagaaaagcatatcacatatttaaaccattaatgacaacagaaaaacagcaaggaaaaaatccctggcctcaatgctattgattagtgagaaaataactgggtattttgtagcattacactagaaaatcatgaaaattgtggttactgaaaaaaaaaggactcaatatgttagtatctcactcaaatgcttttaaaatttatatcatttaattgaaaaatgccctgaacattcttacttcctttttgtgtatgtgaacattttcttcttcattacagatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgaatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataatacaggcaagcatgtaatggttatcaatatttttttccaccaactatcctatacccctgacctcctttcattaggcattatcttctgttttgattttaacacttagagtggttttctctgttatgaatcaaagctgatctattttcatcatttttgtgatgaaaaaattaattttgattgacttaggatggaaggatttggactgggtgtggtggtttatgcctgtaatcgcagcactttgggaggccaaggcgggtggatcacttgaggtcaggagtttgagaccagcctggccaacatggtgaaaccctgtctctactaaaaatacaaaaattggctgggtgtggtagtgcacacctgtaatcccagctatttgggaggctgagtcgagaggatcgcttgaacctaggaggcggaggttgcagtgagtcgagattgcaccactgcactccagcctgggtgacagagccagactcctctccaaaaaaaaaaaaaaaaaaaaaagatgaaaggatttggaaccttaattgcatctgaaaaactgcctcacctttgttatttagtgtactccaaccacggagtaacatcccatcataatcccaaatcctactcaaacaaaaggggaagggattatgcaggtgtacactaggccactggtgtaccaattagaaaccactttagagttatgcctactgtacccacataatcctaaaaatatgttacaactgctacttcatagtttatgccacttattttattttttacttttattatttttttttctgagacacggtttcattcccattgcccaggctgtagtgcaatgatgcaatcatggttcactgcagcttcaacttcccaggctcaagggatcctcccacctcagccttctgagtacttgggactcaggtgcgagccatcatgctcagctaattttttgtatcatttgtagaaatggggttttgtattgttgcccaggctgatcttgaactcctggggtcaaggattctgcccgccttggcctcctaaagggctggaattacaggcataagccactgtgcccggccagtttatataatttaaacactgccttttggttccttgattcccatatgctaggacaagtaattattattttattttattttactttaagttctgggttacatgtgcagaacctgcaggtttgttacataggtatacatgttccaaggtggtttgctgcacctattgacccatcatctaggttttaagtcccacatgcattaggtatttgtcctaatgctcttcctccccttgccccccaccccccgacaggccttggtctgtgatgttcacctccctgtgtccatgtgttctcattgttcaactcccacttattagtaagaacatgcggtgtttggttttctgttcctgtgttagtttgctgagaatgatggtttccagcttcatccatgtcgctgcaaaggacatgaactcattctttttatggctgcatagtattccatggtgtatatgtgccatattttctttatccagtctatcactgatgggcatttgggttggttccaagtctttgctatggtaaatagtgctgcaataaacatacgtgtgcatgtgaggacaagtaattattttctgtttttctcaatacattaattattagttcctccgttagttgtgaagtcctaattagggaaaaggagttaggctggcgggagcaggg

SEQ ID NO: 12072 - DNA, 7866 bp, Human
ggagatgggggtgctgcaacttttatatattcagaactttggctacctcttcctcagatcttctagtgccttccttcacctcccaaagcaaccccaaatgactccagcttgccttgcaaaacccccttgctcatgccgtgctcagcattttctttcctggtgcccaggtccttggatttaattacacaaccacagagacctcctttggtacctttagacctttggttcttaaagcaggtggcatctccactcgggctggagatgggaagcccaggacagaatatggtacatcttcctgatgtatccatttctcttagagaattaagcaaagtatttgaaagtttaactggaaatttaaaaggggctttttaaaaacattaaagctggctgggcgcggtggctcacgcctgtaatcccagcactttgggaggctgaggcgggtggatcacgaggtcaggagattgagaccatccttgctaacacggtgaaactccatctctactaaaaatacaaaaaattagccgggcgtggtggtgggcacctgtagtcctagctactcaggaggctgaggcaggagaatggcatgaatctgggaggcggagcttgcagtgagccgagatcgctccactgcactccagcctgggtgacagagcaagactccatctgaaaaaaaaaaaaaaatatatatatatatatatatataaagattaaagccaacatggatatattatggaatatagggtcaattcatatgaagtttaaagatcaactacaagtgatttcaggccgtggaggcccctttgggctatctcctgactttcctaacatatccatctactctgttcggatactatggataaccttaggaaatgtttgacaaagacctccttattcctttctctctgcccctgaatatctttcctagattatttaaatgcattttttttgttttgttttgtattttgagatggagtcttgctctgtcaccaggctggagtgcagtggcaccatctcggcttactgcaaccttcacctcccaggttcaagtgattctcctgcctcagcttcccgagtagctgggactacaggtgggtgccaccatgcccagctaatttttttgtatttttagtagagatgggtttcactatgttggccaggatggtctctatctctagacctcgtgatccgccggcctcggcctcccaaagtattgagattacaggcgtgagccattgtgcccagccttaaatgtgttttttatggctctctcggtttgcacttttcagcctctttcaaaacgatctcttaccccagaaacttcttgttctccaactagttatcaaagcctctacctttaaaattctctcctctacaattttcttaagtaatatgtggtggtgggggggaagtattacacggacccgtaaaacacaaatcgctgtctaatcttttcagtcgtgtcctccattgattctaatcatccaccttaaggcttccaaggcacagaatgctccatcatttgaagattcttctctaaatgcagagggaaagacagtccactgtggcctcttaatgcaacttcttcctcaaatcaatccgtgtttctccctagaaacggcaggtggaccaggacatgagtatgtttatgggcctgcagaattatgtgacacaaaagaatgtcatcggatggatcaacacctcaattaatgagggcagatacttgggctggactgtgtagcctctttgaaggcctaccacagaactctgatttcatgggtggactgtctgcggaggagtcctgacttagcaagaagcccaagtaaagaattttatgggagaagggactcttcagaggaaggcaaataacagactgaaggaaagggcgtttgaaaagaagtgaagaaataaaaagaaaaaagacattacatactgtgtccacaccctctgcagtgggatataaatgctccctagaggaaggagacccacagctctgtggcttggagaatttagactctgtcttcagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgtgagcaactgcaactggttctgcgagggctccttcaatggtagcgagaaggagactatgcagttcctgaacgaccgcctggccagctacctggagaaagtgcgtcagctggagcgggacaacgcggagctggagaacctcatccgggagcggtctcagcagcaggagcccttgctgtgccccagttaccagtcctattttaagaccattgaggagctccagcagaaggtgagcggcattgctgtcatctccaagcaagagagtttgctgtgattctgtctgtgatagagaagtgtgtttcttgcttctgtgctgtcataattcttgcttcctcttttatttcaaaatggcttaagtcatttttaaaaagttgatgatttcatatttattttcagtcctcactaagccacctctcactccccagatcctgtgtaccaagtctgagaatgccaggcttgtggtgcagatcgacaacgccaagctggctgcggatgatttcagaaccaagtgagttgttcggaatttgcactagtgtcaattgcttctgtttaatctttaaagaaaagggatttccatctgaaaacagatctacccacttgttgtgaaggattctgcagaggactggggagaaccaagcaaagaaatgcaaaaatggatgaggactcacatcaatctgtttgttttgggatgaatattgggtattgatggagcctccagaaacctctgtctcctgggcctattcattacagaaagtggaaagataaggcacatgaggttatcaaaaatcattcctgtgagtcttgaagatctaccaggtagtactctgaccctgtccttgcgcaggtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggtgagactagaaatgagaaatgcacaaacctgtctcagcctctggctcagggttgctttagtgatttggggcagcagaatgcagagtatgagtacaagactgagggtttcctttgaaaacatcacggtaagagaaaaattggagagagataagacctgttcatgttcccagacaggaaacatctttcactttaaactagcacattatttgagttgcccggagcagctccatgtgcttgcagttgatcaatagttgtagaatgagtcctagcattgcagtgttattgctttgtaaagtcttttttttttttttttggcaaaggccaagaaaaaaaatatcaaaccttataaatgtgagtctctactctttcaaagtattggtgaagagtgtttgtgagattcttcctctctcttgggaggggccatgacatgctcttacctcttacttgacagcaagagttttttgatatatggtctgaaattgcacagcctattttttttggcattctgaggtcctcacagccaattgtaaactgggaaagttgaatatcaattagttcatccttcagtggcatccaagcaaacttttgggatttttttctgaagccaagtgccatggcacagcagatggtggggagggggctatgccacatggagtgccttgagctgtcacaaactgctccactcaaagtttcttttccgagaaaatagactaacagggtttcaacaagcaatgccattccttagagttcattctttgctgagcatagtaactcttgtattttctgcatccataggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcaggtgggcatctaagcacgtggcccctcaggacccaaggccccccagggccccggaggcagggtctgatcctttctccccttgggtgtttcagaccgaggagctgaacaagcaggtggtatccagctcagagcagctgcagtcctaccaggcggagatcatcgagctgagacgcacagtcaacgccctggagatcgagctgcaggcccagcacaacctggtgtgtattgttcagacctgctggtgagcgacgggaacttgggaggcagagtcccggggatgtgcttggggccacacactctccttagctcttggagcttgtgacttccttgtaatcctgtgaagaaaccctttgaaggagcagctctctgacattcccaatcttctccaccacagcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaagtgagtacatgggcagacgtgtttgatgaaatgatgcacgtgtgagtgtaacagttagacaccatgcaaatattgcataccttggaaaggaaattatgccttcacactagacatgctcaaacagaactcagacaacataatatggccatcatttaaaacataaatggtttggtagcaagagttgtttgatgtacaaactgaaattgcactgccaagtctttgcattctagtatgataatatgcatgactgcatgatatgtgatcaatgccttactttttacaatactgtattgcctagtgggtacattcccataggctacctgatttgatcttataattaccaccaggtgggctggatcagtattccctccattctacaggaaagtaaactggggcttggagaaggtaaatgactcaccccatgtcatcagtttggcatgaatggatttgagagtagacatcagagtttcagagtttctgtctaccttggtgctctatggcagggagaccattaacaatttgagttagttatctttgtagcaggggagtctgtgccttttctgttctaggccaggtcaagtcccttgacccaggcattcttacccttggggatatctctggcatatgattttaaaattgcccttaactcacttttccacatcattcttttgtctccagtctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgctcaccctttccttcctgggggtctgttccttcctatgctcacccagagaactctctgatgtgccagtgggcctcccttttaacctcctaataaatatcatttccttggcaaagcagatgcctttttcatttgtattcatttgtttcaacgtgctcatcacctgagtacgctataaaaagccacttgaaagacaggccatataatggcctgactcttggataccagagcagtttcatgcctcaggggaagatggtgaatctggtgccctggacccaggagcgaggcaggcaggccagtgggaaggagggtggaggtgctgagtgctgcagtccctatctccccttagctattcttggatttcccttctaacttggacatctcccagagctgcttgtatcctattctgaatggaggaggcatgagctgcgggctggaaagaagctctggaaaactcatgttctttcagcaggagtttcaggttcagtgctgtattattctgggttattggtggtccaggcatttcccagcgaagaaaccctctgacctgccctgctatacccaggaattcctcctttcccttgtgtgggttgatcattatcagcctgggcttccagcttctgtcctccctcctcgactccaggtcttagagaccccgtcaactctttatttgatcctttggcctttctcaattcaatccaaccagtacctgttgaatacctactctgtgcagacgctgggtggtgggatgggtagagacacatgaagaaacacacagttcctgactgcaacttactgataatttgttaaaaaactagtccccaagtagtgctcttataaggcccagtcccctggcactgtgaacagctggtgggtgctagaaggaactctgagtaccgaaagggacaatgctggtacccaatggcattggtgtttatcaagaaagggcatctttctttgactctcatgaagacccatggaagtgtttaagcatagacctcccgaaaacatagagggccattttgatctgaagggatcagaggtctctgacttttcccaccacaccaggctttcccagcgggtatcagactccacctgggtgaaacatagtcctgtgtcctaaaatgatcaagtgaatcggaattttatatgtatatatatatatatataaatatatataaaaaatatatttttgtttgttttcataaagcgatgattctctccaccataatttctcccttgattcttctttttaaaactcaagttccaggatggatttggatttgtgctttgctgcttggcttgtgagaaacctctgacctggaactctgtctctactatgattcaccctgtgtctgtgatttcctccaaacccaaggtcaagctcagtccagaggctctctctcatgttgcttgtttctttattccacatcctgcttatgtatattattttacaataatacaaaagtactgctaatagctcctgtggtagacagaataattgtcccctccatccctcatcaaaatgttcatgttctaattcctggaacctgggaatatgttagattacataaaaaaggaaatcgaagttgcagatggaattaaagttgctaatcagctgactttacgatagggagattatctcggattatcaggtggactcagggttcttaaaagtggaagagggaggcagaagagtgagaaggtgatgaaactatggacccaggtcagagtgatgtgatgtgagaagaacctgccttgtcctcgcaggatttgaagatggaggaagtgggtcatgagccaaagaatgcaggtcatctctagaccttggaaaaagcaaggattctcctctagaccctttaaagagaaacgcaaccttgccagacctctgattttatttttattgtggtaaaatatgtacaacataaaatttaccattttagccatttttaatgtacaattcaggggcattaagtacattcacattgttgaaccctatgcacagattcccactaatttttggcaagtctcttcaggaactgcctttagattcaattatgagtcacaatcctatggaggtggttttaaaaatgatccaaattgattgtctac

SEQ ID NO: 12073 - DNA, 10301 bp, Human
ctctaatcccagctactagggagggtgagacaggagaatagcttgaacctgggaggcggaggttgcagtgagctgagattgcaccactgcactgtagcctgggcaatagagcaatagagtgagactctgtctccaaaaaaaaaaaaaaaaaaaaaaaattagagattcaggcaggaggggcggaaagttgtggattgtgattgtaggggaggatatcagtaccttcaatgcattcaccctggaagaccacatgtttgccccaaagctgctgtcctttataaaagcatatttgaagcttctccttggaaatgacttccagagtcacccaagaaaacacacattattattttgtagtcacaacctgtttctgacccattaaagatgctatgcagcttggttattcaccctatgcactaggtgtggtttcaaatgacttctggctggttccaaaaataaacacacccatagaagatgaagattggccttcaatgaggataaccaaaagaatgtgtcccaagctgtgaaggcaagtttgaaggaagggtgatctgaggaatggcaggtcacctgtaggaaaagaattcttgtatggcaagacttaatatgtagcttccaaaaggaacaacttggaggagtatctttcagaatttgagcactgatagattaaacataaaatcctcatatttcatagttccatctggaatgcatgagagtagagcatctgcttgccaaaatgtgccaatggtcataaaatgccacttcatgcacatgacatagtggtggattttcagggtcatatcctttggagagctaggcttgggtatttctccctcagatcaaccaagggtttcctttttttttttttttcaagcttctagtgggtataaggcattttcacttagtaaacttccttccttcagcatagaagtgacttttggttctttaataagtaaaaaacaggcttgttattttttggcccattctaatttaggatattgtcagcactgattgagctcaatggagctcaatctgtattttttgcattattgcatctcagtactgaaaagattggaagagagagacatgtaatatgacagagtgtggacattggaattagagagatctgtatttgaaccctggctccatcatgtaggagctctgtgaccttgggagacctctcagaggcttagggtccttatctacaaacccttgcagcattttgagaggactgaaggagctggtgcatatgaggtgcctggcactgtgcctggtgcacagtggaggctcagcaagcaggacccatcaccaatgacagagtcacgctgtgcacaggcatggagcacagtgcttcatgcagagtaggtgctcccaaaatttaggtttcttaatgttctgtgaacactgaatactagtagaaacggaggtgggtggcttcctgcagccccataggaagagggtagagttgcctccatctgcctggatggaactgcaaatgggccttgaaccaatggccttgtaagtcctttctcatttcagcttccaggattccctatcacatagtctagtttctagacgggtttccttacatggcttttctcacagagtcttaattgaatatgaactggatgagacacaagcctttcctcatttaggagaaagaggcacatatgtgccccctactctggggacagggcccagctgtcactctagctcaatgtcccatggataagcactgctacaggcaaggttggtcactttgaagccaaaccatgaagctcttacttaaccaatcagcatgttttgtgaggagtcctgacttagcaagaagccagagtaaaacatttaatgaggtataggactcaggtgaagtggctaaataacaaatggaaaaatcagcaaaggaggtaaaaaggaggaatacttgacatggttgccacacccactgctaacagaatataaagccctggaaaggaccaaggcttatcccagggaaaaggaatcaggttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgagcaactgcaactggttctgcgagggctccttcaatggcagcgagaaggagactatgcagttcctgaacgaccgcctggccagctacctggagaaggtgcgtcagctggagcgggacaacgcggagctggagaacctcatccgggagcggtctcagcagcaggagcccttgctgtgccccagctaccagtcctacttcaagaccattgaggagctccagcagaaggtgaggaggtgggcaccacactgccagcttaatgaactacttatctatatttgacatactaaactgtgaatggatctaagtctgttcacagtaatgctgagaatgataaagacatagattcactggcttaggtatgacatcaagtagtcttagaaaatctgttgtagagccacaaaggaaggatgcaggctggtgttagagtgaagcattagaccaaaatcagtcatagcaatcttatatggcgtcttactccaaaccagaatatctgattttttggtttgattatgataccctggttttgttttcagagcattaccgcattttcaaaaagtatgcacctgaattattttctatgctaagaatttcctaagtaaatcttcaaatatttaaagcctttcaaagctgtagcaaaatatagcatttatggcaacacaagagagctgttgactccagcaatatctacagacacatggaccatcctctagagcagccatgtgtacagatgacaatatggggccatctgttctggaagagaagtagatataagtaaagagtccacagagaattgggactgaatacctggtgtaggtttgggagggatcccagaagaggcaatgtctgagtggggtttgaaggatgagtgggagtttatatccaattgtacaagcccttgattctgggagggaattgactgcccactgttctgtagatctggaaaattagatgccagaaaggggttgtgctatttgaatatcattcatttatttacccagagttggagagtgttaggcacagtgctggggtgggggataatgtactgagtaagacagtctccttccttcaggagctcacagtctaacaggggagatagatgtggaaacaaaatgatcacacaaaggtcataagaagtgttattgattaagtatgtgggttacacaaggggtcttgctagtgggtgagggcattctgggtacagcaagaagctttttgcaaaggcatgaacaagggcaatatgaggggagagtggagagaagttagcaggtggaatgtgttggataaccaagttgttctggcttgcctgggatttttcccattttagcatcccagaaacccctcagtcctaagttaactgggatggttggtcacccaaccgaagggttggatacccagtaacctaattattgcaggaagccagaagcagataagaatagaattcatgatgaattcacattggttgtcctggttttgaaatgatcagttttatgatcaaatcctccttttatctcagagctgaaaatctgaaaggactcaaagctatttgggaggaatgtggctgaaagaaaatagcatttcactttaaggcacaaggcatttcttagtataacccatttcatgattaatcctatccccagatcctgtgcagcaagtctgagaatgccaggctggtggtgcagatcgacaatgccaagctggctgcagatgacttcagaaccaagtaagattttcctaaccatcagagcagtctagtaacggacaggctgaattacaaagtgatgagctccctatcctggaatgtggaagcagaaatttctattgggaggattcttgcattgggttaggattaggttaaatgtcaaagcctcttcaataggtgctcagattctgtgttttaagtttttttttttaatttttttattttgagatggagtctccctctctcatccaggctggagtgcagtgatgcaatcttggctcactgcaacctccgcctcccggattcaagtgattttcctgcctcagccttcctcgtagctgggattacaggcatgcgccagcaggcccagctaatttttatatttttagtggagaccgggttttaccatgttggtcaggctggtcttgaactcctgacctcaagtgatccacccgcctcagcctcccaaactgctgggattacaggcgtgagccactgtgcgcagccctgtgctttaagtttgattgtaagacaccatccattcttactccttttcaacccaacgtctggagtaagtttgaaagtgattttcacattggtctctttgtatacgttagtcactgtcaaccccccaaaaagaagttattaaaccacaaaaacaggaggcaaaatccattgcctttcagagaatcaatcaatacttttaggtatgaccattattacaatcatgagaatcctttgcattttcctgggatcttacattttacaacataattttacatatatcatcttcagtccaaccctataaggtgttagttttgtcttcattttacagttaaggaaatcaagcctcagagagataaaggtatctatctacagtcatttaatgagaatactggctctaactctgaattcagtgtttcttccacaacactagattgcttcttggcaaggctggaaaggatgacaggacaacctggagcaggcttatgaagggcactgattcacttgagatggcaaaagcagcagggcttagttgatagtaacttgtaaacgagagtcttagaacaaacttagtttgtgttagactaaactatccacaggcattccaccaataccttttctgtgtgtctcagtgacaaaataggccttctcactcagtacaggagtattttctcccttaattttttaaattcaaaatatttcaaaatataataaaattgactaagtcagccaagtaaaggccgggaaacaaagactttttttttttggacctcttttgacctctggctgtgtgtgcaggtaccagacggagcagtccctgcggcagctggtggagtccgacatcaacagcctgcgcaggattctggatgagctgaccctgtgcaggtctgacctggaggcccagatggagtccctgaaggaggagctgctgtccctcaagcagaaccatgagcaggtaagagtcccagcccccaatatcccaatactgagagctctgtgatccccctgaataggataaggtaggatttgatttgctaagcaccctaggcctaacaacattttgctggttgctcaaaacatactttggggcttgttggggaatgagtgacagcttaccttttttacataaaggagtgtggtaagctgacctacttccccttgggaccagacatgtatggctgaaaggtcacacaaatatctttaaactactgtctactgtttgatgctatctattagcttctgaagaggtgccaggtaggttaatgaccaagactggaaggagatagaaaacattcttacactctgtttcacctagataactagaactcaagctagataaatggatagatggatgaatggatggatggatgaactgatggatgggaaaaacgggagaaatgaaataactcaaataatggttgattcagatctcatggctgaatgcaatactacgaaatcagatgcatgtctcaaacattagacgttttcatgatgaaaacatgtgtcatactctagtagtatcccatgaaataaataggaggaatgaaacctggtttctctatatttaagtagcaacaattgtaagccaattatcatgccaggcttatcactgagcaaaggggaaataagaaagaaatgatagaatcttggactgggtagaaatattagcaatcatttaatgaagcagccgtatcatacagatgagggaagggattcagagaagaggccagaatttccagaggtgacagctgggcttcaactcatgtttcctaagctgcaatgcaatcctcttcccattatattgaactgcctcaaagaagttattgaaagacttctttctgtgggtttatttcttcccttttctccattaggaagtcaacaccttgcgctgccagcttggagaccgcctcaacgtggaggtggacgctgctcccgctgtggacctgaaccaggtcctgaacgagaccaggaatcagtatgaggccctggtggaaaccaaccgcagggaagtggagcaatggttcgccacgcaggtgggcatctaagcacgtggccactcaggacccgaggccccccagggccccggaggcagggtctgatcctttctccccttgggtgtttcagaccgaggagctgaacaagcaggtggtatccagctcggagcagctgcagtcctaccaggcggagatcatcgagctgagacgcacagtcaatgccctggagatcgagctgcaggcccagcacaacctggtgtgtattgttcagacctgctggtgagcgatgggaacttgggaggcagagtcttggggatgcccttggggccacacactcttcttagctcttggagcttgtgagttttttcgaaccccatggaggaaccctataaggagcagctctctgacattcctgatctttcccaccacagcgatactctctggaaaacacgctgacagagagcgaggcccgctacagctcccagctgtcccaggtgcagagcctgatcaccaacgtggagtcccagctggcggagatccgcagtgacctggagcggcagaaccaggagtatcaggtgctgctggacgtgcgggcgcggctggagtgtgagatcaacacataccggagcctgctggagagcgaggactgcaagtgagtacctggcggacggcacccctgcaagggacaggcactgttctactgtaggataaaacagagactttgaaaatcaagtttcagatgccaatctgtctgtagaggcgagagttttatattacagccgtgggaagtgtaggatatttgttgctaacattatctgggctaaagatactttcttttacaaaagatagtcatgggacttgactccttcctccagtagagattttttggatgttgatggccaaataaatctttctgtcttcaggactgtcttgtcaccacaaaaaggaaaatgaaactgtaacaatgatcactttttctgatttaaacagaactttcaaatccaccgtttcattaattcttgttagaatcatctgaggcaggcagagtgggaatcattatcaccttcttatagatgagcatttgagtgtcaatagggttgatgatcaataactaacagtacagcagttgccagcgaacataatatttttatgaacacagtcttgtggaattttcataatcctgtgtggttggtactaccagtcctaccttacaggtgggaaagctgaggcttagaaggaggaagtgactttcttgtgtgtctagggtcatacaaggaaggctgggattccaccttacatgttctttgctcatttctgccactgtatcagaactctgtagaaggagtgatccaaacaaggcatggcttcctaggacatcagagaacgggttctgcttgtttctgtgtctctttggattgagtctcccttgtttgaatcacccttctcatgctgacagtctaatgcttctgcatcccaggctgccctccaacccctgcgccaccaccaatgcatgtgaaaagcccattggatcctgtgtcaccaatccttgtggtcctcgttcccgctgtgggccttgcaacacctttgggtactagataccctggggccagcagaagtatagcatgaagacagaactaccatcggtgggccagttctgcctctctgacaaccatcagccaccggaccccaccccgaggcatcaccacaaatcatggtctggaaggagaacaaatgcccagcgtttgggtctgactctgagcctagggctacttgatcctcctcaccccaggtccctctcctgtagtcagtctgagttctgatggtcagaggttggagctgtgacagtggcatacgaggtgttttgttctctctgctgcttctacctttattgcagttccccaaatcgcctaataaactttcctcttgcaaagcagacatgattctcatttgtattcattcttttcaaagtgttgactctctgtgtgcttcttataaagccacttgaaagcagaaggaggactttataggttaatcatctcctaaaaggtcttcatcaccttcattaacattcattaagcacagtgagtcccagcatccacttaggccagcataaaacaagtaggatcactaggacaagaggcctcgtctgaatatgataaacatatttctcatgggaccttactcagtaaaatgcaacggtgagcatctctagacagttccactcattcttttaagtccctagcagggatgacagaagttaatatttattgaacacctaccaaatgccaggaattgtgctactaattttttctcttcctcacagtgaggaagaatcaatggcaggactgaacccagagttcactctctgcttgtcagttacacatgaggtgtgattatgagaggacaaaattgatttcaaacaagcacccagagcttatacatcctcctggggagacacaatgctgttagtgctcaaaacatctctgaaactctcctttgtgaaatactgaataactcaatactaaaaagcaccaccttgccatcttccatatttgagcaatacccaacctattttgaaagtgtttcttttctcacttgaattgtttaaccatgggaactacatatgaatttcgggaccctccccctcaaagttatttagaatcaaattaggatattacaagtcaggtgtttgcaaatgctaacagtgaccacggtactggtgcctggcccctactggtgcctgctgatgtctaaccaaggttaatggctcccatcactgtgcatgctgtggtttgtgccaaggccactccctcagtctgcagattattcccagattaaccaatctgctaattatgtcttctctccttgagatgaagctgatactatctcccctgctgtgatgatgccggttccatcatcacatgtcagtcttaaattcttaaattttttttttttttttttttggagacagagtctcactctgtcaccccagctggagtgcagcggcatgatcacggctcactgcagccttgaacttcccaggctcaggctatcctcccactttagcctcttgagtacatgggactacaggcatgcaccaccatgcatggccaatttttgtattatttgtagagaggggtttcgctgggttatccatgctggtcttgaactcctgggctgaagtgatctgcctacttcagcctcccaaattgctgggattacaagtgtgagccactgcacctggccagtcttaaattcttgtgctctcatattctagttcacttaatatctactcctttgttgttgatgctgctgcagcttagacaggagaccttggaagaccgtctgagtgatactccatcctctgctcagaatgtcttagacccagtttgtggactctattctctctttcctcagggagagttcattccctggagctacctgcatgcctcatgaaaaccgcccttgttcaatttatcccggcagttctccacacatgctgggattactgtccactgatagttacctctcagctaccttcaccaggaacagtgcctcccaaatacccagttgcatgctttgtgagtgagaggtcaaagttctcaacacagtaaatacactttgtttttagtgttcaatttataaaatattaagcaaaacttgtttctatgtttgatgttgtgtcagcggaaaacatgggtctagggaaaacagtccttagttcttatctctgccatggtgctctccttggaggataaaagaaaggagtgtcagggagatcactttttctcaggacaaagccaaattgctcttctgaagtatctgggaagggtcagtgttaccactgagaaataaaactaaaatcctaagtcccccagctgactgaacggactctgtcttggccaaggggaccgaagagaaaccttaaaaacagag

SEQ ID NO: 12074 - DNA, 9123 bp, Human
agattaggaagtcaaggggttgtcacagcttataagtgagaaggcaatgcaactcctggctccatcacttaccagctgggagacttcgggcaagttatttaacctccctgacccttggtttcctcatcagtaaaatggggataatggtacatacttcatatgattgatgtgagaattagagatcatttacgatatataatgatgatcacatagtaggtgaccaattaaaaagaaacatattcttatcaaactaagatccatgtttctctacacagttctttctaattctaattctctatacagtttttcctaatacagggggaaatgtactgaagtgatccaacctccatctcctgggttcaagcaattctcctgccttagcctcccatgtagctgggaatacaggcacgtgccaccataacgggctaatttttgtatttgtagtagagacggggtttcaccatctctggtcttaaactcctccactgaggctggtcttgaactcctgacctcaggtgatccacccccctcagactcccaaagtgctgggattacaggtatgagccactgcgcccagctgtgattcaatttagcatcaccaatctgacattttatgcttcctggggtgatataataagagttacacagcatattttatgaagtattctgtcccaacaatgtttaatttaaacctaatccagcctctagcccagtgctgtccaacagaattttatgtgaaaataaacaataaataaaataaaaataaataataaagaagtgttctttatatgcactgtctaataaggtaggcactacttacaggtagctgctgaggactcaaaatgtggatagtgcaactgaataactagatttttaacttatttagtttttactaacttaaatttaagtagccacatctgcctattgtctaccaaattggacatcccagctcaagatttactttctaatttatagaaaatacaagggctagagccacaaattaaattatgtaaaatgtagttttaaaatccttaggacagttaggaaaattgaatctgagatgaatagtaagtggtgctttggaattattgttaattttcctgaataagaaaatagtactctccttattcttaagaaattcctgctgatgtatttaagggtgacatgccatgctttctgccactcaaataattgggcaactgtgaaagcaaatatggtataatgttaactgttgaatcggggtaaacaggtggagcatcaatgcatgtgtgttgtattattccaattttcctcaatatttgaaagctttcatcataaaaaagataaaagacaaatatttaataatctgctgactgttcccatggtaggaaaagtgagatggttttcagctgccaactgaaaaatctggagatggggaaatccagatttgtgtttcaggagcactttagccacagctgtgatggaaatgagagatggtatttattaatgcctcagcctttcctgaaacccctctccccacatcacacttaacacacaggtctcctcctcccagtttctcccagcacctggcctcccttctcttcccctcgccaggctctactcctccttctcgtcctctcctctgccttccccttccctccccaatgcctgcagatgaaggaatgccctgctggcaagacactttgaagatgaaacatgctgactcccccagagcccaagactgacatcttttacaaagaagagggtgcaggccactcccccattaaagcacattctggagaggccttagacccggctaaccacccaagcccataaagcgcaaattgccccaacatcatcttcacagccaagccccttcagaatctgcgcataaatagggctgcggtgccctgaggagcacattggagtttccatcaggactccaggtcccctatcctgtcctctgcaacccaaacgtccaggaggatcatgacctgcggatcaggatttggtgggcgcgccttcagctgcatctcggcctgcgggccgcggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgggtgtcctggatcacacccttcctgaacccccaccacctacacagccagggccgggcactaaggatggagtcagaggcacaaagacctctgcctgcctgagatcccagtctgatgggcgaggcacacagacacacagacagacagacacatgcacagacacacacacacaggcactcaagatgcagactcagctgacagttcagatagagggagcttgtgaaggaaaagtgtggccaggctgctctggggcacaagctagacatcagggagttgggggaggggggcatgtgaccactgctgctgaactcagaggggtttgggcagccccagggtgagagagtagggtgcactgacttccagatgacacaggggaagggctgggacagctgagctcccttccagatggcctgtgacaccctcttcctggcaccatccccagaaacctcatctgtgatctgaacctgagtactctgcctgtgtgggttgctgatcacctagtttcatagtgagggactgagcctctacttctgttcatctgcttgggtggggggtgggggggggggtcactcaactccccagggagcaggcactgacaccacccagcccttgctccactcctgagtgggaaatctagacacagatcatgaccaggaaatccagaaattgtctgtctcccactgcccacctctactcaatctcagataagctccagatttgggggttcccattaaagcacctcccctgcgagcccccagagctggctttggggcaccagacaccatctgccccaccttcccacaccgaatggcaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtgagtgcgggcaagagggatgctgggcacaggaatggggtttaggttaaatacactggattagacaataagaactcccaggtagggtgagtggccatgaccactagattgaccgagggtggcggggtcttttcctttgtggaatctttgcccagacacctgtgtaagaggagggctgtgactcccatgacctgtctctgtcccacttcagccttctctccctgaaccacatcacccagcagctctcccctgcgctgggtggggaggaagcctctgcagggtccaggccttctctcctgaccctcagcccctatacttgtagcacctgtcagatgtgagcccagggtctctcatgagtgacaggtcttgggctctgggtgtcgcactgccttaggttctaagtcctgagggtctgcgggtccaggaggccccatacctgagctgggattgataccagtgaggggaggctagggctacaggccctgagagtccacgctgtccactcccaggatggggctgggggctgagtcctatttgcctcctgggggacctcagagcccctttgggaacaggactgggaggtcccagatgagcactctccatccccagttcaaagtggatagagaatcccagacacatcccacatccaactagaaagcactaagctaggctgccaggccggggctgtgtggaggtgtttctagtactgtccccatggctgtgatgaagtgtgatgtgatggtggctctgcagagacctgccctgccctgacctcccctctcttccctctgctctgtctcaggtatgaggaggaggtttctctgagagcaacagctgagaacgagtttgtggctctgaagaaggcaagtgacacaggattgagaagcacagatctgtgggatctcagaatgacagattcttcctggggacacacagggggtctcaacctcagcgtggggcacaatgacctttccacagcaggctaggactgcccagatgcaggcctttgtattgagcatccagggccttgacaaagggcaatgacttgggaatatctaccagcacctaccttgggcaaggggatggctgcactgtcctctgtgtgtcctgctctgttccagaggttgtggtctattgctgaggcccctggagccatagcagatacaatgtctctgctgagagacagtgcagtctgtctagcattttggggagtctgaccttgaggcagagacacaatcccagggtctaaggggggatggagaagaaccaggagcagccactgggctcttggagcacttgtgggggacaggaaagggtcagggtgtgagagctggggggtcagtctgggcaggcttcctggagcaggagatgagagaagggagagacaggagggcaaggaggggtgaaaggctggtgaggcatggtcaaggcaaacagggtttgtcatcagagggacagaggatgccagctcatcccaggaagggcagaaggggaggaaaggcatgggaatgggacaccagggactgctttcccctggctacatggaatggatgggcagagagaggagtctgggggctggatcaccagggtccttgagctccaacactccccacctttccaggatgtggactgcgcctacctccgcaagtcagacctggaggccaacgtggaggccctgatccaggagatcgacttcctgaggcggctgtatgaggaggtgcgggctcaggggccagacagaaacctggcagccagcagagaggagagttgggggtgggagtgttggacaggatgtgggtagaggttgcagtccctgaggctgtgtgagggggcagggttggggaccagagaaagcctgaggaggtggagtcaggacatggtgggtggggctgtgttctcaactaaagtcactgccctcacctcctgcaggagatccgcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaaggtgagtggcacaggacacctgcctgctagacgtggcagtgggagggatgtgaggtatctattaaataggcttccttttctggggatgctggtccctagggatgagaagagagggctgccaatctgaggttggggtggcagggcaggactgccatgtgtggctgcacaggctgagcactgtacaacctgcaaaatcatctgtggtgtcctgaatggatgggaggtcccaccctgagcctcatgagcatctctacttcccccagtgtgaggagatgaaggccacggtgatcaggcacggggagaccctgcgccgcaccaaggaggagatcaacgagctgaaccgcatgatccagaggctgacggccgaggtggagaatgccaagtgccaggtatggggcatctgtgcgcaaggtcagagagaccgagggcctaaccattgtcacacagcctatgtgtgccctacctggatctcagcattcattctccgccccctttgtccatgtagagtccctggtcgtggtctctcaatgagtcccaggtgataaaggcaagaggctctgttctggggtgctcccagcttggtggggagtgtggtctcatttggatgagcatcagagagacccagggactctaatctaccttgttctttctgttctcttcagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggtgggtccaaccaagggtggcccagaaccacccttccccatccctggcacaagcctacccttggccttggctgagcaatggccagggctctgggggaaaaaaatattattattcacttccggtgtggggagggctggtgtgtgagtttgtctgaggcaagctgttccctcagactctgttcttaattgaccagttgtggaccctaccctatgaactggggagctttttcagccactctggggcagtcactaatgttgcctttttctcttttgccctcaggctatgtgaaggcattggggctgtgaatgtctgtgagtatttggggtccagtgtggacagatttactaactacctgtgatggagggcagagtttggaaaaaggagtgttactgagattgaatataaaagagtgggctggcatcacaacaggagggatttggggtcagacatccaaaagaccccagctcttggactagatggacctagaattgtccacaaagatgcttctgacttttcataccagagctcaggtcttgggcaggggcggttgtcaggaaggcaggatggcttgcccttcagaattttgactcagccttcggggttcacaggtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcgtctttcctgccctgccttgcttggcccatccagtccaggcgcctggagcaagtgctcagctacttctcctccactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaacctgggtcttgtgtgtgtctctattaccctcctcaggggtcggggttagggagggtccccaaagtcacatggagcagcaaaaggccaagccaagggtctccagtacagttttctatccctcgcctcatagaaggttcagatttagccaagagttgtgctaggcccctatttgatgtaactttatccacacaaccctaatgatacaccttgcagatgaagaagccagaactcagaggcactcaataattggggcagggtcacccacttagttgggtggttcatctggggtttaagccctgtgtgtgtcgctagtgctcatttcactaaactgcagctgtctctcagaaaacatctcatgcatatctgcaaactgatggatcatgaaaatcagattcaccaatcactcaaagcttgaggcaacatcacccattgctttggtagggaagactcatgcctgagtaatttattggaattctttaagaggtgaatacatgaatatgatttaaagtttcaaaaagcctttgatgttggctttctttttttttttttaaatggcatcactctggggttttggagacctgccacagctgatacattttcctcaaagacagaaaacagcacatagcaagatgatgtggcatagaggggggacacggactccagccagactgtctgggccccaagctgggccctggtccttcctaggtgagtgggttgggcaatgtatttaccctctctgtgcctgtttccacacctccaaaatgaggatgatagaaagggcaaccacctcataagttgatgagttaaaggatttcatatacgtaaaaggtttagatggtgcatgccacaaaattatcactctattttttatcattagtgttattcttttgcagaatgtaaagtagaagtccctctagggatcagggcctcttatggccaacctcttattacattgatatctgtgatcagagattgcaagtacagagagaaacctccgtggttaccagggccattcagctccttcatgcatggaagtattaacttgacactgacgaggtaggggaaggggaagatgacagctcagccccactatgggccaaggtgactccctgaacatacatctttaagccggagtgaatctctaaacttccagtccaaggcccagaaaatacagcagaaatgggagtcccccacccctacccttctgggcactagaaattattaagaatattaagagaccagaagtgagtggactgaaaagaacaaattctcctgtaaaagctagaatcaaaccaaggtctctcagccacccctgatggaattctgagagggacacaatcctagaaagttccagaatttgtgatcaatcattccaaccagccctgtatgctgtgacgtcacacagctcagaagctggccctaggccaggtgcagtggctcacacctataatctcaacactttaggaggccaaggtgaaaagatggcttgagccccagagttagagatcagcccagacaatacagtgagactctatctctataaaatataaaaatattagctgggcgacgtggtgtgcacctatagtcccagctactt

SEQ ID NO: 12075 - DNA, 9950 bp, Human
gccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaacctgtctcctgctttcccgggggctccagtcagtgcgacaaaagggtagagagggaggagggtggctgacctcccattctgccaggacccttccctttgatacaaaagcagcagcacactcctaccacccacgactcaagaagacaagatcagccctccaggggtggcctggagcccagctcttctgagagctgacttatgtcctgttttggattctcagggatgctcctccccagcaatacacacttccctgctaacccacacaagacctagacactgctgagcccagtggaaagctaccagctctattgtgctgaaccaggcacagagaaacagcccagaaacaggaagtcctgcccctgagctgggagagggctggtagtcctgggtctcagcctgctaggatctggagtgagctgcctggcatcagagatgccctctgcctggcatggaagcgagctccttccagtcaagcagggaaatcctgggtctcgtgtcatccccaggtcggctgtatgtttcgtcacctgccctccaactctccctgggctgggctggggagcgggagttgtatgactcttgtcagtcttgggccttccctagtcccactgcctctgtttcccctgagtttgatctctgttaggagatttctaagatttctgcatttctccatctccgcatggcccttgccttctcctcttagttcggaacctctggactggaggatgcttctgagggcatggggacctgagttggagtggggaggggtgttgactcatcaacagcatcatttctcccaggagacgcccgtaactcatccaaggtcaggactacacactgtcacgcacacaggtacactcacagcttttatcttcacgctccctaaccttggcaaattgtacaatttctttgaagctcagtttcctcatctgtacaatggggaaaagcattagatttcatgaattactataagtaaagtgtccaatacagtgcttagcacgtaatgaagcctcaatacaatgtagttattctccatgccccacaaagctggcatgcctagcctcagacctaccattttttggggtgcagtaaggcttcctgtccaccatgttcccagggacattgtactgatgggtggaaaggcaggtctaaaggggtcacgaagttctgggaggttaagggaacgaggaaggagattgagcaacaaggaaagagcttgccaagaaggaggtgtgaatattgggactgaggaggcagcttagagatgggcaagggggcagttccaggcagaaatggttcgtggaggcagaaggtccctgggagagggagcagtctggagggtggggcaggggcgaggagggggaggtggggagacccaggactgaggaagtaaacaaggggagcgccaccacagaggtggagaggtggagggtgctgctgctgggaatcaaccccctcagactttccactgcgaagcgaaaccgtaagccctggggtgcggggggcgggccgggaggaggggaagtggggaaggtggagggaaggccgggcacaggggtgaaggcccagagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccaggtaaaacggggatggcgggagggttgacctccagccccacaggaggggaccagcagggatctctgtggccacaaaggtcctgaggtccttagctctgtggattcttctaatcccttttttgggcagtccttccaccccgaaagcctctctgggcagagaagaaacagaaacccaagttcttcctgcaccctgtttctccctcgggaaacacccaggctccttctctacccctgcctctcggctcacgccccctccccttggcctctcttttgctcacctagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacaggtatgcaccccaaacttgggcaacaggacctccgaatccagcactcaaccccacacccgtgccggtcctctgtcccctgccctgaggtgtcactccctctgaagccagtgacccagtctccctgccctcgcttgcaccgttcctgcccttgctctgcaatcagcgaccctcacgccagcatcccttctctccagaagtggatgcggccagtccaacagaggggtcgggcgtgaggggacggttggtggtcaagagaactcttggggcgggctttctcatcctcaacgggtggctgcctgcatcctcccgggcttcctacccctggagcttctcaactccattctctttcccgcccagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgagtatgtggggcgggacgatgggagaagggctgggaggtgggtccccatcccctgcctcccgggacgcaggaagggctggggcagaggctgcgccctaggccctgtcggagagctcccagaagagtagaggaagggggtgggcggcctgctggagtggaaggtgcccccgaagcacgtgtatggggggccctgtggagagattgtgtcacccccgagctccccttctcccacccacgcgggagtgcccagagggagggggagggggggagagcatggggctaaagtgattcatttcagatatctgtagctcagggggtgggcttcgcggggttccaggccaggaaaacggcaagggtggctgatgccaagtaaactccaggccagggacggggaaagtggtcctggggagtcttggggatccactttatgcacctccaggtgctggaagctgagatggggagagggtgatgtgggagaggagaagacaagtctaaagccaggtgcctgtttccaggagcttccggcttggcagtcctgctgtgttgggaaattgtttccagtgggctgatgaagtcttctttatccttgcacagtgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtaactcccccactctgcttcacatttgaccacaactccttcctgccccccttgtcacctcccctaactatgggtccccaaaccaggttctcggcagcgagtggcctacgtcattgctgtgggtctcactgttcgacccctttatattgctggcagcctcacagctgccatcaccccttcttgcttctcccgtggccttccagcgtcattgccggccttccctctccttccggctaagcccacttgctgggtttctgagcctcctcagctcatcaccttattctgctccttagcactcttatgagccagaccatctcctgaattcttctgcctcccttccttgcagccccagcactccctccccactgcagcacccagctttaactttgggttttcttttctcttcaggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacaggtcagcctcaggtgggaaaggagtagctgccctcccagggtagaaaggacagggaggaagggctggcagggcaaagactaggcaaacccaccctgtgatgccaggccactgggcacaagttccagagcctgcccatctcggcccccacttttctcacccccataataaagaaacgaaactgaaaatctcctcttgagtcacaagataaaagttccaccgttctctatgggactcccctgctctcaattggcgggagggtctgggaagttagaaggaaaggtgacaaaaattctgaatggttcgaaagaggtagaatatatttctagaatccttgtctactttgcagccagggcttgggttaaagttgcaggaagtggcctggatttgggaggagtgaataaatccgtcccttggtcagcaaatatttactgagcaagggttttccaagacagtataaaacaaacacagaaaaaagaatactcagagagtatgtgttgactggttgataactatcagccatgacagattagccatgtctgcagcacgcacctgcggccactcagtagtagcaccccacggcaggtgcttaataatgtatagagattgaatgaatacgtgaacatgctaatggataatacatctcctgaaggccaatcctgagttttcacttgctttctggatacctctaactagatgttataccacctctcagccgccttaccctgaaccccagctttttctcccaccaatccccttgctgactcagcctgtcagtaatccactggtatccatccacctcgaaacctggcctcctcctctctacatcccatcagtcatcaaagtccaccagttctttctgtccaatgccctcttgaaggtcaactgttttatgtagacggctcaatgagagagatactgttaccccgaagactttctcaaaacagctgggaagtgccagactctgggtctaaactcaggtgtctgcatcaccaaatcactctccaggacactactcagatgcccttcaccctttgtctcctcccacccacccatctctcactttacaacttggagaatgctctgtctctagatgaatgggtcagttccctgttctctataccttcagaaagggggatgatgttcattcagggggcaccacaaggcaggggacactgatgtgagccgcatcatggaagttccaaaattgtgaagtagatgggggtcagctcatctgactgattttgagggttctgagcatttgagtagaaagtaatgtaaaagaatctgtaatagtatttattctgtggtctgccagggccagtttgagtgtgaaggcagtagggagcctggaaatgttttgagcaggggagggagctgactagagcattgtctgaataagataaatgtggccggcagggcatgatggctcacacctgtaatcccagcactttgaaaggctgagacgagaggagcacttgagtccaggaattccagactagcctgggcaacatggtgaaaacgcatctgtatacaatttaataaaaaaataaatagaaagaaaaagatgaacgtggccatgacccatgatgtccttccccaacctcccctggccagaacccaagtgagtgcagggtgattgagacttggggttcaacctgtgatatcacgtaaggggggcagaatcccaaaagatctcttccttctactcttttcagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtccgaggccccagaatgccaggacccaaacgccacagcaataatctttatcctccttccagaacagcccctgccacccccatcccagcgcttttctttccagtcagggacctgatctctggcttttgcctagggttgacccgtttccgccactgatcagctgaatgaccctgggacaagtcccttaaactctctggatctcattgcatctgtaaagtctgagagaatgacaaagtgtcctttctagtcctgaccctatgcctcatcctgtactttctccataggtgcccaacgctctgggagagccccaggtgccctcccagcaggccacctcctgctgtttctcatccttggtgtcctttctctgctccttttggtgactggagcctttggctttcacctttggagaagacaggtgagccagggacatggcaaccccgccccccagcagctcccgctcttccatcctcagagtgctgatggcaccccttcctcaggaaggtgaccaaatgggaccctgaacttgccctcagagccccccttcttcataagcctctcactccagggatggcttgtgcctgggtaggctggaaggggggttgggagaaagccaggaccagatggggagggcaggggcgctgagaaaaaatagagggactcagtgtccctcctcatccgcttcccttcatccttctcctccttccgccctccgtctctctctccatctcttctcacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaagcctgagtctggctctttcttgtccaagtgaaggttcccgtctctccccagcctctgagggctcccttctcccaccctagcctcctaacctactttccccagccagcctccctcaccttccccttttctgtttctggctgcttcgtgtttctttcttggtctctctctctcttgcgctcactctctctttctctctcctgggtaatcatttctctgaagctcccccgaaaaagcccttgccccttgcctccgcagctctctcctccgtccttccacccaccttccacccacagtgcgctggctgccctggtttccttgatatttttgtcctttgggtccaccccaccccacactcagctgcacttcagcacttgtccttggccctccggctgcagcagatgcgcacatatgctcgcgcgcacgtgcacacacacatgcacacacacgcgcgcgcgcacacgcacacacacacacacacacacacacacgcgcggcgcgcagaggactgccttgtcaagtcttccaggagatccggtctggaaacctctctgggcagccggctggggctcctacctctgccccaccccccacgttcctcagcccttggaggcttttctggtcccaggcatgagaacacactgccacccagtggtcactgcttgtcacaccccaacggaggtcactgggccggctgcggcaggcctgaggagttgagcagtgcagtggacaaggcagggcacagactgctgtgaatgcaggcaccgcctttgtattatgcacgttctatgtgcagcatatgagtatgtgcccggtgactgtcacatgtcctatgcacccttcaggagagggactgaacaatgcatgtctcaggagatacagccctggctggccctctcaagggtgtaatctatgtctgacaaaggggaaggctgtgaacaaaggcctgtgcgtagagcaaaacagccagctgcagctgtgggagtcgggagccccggcttctcattccagctttgctgatgtaactgtagtcaatctccctgagcctcagtttcctcacctattaaatgggataatgataataacccaccaaaatgggttgttgtgaatattggataataaagggctttggaaactgtgaagtgctctgtgtgtgtggagtacttgtctgattatccattagtgaaggagaaagcaggcctgctctggtcatgctaagaatgatattgaagaacccaagtcggcctgcgccctgctctgtctgtctgtcttggagcattcacctgggccatgtcaatggtcctctcagcagagcaaacacggcctcagcacatggcatcctccagtctggcatgggacagagacctctgcctgcaaataggtgtggggccctggactttggccacagatgactctgtcaggggactttaaccccatacaggagaacaaaatattgaaagcgagtgggtgagtgggagtgaaactgctggagcaggaggggcatggtggcatgtgtgagtggcatcccactgggtctgtgtgccgtgtgcaaaaagacacaaaaagacagacctgaggacatgtccctgcagagacacaatagtcactcattagagacagacgatgaagaaggtgacacctttgttctgtgcagagccttaggtagaggggggaccctctgaagcctgaacaatgaaccatttacagcaatctgaggttctgagcctcaggatggtgatgactcttgccttgtcactggcagagaaacactggcacaggaaggaggaagctctggccctgccagagatgatcacactgcaaaaggaagtcttgaagtccttttagaagcttccaggccaggtgtcatggcttatgcctgtaatctcagcactttgggaggcggaggcagaaggattgcttgagcccaggagttcgagaccagcctgggcagtatagtgagacctcatctctaaaaaaaaaaaaaaaaagttagttgggcat

SEQ ID NO: 12076 - DNA, 9722 bp, Human
agcaaaactccgtctcaaaaaaaaaaagtgtatgtttcttctcctgttaatttgtctattgtcagttcattttagcagtgaacactcagagggtggaggggaagcccctacaagagctttaaaagctactgatgcttgggtctcactcagagattctgatatattcagcccaggtgtaagattttaaaagctgcccaggtgatcctaatgccaaggctgaggcccctggaggaaccctgcagagctgcactcactactcagcaatcccaatccacacgtgaagggttaagcaggagtacatttgggtgcagggggcagggcattgttttgggactcaggggcctctgaggaggcttgtggcctgagtttctgccaacaaactgaatgcctcctcttcccataacaaagcgtagaagcgggaggcatttgcatttgccgcaaggggctgtgacttctctgaatttgtccctcaagccccaggtgcttcagccttggtgggtgatgaagcagagcagcctgggggtgacctgtgctagggtccaagggtttccaagctcctcagaaaatcatactggcttcagtggagctgcagagccacttgcaggagaacctggatgtgctgtcctttggaagagtggccataagggtctacgagttcattttagggtgggctcagaaatcagattgactcagcaggccccagagaggaacctgcactttttttttttttgacggagtcttactctgtcgcccaggctggagtgcaagtggcgcaatctccactcactacaacctctgcctcctgggttcaagcaattctcccgcctcagcctccccagtagctgggattacaggcatgcctggctaatttttgaatttttagtagataccgggtttcgccatgttggccaggctggtctcttgaactcctggcctcaagggatccgcccgcgtcagcctccgaaagtgctgggattacagccaccgcgccccttcaattaactcctatttttttgtttgttttttggagacagaatttcgctctattgcccaggctggagtgcagcggtgcaatcacattcactgcagccttgacctctaggctcaagctatcctcctgcctcagcctcctgagtagctgagactacagggacgcaccatcatgattggttaatttttgtattttttgtggagatgggggtctccccatgtttcccaggctagtcttgaacttctgagctcaggcaatccacccacctcggcctcccaaagtgctgggattacaggcacaagccaccgcgcccggcaaacttatctcctactgatggatattgcaaaatttttcttctaccaaaaaaaaaaaaaaaaaaaagatagatataatccataccatctgttcaatcttgtcctttttaactttttcagggaaacttcccccaggtgatagatggatagatacatgagatagacataacgcatacgatcagttcaatcttatcttttttaactttttcagagaaaacttcccttaagtgaacatttaaatctgaattacgtcctgttaaactgttctccaggaaaataaaataaaataaatcttcaagtttttgtttacctaacaatttgttgtgtcgaacaaaccttcctacttttcaggtaacaaaatggcagcttaggctagaaagccgctcatattcgcaggtacaagggctgggtaagaacgccccgcctggctgactaacttgagttccgcgctctggacaggaattatgcacagggcgtcgctgtggcactagaaaccccaaagtcacaagcgccccagatccgaccaggatgccgctaccggctacagcccagaaggcccgctcctgcggcgcaagcccgccttcctgaagaaaaagcccagtcccggcagcgttcttctccggctccgcccttcttccgctcgactttctttgccattggctgacaacggagtacataaggacgtcatttcctgccgcctgtcttttccgtgctacctgcagaggggtccatacggcgttgttctgggtgagttccgtgtagcgtccctggcgccttccagggctagaaaaatgagcttttcctgctcaaatgaagggtgagaagactagtgatgaaagccggtcagactggatctgtctcccgcccggcgcgccccaccttaggcctgcggcccgcacgtggccaggctcgggctggcgggttcccagagtgccccgggagcgggtggaggccgccctccagcggaggctccgagctggggttcggaccaggccgcgggtgggcgggagtgcagaaagcgggctaacatcctgtgttgctatcccttcggagtcccacacggcggtgagtctaggcccaggcgctgatttacaccagctacttgggctggtcgggttttcccttcgcgccgtgcgggtcaggagttaaggttctcgggtttttagacaaacaagtggtgacagcacagcgaagtaattccaaagcatccgcctacaatctgcttgaaaatgtctgaaaacaattcatgccttttttgcctttagtttgcatattccaaacatggctgctcttttatatctagttgttaacttggcgcatccacaacttttccttaattcctatcttgagaagtgttgaatttccattcgctaatttcgtgtagttttattactcggttactctgccgtccacactatttcctcagtaagatgtgcgctgttccgtaatacacgacatgtatgggttaactttctgtttacccttcactacactgtaagctcaatgcctgacactatagcagatggagtttttggttgcttttaagggtgtgccctacttaactcaatggaatgaaaagaaataggttgctctcttatttcagattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagattataaaagggaaagagtggcagaaagccaggaagtggattcttaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccggcgtattacgaggtcaggagatccacaccacggtgaagccccatctctactaaaaatacaaaaaattagttgggcgtgggggcgggtgcctgtagtcccagctactcaggaggccaaggtggagaatggcgtgaacccggtgggcggagcttgcagtgagctgagatgcgccactgtactccagcctgggtgacagagccgagactctgtctcaaaaaaaaaaaaaaagaaaatagaaaactcaaactccactgttagagatcttaagttggactgagccatagaaatcgcccttatgacctatgaccttcctttttttttttttttttttttttccttcaagacagtctctcgctctgttgcctgttgtccatcctggactgcagtggtgtgatatcggctcattgcagcctttgcctcctaagctcaagggattctcctgcctcatcctcccgagtagctggaattacaggcatgtgccaccatgcctgactgatttttgtatttttagtagagacatggttttaccatttggccaggctggtcttaaacgcctgatctcaagtgatcctcccacctcggcctcccaaagtgttgggattacaggcgtaagccactgcgcccagcctgtaagaccttttcaacatacatgctgggcatctggcagtatgttgaactttataatttcattttgtgtagacttgtgccactaaatatctagaaattctattaaagtggcttatcacattttcccatggtcaaagtttttaccttaaaacaatgaaatactgggacagaaattttttaagaatcttagccagtcatgacggcatgcacccatagttcccgttaattgggagtctgagccaggagatccctcaagtccaggagctgggggctgcagtaagttatgattttgccactgcactccaagcctggggcacagagtgagatcctgtttcttaaaaaagccagtcatgggtggctcatgcttttgtaatatggggtactttgtgaggctgaggctggtggcttgcttgagcccagaagttcgagaccagggtgggcaacgtggcaaaactccgtctctaccaaaattaacaaaaacgagctgggtgtggtgttggcgtgcctgtagtctcagctgaggctaaggtgggaagattgctagaacacaggaggttgaggcagcagggagccaagactgtccactgcatcccagcctgagtgacagagtgaggccttgtctcaaagagaacctctgccaacttgaatgaaaaataccttaatttgtatttttaagaaatgactagttagtaaaacttgaatcttttttgccacagctctattttaataattttttctgttgagaaaactagtagatttcttgaattctaagagttctaacagggattttattcatcttaactattttgacagatttaaaaattatgtagtaagactttatttcaatgttgacaggacgggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagaggggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccgtgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaagcccactgtagatagtgtatattgcttttcacttcagaatttccctgagcttccttcctgtgtggagaacatgtgtgctgtgaaaatagatgtaagtggttacacatacttagttggtaacctcaggaatacttttccgaggccctgatgatcttgcttttattaccatttgcgtaggtaagttctatagagcttaggtttttatttttgagagtcttcctgtcacttaggttaactattcctggaagccctggagaggcgatggtccttccccacattgagagacattaattgcccctcttgtcagcttgcctacaggttctgggagaggagaggtatgtatgtatttaaaaatgtgatgttctccatatttgtctttgccggggagggggttggggagacagtctttccctgttgcccaggctggagtacagtggcgtgatctcagttcactgcaacctctgcctcctgggttcaagcgattcttgtgcctcaggctccttcgtagctgggatttcaggtgtgcactgccacacctagctaatttttgtatttgtagtagagatggttctgccaggctggtctccaactcctggcctcatgtgacccgccccaaaatgctgggattacaggcctgagcctgaccatatttgttttttatgtattaatgctggtggcttcatcctaaacggatttcaagattttcattgcctattaaaaaaatactcgtggctgtcatgttggctcacccatgatcccagcactttgggaggcagaggcaaagcgattgcttgagctcaggagttcaggaccagcctgggcaatgtggtaaaaccccatctctctccaaaagatacaaaaaattggcagggtgtgatggcatactcctgtagtacctcagctacacaggagactgaggtgggagaatcacctgaggccaggagttggaggctgcagtgagctgtgattgagcccctgtatactctagcctgggtgacgaagtgaggccctgtctcaaaaagattatagagacatttccatagattggattgaatgcagattttgagatggcctgaactgatttacatggattcatacattctcttggaaaatttacaaaatacatgtacatgtgaccacattcctagggctccttccggtggtgctgaggcaatgggaacactgcaacctcaagcattgtcttcatgggaagcctgcttatggctgtaagcgaggctgggaaaatctgccctataatgtctccaagttgaatggcattcagtgagatttatggatcctgaagttgcaagtggttagcaatactggtagagattgctggaatcaggatggtgggaagcagggacagtttaccagaaggctactggccaacaggggagttggagaagcattgcgaggtggtgtgagcctggagtaaggtatactaagctcatttatgagcgggttctgggtggagtctgttcagcgaacagagaaccttggcatttctggacacttgaagatactgtggaaaacatccgttgtgactatccagcaacctccaggattaccccatcttactggggtcccatgcaaacccagcctctccatagacttgtgtcctagtgccaagcacctccaatcaggagaccttggtagcattctcaaagcagttccagaaagtctctttttctagattctgaggttagggaggaggtagtctcccttggcagggttcattcatgttcagctaagtggaagccagcaaatactagaggggatttctctcagacccactcagctggggttagccttccctggcaggccttaacctttttataaccttgtatatctgaaaataggatcctctccccaactccactcccctggccctg

SEQ ID NO: 12077 - DNA, 53722 bp, Human
  misc_feature (1)...(53722): n = A,T,C or G
caccctctacagtctatggaaagtcatgggagtctattaaaaaaaaacagacactataaaccaaattaaaagatgggaaaatttttctatcacgttttaatatgtgatatccaaactcccattaagaatttttatatcagtaataagataaaactcagaagaaaaatgcccaattaacaagaagagcttcacctcttaaataatcagaaaaagaaaagcacataatatttacgtcaaagtatcaaaaatgtaaaagttttataataggcattagcaaggcagacggatacaggcacacatctaactctatgtaggatttaacttggaagacaatttgcatttcaatcaatcaaaaaccatttttttttttttgagatgatctccctgtgttgcccagactggcctcaagctcctgggcttgagcagtcctacagtctgagcctccaaaagtactggcaaaacaggcgtgattgaccatgcccagcctgtatataaggatattcatttgcagcattgtttgcaacacaaaaatgtaaaaccaaccggtgtttaatatgcaagatgttaatttatggtacattcttgctgtggaaagctatgcatctgttagaggtgggtctatatgttctgatacaggcagaactctaagagctattaagtgaagaaaaggctgaaaatacatatggcataattccatatatgttaaattgttctatattttaaatgttatacacgtttccatttgtatttacgtaataataatgatccctgagctgtactgttgtatacatgctacaagaaagacccatttaatccccacagcctatgatgaattatccacattctacaggtgacaaaatagaggcacaaagttaagtaatttttgtcaggtgagatttaaacccaggcattctgactcctgtataaccattaagatatgcagagaaagaaaactggaaagatacatattgctgaagatacttattataggaagaggaggggggagggtgaaggaatttgcaagtttttcatagatgtttccatattgtttgaatctcttacaaaatatgttcagcatatttttaaagagaaaatttggggcaaaatacttatttttgtattatgtaaacaaattttaaaataatgtgtggctgggtgcgctggctcacacctgtaatcccaacactttaggaggctgaggcaagaggattgcttgagcccaggagttcaagaccagcctgggtgacatggcaaaactccatctctactaaaaatacaaaaaattagccagtcgtggtggcgcacacctatggtcccacctacccaggatgctgagatgggaggatcacttgagcccaggaagtcaaggctgcaggaagctgtgatcgcaccactgcactcccacctgggcaacagagtgagacccggtcaccaaaaaacaaaaaaaaacaaaaaaaattggtaatcgttttcttcagacattttccgggttcctctgcttaacttgtataggaagtctgaggtttttgtgttggtctttaccttttttttttttttttttttttttaagatggagtctcattctgttgcccaggctggagtgcagtggcatgatcttggctcctgcaacctccgcctcctgggttcaagtgattctcctgcctcagcctcctgagtagccgggactacaggcgcatgccacgatgcctggctaattttttgtatttttagtagagatggggtttcaccatgttagctaggacggtctcgatctcctgacctcgtgatccgcccacctcggcctcccaaagtgctggaattacaggtgtgagccaccacgcccggccctgatctttacatttttaaatattgcattagtgaaccgtgtactgattttgtgatcatagataacccagttaaatattaagtcttaattatcacttagtattttacaacctcagttgcagttataaagtaagggttccacatacctcctaacagttcctagaaaatggagctgtcttggcatgtagtctttattgccctgctaagtttttcatgctgggggtcagactgggagtctgatagaaatttcatttccaccgctggtcctctaaccaatgacttgctgcacaacctgagtggtctcctgggagaccagagttctaactttgtagcaggggacaaagacatgtatgtttgtcaccagccactgcccactttcctgccagaatacttcagcagtctccatgccagtcagatcacccattataaggtatttctgtcatgggcacagctcctcccagcaggaagcacccagaatccagacgagaaaacagtgcagtgctaccggcgactcctcaaggccctcaagactgcacggcttcagcccatggtcatcctgcaccaccagaccctccctgccagcaccctccggagaaccgaagcctttgctgacctcttcgccgactatgccacattcgccttccactccttcggggacctagttgggatctggttcaccttcagtgacttggaggaagtgatcaaggagcttccccaccaggaatcaagagcgtcacaactccagaccctcagtgatgcccacagaaaagcctatgagatttaccacgaaagctatgcttttcagggtgagtacacattgacctgatggtgacccctcggcaaccttcatcacacaccttccccatcctccttagagcagattcgacatttctcccaactcaccttcagcagtcctcttatgtctgtgcatagggagaaattaatattgtaaattgatttcccactggcgataggaaggggtagctaacatggcaaaacactcagcatttcctttgaaaaatatctttgaggctcacgcctgtaatcctagcactttgggaggccgaggtgggcggatcacttgaagtcaggagttcgagaccagcctggccaatatggcaaaaccccgtctctactaaaaataccaaaattagccagggatggtagcaggcgcctgtgatcccagctactcgggaggcttaggcaggagaattgcttgaacccaggaggcagatgttgcagtgagccgaaatcatgccactgtactacagcctgtgcgacagagcaagacacaatctcaaaaaaaaaaaatatgtatacatatatatatatatatatatatatatatatatatatatacacacatgtatttttgaaataccccttgcccagtcttgagttgtgcaagcactgattgtctttctgtcttcctttccgtctatgtcctgctaccctgacttggaggcaaagtttcgtggtttcctgtccttccccctcggctcccctatacttacatgtcttagttggagcttacattgcagcttgggagacagacaaatacaagatgaaacaattatatatcacaggatgaggagagcacaactgtaactgttcacattcctgcctcctaggggacttgaagttctgatctgtaggcctaggctgaaccaggacatttgtgattataatcaattccctaagtgtatgttaggtacaccaattttgagaatcaattttggattatatatgctttcttgtttttattatataccatatacatacatatttgtatatatagtacctgatatatatatatatatatatatatatatatatatatatatatatatatacttctatgttctactttttcattttaacatagtttatgactatattctcattttattaaaaacttgagccaggcatggtggctcatgcctataatcccagcacgttaggaggccaaggcagggggattgcttgaggccaggagttggagaccagcctgggcaacatagagagccactatctctaaaataatataataatttactccagtgctggaatagtattgcttaaaacaaaagaaaaacttgaaagcataactttcaatggtcttttaggttcccattgtataaatggagcataaagtttaaggtattttccttatttttgtatgtttattctaattttcactagttacaagttatgttgcaatgacattcctatctataaactatttcccaccttctgataaattctttctgacagaatcttagaattgaaactactaggtgaaaagatctgcattctttaagattttaaagcatggtactaaattattttccagaaaagttgtaatcatttatacgaacagttataaaattactctctgaccccattctgtcagtttcaaatgctatattttattactaatttgacagctgaaaacagcttattttcatgtcttgttaatttgcgatgtcatttgattatagagacgttaaacatttttttcttcttctttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactaaaaatacaaaaattagcggggcatggtggtacacacctgtagtccgagctactcgggaggctgaggcaggagaatcgcttgaacctgggaggtggaggttgcagtgagctgaggtgcgccactgcacgccagcctggtgacagagcgagactctgtctcaaaaataaatgaaaaataaactaggacatcatagctgccttattcacaatagccaaaaggtggaagcaacccagatatccactgatggatgaatggataaacgagacgtggcatagacataaaatggaatattactccacatttattaaaaagggaagaaatcatcacatgctacaacatggatgaaccttgaggacattatgctatgtgaaataagccagacacaaaaagacaaacgctgtatgattccatgtataggaggaaactagagcagtcgaattcatggagagaggaaggagaatggcagaggccaggggctggggtaggggagaaatggagagctctttaatgggagtagaatttctgttcagaaaaatgaaaaagttctggagattggttgcacaacaatgtgaatatacttaataatactgaactgtgcacttaaaaatagttaagatggccgggcgcggtggctcacgcctgtaatcccaacactttgggaggccaaggcgggcagatcatgaggtcaggagatcgagaccatcctggctaacccggtgcaactccgtctctaccaaaaatgcaaaaaattagccgggcgtggtggcgggcccctgtagtcccagctactcgggaggctgaggcaggagaatggcgtgaacgcgggaggcggagctttcagtgagccgagatggcacgactgcactccagcctgggcgacggagcgagactccgtctcaaaaaaaaaaaaaaaaaaaaaaagaagtttaggaaggagttctctccttgccaactctccaactgctctgcatttcatagtcctgattttcacaaaacactctctaaaggaacattatttttttaagccaccttgtcttctaaaatctttcagctagagtaaagtcatttggatgatttcttcaggtccataggaaatgaatcccccagtggtttccacagtcagagcctcctgccctcgctcacctgctgttcgtgtctctggttggtttcaggcggaaaactctctgttgtcctgcgagctgaagatatcccggagctcctgctagaaccacccatatctgcgcttgcccaggtgacagcagcccaaaaatatacctgtaacatctgaggagagtttgattttaattttttaaaaacaagagaagttttggtctattggtttgacatttctgtaaatgcctcagaatgagtggtgtatgttctccaggttcataattaccttaaaaacaaaatcttgaagctgcagctcctgcttggtcaagtgtcagcttccctgcaggaagaagccacttgcctctgctggctctgatttttgagtccaaaatagcttataggataagagatgagattatggcaaaacaggtactagggtaaaggggtttttcaaaaatgtgcacctggccaaacacggtggctcacttctgtaatcccagcactttgggaggcggagatgggagggttgtttgagccaggagtttgagaccagcctgggcaacatggcaaaactccttctttgctaaaaatacaaaaattagcaaggcatggtgatgcatgcctgtagttccagctgctcgggaggatgaggtgggaggattgcttgagccctggaggtcaaaggctcagtgaactgtgatcatgtcactgcactccagcctgggtgacacagcaagaccctgtcttgaaaaaaaaaaattaaaaatgtacgtatatcctctatcacattttattttttatttttatttatttatttttttacagacagggtcttgtggccttgctctgtcacccaggccagagtgcagtggcatgatcacagctcactgcagcctctacttccaactcctggccttgagcaatcctcccacctcagcctcccaaagtgtcaggattacaggcatgagccaccacacccagccaactatcactttttaactataatttatattttttattttattttttttttgagatggagtttcattcttgttgcccaggctggagtgcagtggcacgatctcggctcactgcaacctctacaccctggattcaagtgattctcctgcctcagcctcccaagtagctgggattacaggtgtgcaccaccacgcccggctaattttgtatttttagtagagatgggctttcaccatgttggtcaggcttgtctcaaactcctgacctcaggtaatccacctgcctcggcctcccaaagtgctggaattacaggcttgagccaccgcgccagcctttaactataatttttaaaagaaaaattaaaataatctgggaagtgaacagctttgggcccccttgggcagctgggcagtctggaagccatgggaaccaccgccggtctccgtagttctgcagcatcgccctggtgctgtagagatgttgtgctgctcattggcgtctgtgcgttgatgggggccccaggagtcagggtctggtcttcagattttccatttcaaacatgatggaaccaagactgataaggttctggagggacaactcccaggctgattgcacggccagaatggcacctaaattagtttacagagggcgataactgctatcagttatgaacgcaggagaccaaagtgctgatcagaaaaatgcttgtcgagaaatagcctttgtactggtctatctgccccagtccatgctgtgcaatgcttctgggtcatctcccaaaagcacagttctgaccagttacctgctgggaagccacacttccgagtgggacgaatcccacaggaccctccagtgcatgaacgtgtgggcgtctctctctgtctctctctggcctcacctcctattttgtccatgtgagtgctatgcttgcttcctaccctcctgcatcccctactggacgtccttcctgtcttcctgccttcctcaaatctccttccagcaaaattttctccattgttaatgtacacgtaactgtgctctccagctgaggcctcgctcagtaacactccctcactcaccctgatgcactctgtccccacccggacccttagccattgctttagaccagtggttcccaagcttgagtgggcatcagaaccacctagagagctaggagagagcacggagaccaagacttaatgtggtgggacccacctgggcctgcacaggcatccgaagtccccaggtgagtctaatccccagcaaggcatgagaaccactggtgtgggcttcttacagcacttctaaatttctgtcttctcctcgtgtgattggtgcatttgctaaccctccctattaaaggtgtaaacctctgtggatattatttatctctaaatgtgaatccctacccaccatccccacacagtgtgactttcagaggtaggaactcagtgacgatgtgttgtgcagaactgacagacataaggaagagctgcgagagtgggcagggaatgctggagtgatacctgccagtgtggtctttagtgaacactgatgacaacttgactgagaaagaaacagggagccagtagtgaaccacttattaacccatttatgcctgaggctgcaattttttgaacttttgcaatcagaccttagcgaagaccttgagcagtaggatataagtaacttccacaggcttagcattcccataatggaacactaggcattcacagagcacttggttctgaccaggtgacagtaaccattagtccttgtcttgaagaagcagatgatcagtgggagggataagacaggtaatgatctaatcaggccaagggtagacaggtacggccagccaggctcgtggaggggagcgcagcactgggggtgttggcatggtcctgtgtagactctgtgaatctgaagttctttgagcacatgcaggccagagacagggcagaggggacatcctcatcagaagtgtggatgggggtgtcgacgaccaggaccatgagggttgtctctgctaaagaggaagtccccagtgcgtactccacaggccctagctcttggcctggctagggataactgggggtggacttcaaacggtggcctgaaatttaaaccaaaaccaaacacccggtaggattcacagggatgactgtggagccatgcgtggctgaaggctccaccacccccatcctggccaaatgtgagggtctatggaggaagcaccaggggcagcactggcctctaactgcctcccatttctggcatacacactccttcacgcattcatttagccatcaacactgcgtgctttctgtgtgctgagcacagaggcgcatggatgagcacataggtgatgcattcccaacaacatacaggcacaggcaccccccgccccctacacacacacacacacacacacacacacacactttctcattccatctccatcttttcctttggaaaatcctgctttggaatatttggtttagtgataaggggagaaacaaaaaagcgtacttctgagaggctgttagtcttgacagtgcttaggttctaatgaccctatttaactactattttcaggacacggtcgatttcctctctcttgatttgtcttatgaatgccaaaatgaggcaagtctgcggcagaagctgagtaaattgcaggtaatttgagcccttttccacattaatgatgaatgcagcgaaggtttcagagagcagattagacatttaatgctttggctactgcataaactgaacttccatcaacagcagagaccggctgagttgtgtctggggagatttccattgcaagcatccctagagaacatcggatgttaggcagtctttcctagaagggatacaaggtttagcttgttaaggtgaatatttacatagatcctctgcttgcttgtgtagaaatctgccgagaattgagattctggggttcattctgagttttaaaaaggcaactcatcaatgggggtgatggttccataacgataagcgtccacttaacaccactgaactatacatttaatggttatgatggtaatttttttttttgagatggagtcttcctcggttgcccaggctggggtgcagtggcgtgatcttggctcactgcagcctccacctcccgggttcaagcgattctcctgcctcagcctctccagtagctgagatgacaggaacacacaaacacgcctggctaatttttgtatttttggtagaggcaaggtttcaccatgttggtcacgttggtctcaaactcctgacctaaagtgatccgcccaccttggcctcccaaagtgttgggattacaggcgtgagccaccacacctggcctgtaaatttcttctttatgtctattttaccacatttttaaaaaaacaaacatttcacacccaggtctactaaatcagatcccagctgtctggaccttccagtaagctcagtactccctcctgtacccagtactgcttttctcaagtctaatgatgcgggctcattagagaaagtgtgttaggagcctcctatccaactaccaggtttctctcttaggcttggtcactgctgtgtgacttacttgcttcattccctggagtcccaactattctcctgtgacaaggtctatctgatggtgcccacgttttctcctgcaccttccgagtgctggcagtattcctataaccctggagagctgccttcctgtgggcctttccaaggatgtctggccactggtatgcacccacattggaccccctgcctcttcaggtttgggcacaaaaccactccccgctgctttcagcctgtgcctcccatgagggaggcagagcagccccctacactcacctgtggttttgaatcccaccatctccgtcaccaaggaggatggtttacctgaggaattatccctttaaaggccaagtttggctaggcacagtggctcatgcctgtaatcccagcactttgggaggccgaggtgggtggatcatgagatcaagagattaagaccatcctggccaacatggcaaaaacccatctctactaaaaatacaaaaattagatgggtgtggtggcacgcacctgtagtctcagctacttgggaggtggaggcaggagaatcacttgaacctgggaggcggaggttgcagcgagccaagatttcgccactgcactccagcctggtgacagagcgagactccatctcaaaaataaaaataaaaataaaaggccaagctcaggaatgtcaaactgagcttcagctacatggaccctccattttacctgaggcagagtgcttgaaatggacaaattagcaccagtcctatcccaatgtctgtgtgtttctagctgtctgtgtagtagacactgctgcttttgttatctacaaataataagatgatctaatttaggggtccccagcccccaggcggagcaccagtactggtccatggcctgttaggaacctggctgcacagcaggaggtgagtggcaggcgagcaagcattaccacctgagttccacctcctgtcagatcagcgaccatattagataggagcacaaaccctattgtgaactgcgcatgcgagggatccaggttgcgtgctccttatgagaatcaaatgcctgataatctgaggtggaacaatttcatccccaaatcatccccatcatcccccctacctcccccaagtctgtggaaaaattgtcttccacgaaaccggtccctggtgccaagaatgttggggaccactgatctaatcaaaggtgacagatgcagccacaaagacatctgagtaacagctattttagtgcttgcttatcccagacacctgggaggcacttcattctcacatcatctcaacctctcaaaacacaccctaaggtttaaacaatttaaccaaggtggtgagctccagggttgggatttgaactagggctttctcattctaagacaccacactgtcttttcaaaagaaaaataagtctcacatctgtaatcccagcactttgggaggttgaggcaggcggatcacttgaggccaggagttcaagaccagcctgcccaacatggcgaaaccccgtctctactaaaaatacaaaaattaaccaagtatagtggcacgaacctgtaatcccagctccttgggaggctgaggcacaacaatcgcttgaacccgggaggtggaggttgcagtgagccgagatggcgccactgcactccagcccaggggacagagagagacttgtctcaaaaaaaaataaagaaaaagaaaaagaagtccaagggtttggaacatgataatgagggtggtattttttaaatcacatatgatcagtttcagttgtttttgtgaatgcctcacctgaacctaaacttgcttgctgcccagggcctgtgcttgcgggctggctgacaaggtttctgggccttacgtaacactctagggtcttcgaggtctgcttgtgcctgtgatgactaaagctgccttttgtcctcctcatggaattaaaccagagcttgttgctaggctaatgggttcagacaaagctgccattttaaaaccatctctgttgtgcggaggtggcgtgcctctgacaggcagcagaggcactgcatggctggtacttgaggatgtgattttcagtctcttccctttttccatcacaacattttttttttaagatggagtctcgctctgtcacccaggctggagtgccccgtggcatgatctcggctcactgcaacctgcacctctggggttcaagcgattctcctgcctcagcctcccaagtagctgggactacaggtgcccgccaccatgcctagctttttttttttttttttgtatttgtagcagatacagtgtttcaccatgttggctaggctggtctcgaactcctggcctcaagtgatccaccacccccctcgacctcctaaagtgctgagattacaggcatgagccactgcacctggctaccacattttcaagacacttctaccagtgtctgggtaaagcactgaaacttcagtctgtagctggccagccaaatagtaaaactctccctggacaaacttagcagccatttataaatgttctgcaatggttatctattccttttacttccttgggtagggttggcccctcagaggcagcctcaaagattcggaaatgacagctgacaacccctgagctggagagcacactgttccttcctgggattgtggtctcatgcctggtagcatttcccatgcacagttaccacacccaggacagggagaacagctgagcctgccctgagaacaggggctgagttgtgtccacaggagcctgaatcgtgctgcccaccttcccagtgtcccctccctccctgtcctggaaccccaccctccccttgaaggggcctcttcctgtgggctgcgagggaagagggcgaaagcagggcagggaggagcaggcacctgcccccattcccaccctctccccggagcacctgcacagccctctctgagcctcaggggccctcagcggccactccccaacggcacacagctgtctgagggcctgagaacagcctcaagcccagaaatgaagagctgcggcacactccagggttctcggttctgtaggaggcacacgaggaggtcccccatccacttatcagaaaaagctgtgctcccagggagttctccgcttggcagaagacaggctgggggcctccgaggctcctctagctctccagccctgggacatcaccggctgcctcatggcatatccgtctttcaggaaggagaaaacccttgcttccctaagcacgccaccctgggtcatttgtccccactgcattgacccagcacagggagggatgaggactgtgtggagtcacagctccactaactgcgcagtcatgggcaacccgctcggcctctcgagcttctgactccccatctgtaaagaaagtcacaggtggctatgagaaagtaaagactatgcctggctccttttaaagtggttactattggtatcttttggtagcttttagttgctcagaggaggaaaaagttactgtgagtaaaatgaccaaactccaagccccgcaaaaaaggtaatttaaagtgaagtcaaacagcatgtcagccctgagacgttttccttgatactgaaatggctagaaataagaagaggaaattacatttgcttccattttaatgataacagctaatataacttttctttttctttttttttttttttttgagatggagcctggctcttgttgcccagactgaagtgcagcggttcactgcaacctctgcctcttgagttcgagcgattctcctgtctcagcctcccaagtagctgatattacaggcgtgcaccaccaagcccagctaatttttgtatttttgataaagacagggtttcaccatgttgatcaggctggtctcaaactcctgacctcaggtgatccgcccgcctcaacttcccaaagtgctgggattataggcgtgagccaccacacccgctgggctgctgtaactttttgttttggaaaatttctaacatccaaaagtaaaaagaatgatgaacccctacgaagccatctccagctgcaagagctattattggctcatagctaatcttctttcacctaacctataacttctatctcccaaactagatttttaattaaaaaaaattttttttagagacaggatcttgctctgtcacccaggctggagtgcagtggtgcaatcatagctcactgcagccttaaactcctgggctcaagcgatcctcctggctcagcctcccaagtagctggaactacaggcatgcaccaccacacccagctaaccaaactggattattttgaagcaaatcccagacatccatagatggtggcctcttaactaagcttcttaagtagcacaggctctggatgtgagcagtggccttgttcctgatcctaacaccgtgcctggctctaagaggtgccctgtaagcctgtgatgaaagaagaggtgaaggtgggggttggtggggagggtagactatgttattgaaaattgtagatctttctccttcagagtctagagttgactcctttaattaactgagatacttagaggtcatttccaaagccagagtaagtgccacagcttctcatcttgaaactctgtccctgttatcaagatgctttccaggaggcttcagttcacttgctggtccttctctttttcagaccattgagccaaaagtgaaagttttcatcttcaacctaaaactcccagactgcccctccaccatgaagaacccagccagtctgctcttcagcctttttgaaggtgagtgggccattgctgaagaggttttgagtgacatctggtgcactggtgtgctaggtagcagtcttgaaagtccggggttccaatgggaggaggagcatgggaggaagactagtataaaagcccaccccagactgggttagtgtactatgccttcctactgatggtcccttgcaaccatcccccattgacccaagaaagaggagaggttcgacacaaggatgcctcttatggacataaagatagttaggcctcagctgtgagttgtaagcatggaaaatcatctttgcctccttttattacctctccctccaaggtctctcatctctgctcctcttggcagggctttcctctgcccgtctctctccagccagccctctccacttacccttgttccatgtccccattatctcagtttgcacatggccctggtgggtacctgaccaagatgctaagaactttcaagtgtaggactcacagctcaagggccatcttcctagtgtctcttagttcaaattcttgaaagtgaatctgattgttggccatggatcaggaggctgcttctggtccaatcaagtcaggggaaaggtggggtctatgatagcattgaggctggcagtcactggagactctgcaagaagggaggaaggggcagagaggaatgtgcctgagggccctgatattcactcttgtctgtctgtcactcttgtccataggccagagtatgggagaagtcagtagtgttctttctaccactgtgtcttagtctgtcttgtgttgctataatagaatactctagactgcgtaatttatagagaaaaaaggtttatttagctcatggttctggggactgggaagttcaagatcaggcagccacatctggtcagcttctggtgagggcctcatgctgcatcctaacctggcagagaagtggaaggggaaggaagtgcctgcaaacagataaaacaccagaagcagcctcactttataacaaccactgtatggtaactaatccagtcccactagaatgggaactcactcactccctggagactgcactaatccctgaaggcggatccctcatgacccaaatgcctcttaaaagtccataacctctcaataatgttacactggcaattaaatttcaacatgagtttttgtagggacaaaccacatccaaaccgtagcacacctggaccccatcccagcaatgggttggctccacagggcccctgaagtttatccatagataccatttaataatgcttatctgaactcacctttgatggcataacaatttctgttcttagatcccacctctctctaagtggttaaaattgtaccttttctgtttatgcgtattttaccacaattttaaaaatattccacccctttctgatctttgagttcttctaaatcaattgttcccaaagttgtggtccccagaccagcagcatcaacattagcatcacctgggagctcattagaaatgcatattcttgagccctacttgagacctactgcatcagacactcttggggtgggaccagcaacctgtgttttaacaagctctacagatgattttgattcaccttgaagtttgagaaccacttttaagtaataagtaagtagaattcacttctaagcttttaaagtcgttagcccatggtattttccaaaggggcttggaaccactgcttggagtttgggtgtgtcgtatgagcgaggaaaactgttgatttcagacttgcatgttcttagttggcatttacatagagttaattcaatttcttctcttacagccataaataaagaccaagtgctcaccattgggtttgatattaatgagtttctgagttgttcatcaagttccaagaaaaggtaatgtcaggttgcctattgaactatcaataactgatatttgtagaatactctgtttcttttacatgtataatcttataggactgttgtcatcaactcttgggccaccaagttgtttattgccattcaattgatgagaaacaaagactcagaaagaaagtagggagtctcttactgagtgggactcacgaggttctgctttctcatctgtcagttcgcccaactgtgcgcaactagcatgatggctcacacctgtaatcccagcactctggtaggcaaaggtgggaagattgcttgagtccaggagttcaagactgggctgggcaacatggtgaaactctgtctctacaaaaaattacaaaaatacaaaaattagccaggcatagtggtgcatgcctatggtcccagctacttgggagactgaggtcagaggatcgcttgagcccaggaggcagaaggtgctgtgagccgagattgtgccactgcaccagctaggatttgaactcctgccttctagtttaagatcttgctggagacagtgtgagcttgtggaagagtggccaggttaaagatagatctgaccatcccactgaagttacatgatgagtaagagaaatgggttctctgtgcccatttcctcaatatgaagggtgaaacatcctccctggaaggagacagcatagacaggaaagccagctgttgctgcaagccagatgcctaacttgacaacattctagggacagaggtttgaatctatggtggggttgtaaataatatcttactgagtgactcaagtgccaaagtttgcaaatgatatgctttaaaaaattagagcagattgccgggcacggtggctcacgcctgtaatcccagaactttgggaggccgaggcgggtggatcacgaggtcaggagatcgagaccatcctggctaacacagtgaaaccccgtctctactaaaaatacaaaaaaattagccgggcatggtggcgggcgcctgtattcccagctactcgggaggctgaggcaggagaatggtgtgaaccctggaggcggagcttgcagtgagctgagatcgcgccattgcactccagcctgggtgatggagcgagactccatctccaaaaaaaaaaaaaattagagcaggttttgaggttgtgcccataattacattgctttcatgcacgcatatcccaatacgctcttgagtgaatgagaaaagaatggcatggtagccagcactgggaattgcccagaacctcagcgctcctggagggatgttacatgcatgaagttcatgcaccatcccttagggtgggacaaaagctggagacaataattgacttccagaccttcaactagagttctctttgtcactcacctctgatatttccagtgcagccctgttcagggtcattcagtgccaacacctctttgtacctttcctcttccagtacttgactgtcctgagccatatcctccttctattgttccatcctctcaatccacttcaaatcagcagttcagatcaacagacccgcagcagcagctgtacctcaggctttgtgtggcagtgtagacttgcaatagacagacatgggttaccactgcttcctgaccacacttggagtcagccaagaaggactggctgtggcttcacaaaagaaaactcaagaagccgtaataaaatgggttccctgaaaagccagtgattacaagtgacaccagctcggagattctctcagcacttggtggtgctttgcctgaaggggagggccaacacaggcttacattaaacggacagccaggggcccctactcaggaggatgtggttggagaacccgctgaatgcaggggcggtgggtggggagtgattcagaaatgactaacgtagttttctccttcagaattctagaccttataggggagacagagcggcccctgaacaactctcacatgagaatgtggcaggagacacacagcactgcaccctaaaaaagggagaacttaggagccctgggtgtggagcctgaggtgccgtcatgtgctaaatccctctccatggccggcaaacccagggttcccagctccaagcctgtacagcaagttctgtttcatcccagggcagtttatttgtttccttaaaactcttcatgcaatccaggaggacagtcagggccaggagggctgggtaagagcgaggttcggagcagcggacgctgtgtttatgggcaccgtggatacgcagaggctgagcaccgaggggacgcgacacatccccagctgcgatccacagtcgcatatgttttgggatcatctacgaaggaaaggatcatttccctttccccctaatctagcaaatgtcagggagttgatgctgagtgaaacagaaggctcttaggttcggaagacgcctcctgctgggtgacccggccccaggcttcgctttttgagaggaagatccctgtgcagtgttcctgtcacttctcccagttctgcgctgtgggccagcctggtataggtgccatcggctctccacacgatggctgtgtgacagggagatgctcttgtactccacgtccttttccccaggcatgtgccacactcctcaaggccgacctctgctggctgtaatttgcagcatgcatgctttcctgcctgcatgacatgactcaatttagaagttggcaatcacaattgaaaaaaaagaaagaaaaaagaggaaaggagagtgggagggaggaaaatggactagaataaaatagaaaaatcagaccacattttgtataaatgcagcatgcacttttatgtgatgttttatttcatatgcatatacatatgtacatgcatatacatgcacataaacatgtatgtgtatgaggttaaaagcacagaatctgctccaccacctgcaagctgtgtgcaaggagaagttactcataatcaccaggaatccaggctcctttgttgttgctttgtcacctttaacaaggtttctacctcatggttcagggtggatgcttgagctcctgccattatgtcagaaatccaagcagcatgaagaaaggaagcagtagccaggactgatattcaactggtccacatcagtgtacttctgtaccagctgataaatagctgctggctccctgaaatcaggaagttttccatttctttttctttttttagacggagtttcactcttgttgcccaggctggagtgcaatggcgtgatctcagctcaccacaacctctgcctcccgggttcaagtgattctcctgcttcagcctcctgagtagctgggattacaggcccccaccaccacgcctggctaattttgtatttttagtagagacggggtttccccatgttggtcagtctggtctcgaacttctgacctcgtgatccacctgcctcggcctcccagagtgctgggattacaggcatgagccaccacacccagcccccgtttcttttagtctcagtttcctcctgtgtaggatgaggataaatcattgtagtacccatctcataaatttgttgggaaaattaaatgagataatacacatccattcttattacagtggccagcgcagaatcaaggctcaataaattggagtcattgttattattagctatgttttacaaataatgaattataagaagaataaagtatggtactaacactgaagacaatattcaagggcaatctaatacagagaacagtagcattgttcctgttttaaccatgaaagagcaagaatcactcacctcagaaggggtaataataataattttcccatctgccagttacttcctgcccatggctttgcagatatgacttttgactcagtgtttctggaatcttttctgattaaacacagtagtcatccgtagggggcatttgtaactgccagcgtcattcattattatgtccctttttgtcccttcaatcctgcagcatgtcttgttctctgactggcagcctggcccttcagcctgaccagcagcaggaccacgagaccacggactcctctcctgcctctgcctatcagagagtctgggaagcatttgccaatcagtccagggcggaaagggatgccttcctgcaggatactttccctgaaggcttcctctggggtgcctccacaggagcctttaacgtggaaggaggctgggccgagggtgggagaggggtgagcatctgggatccacgcaggcccctgaacaccactgagggccaagcgacgctggaggtggccagcgacagttaccacaaggtagcctctgacgtcgccctgctttgcggcctccgggctcaggtgtacaagttctccatctcctggtcccggatcttccccatggggcacgggagcagccccagcctcccaggagttgcctactacaacaagctgattgacaggctacaggatgcgggcatcgagcccatggccacgctgttccactgggacctgcctcaggccctgcaggatcatggtggatggcagaatgagagcgtggtggatgccttcctggactatgcggccttctgcttctccacatttggggaccgtgtgaagctgtgggtgaccttccatgagccgtgggtgatgagctacgcaggctatggcaccggccagcaccctcccggcatctctgacccaggagtggcctcttttaaggtacttcccaaccctgcagctcctactaattggaggagaaaggacattggctggaagaaagtcattttctctgttttcttccatcagcaagcctttactttttgttctttctttaaaggaaatcggggagggaaggaaccataaattgttaattaaattgttaatcacctggccaggtgcagtggctcatgccagtaatctcttcactgtgggaggccaaggcaggcagatttcttgagtccaggagttcgagaccagactgggcaacatggcgaaatcttgtctctgcaaaaaaaatacaaaaattagctgggcatagtgttgcacgcctgtgatcccacctacccaggagactgaggtgggaggatcgcttgagcctggtatgcagaggctgcagtgagccaagattttgccactgcactccagcctggtcaacagagcaagaccctgtctcaaaaaaaaaaaaaattgttaatcaccttattttgtccagaccctctactggtacttttaaaatataatagttattacatactcagaatagcactgatggatgagtgaggctcagacaggataaacaatgtggtcatgatgacattgctagtgagtagccaggtggaagtcaggatttgagtccgagtcttcttgactccaaatcaagttcctcatgtcagtgacaagtgacagaaagctcaacccaaagtgacttaagcaaggagagaatttacacattcaggaggttgaaaattcttcatttagcctgatcagggtggaatttgatcagagcacaagcgatgccaccaggacccagttcctctcctgttcccctcgttggctttattcttgggctactttgcagccagatggcagcagccctgtttctgttatttcatgaccagtagggaaaaaagctcggctcttttctgtccttcccaacagaagtgtccctgtgtctcatggtctctcagtgggtcgcatacccaccctgaactcattgctgggtcctggccaggaggctgtgacaactgactggtgtgggccaaggacccatgctttactcctcaatacgctcactgagagctgaggaggcagagagggaagaggcaaggaggcattggctttccagacgccagtcagggcatcgtttcaacaagaaggggatgtatacacttggcacaaaattttaaatggctataggtcttttccattatttccctttttcttcggaatctcccagaaaacccaccagctttctttggcagcgttcttcaggatggacatgttagtctgccttttccctgtcactgtttgggttccattcttaaagatgagtatttccggccgggcatggtggctcacgcctgtaatcccagcactttgggaggccaaggcaggcagatcacctgggaggtcaggagttcaagaccagcctggccaacatggtgaaatcctgtctctactaaaatacaaaaattagccagatatgttggtgggcgcctgtaatcccatctacttgggaggctgaggcaagagaatcacttcatcctgggaggcggaggttgtagtgagccgagattatgccactgcactccagcctgggcagcctgggtgacaaagcgagactttcatctcaaaaataataataataataataatactatttcctgtgtcccgtgctaggtgttaaagaggggtcacagccatgccctggacatgttataaccttttggggaagatgacactaacacacgtagcaaaattacagaactcttcaaaaagaccattactagggtgagctggaacatcatgaataaataactcaatgaaatgtcaaacattgtagcacgtaagtcagagtttccattcagctcttgagcagcaagtgactgcacatatggagccattccaccacccaccttctgaaaatggaaggtttgaaatcttctgtttcactccttgttgtaaaacttatctaaaccttttcttcttaggcttttcttcccctttgaactgtggctcttgagatatctttacagagactttgatgagaaagtccccttcactcttctccttcaattcttccctttatttattagttcaatgttagaatgccattgtcttagtgagcttgagctgcaataacaaaacaccatagactggtggtttaaacaacagatatttatttcccagcattctggagctggggaagtccaagatcaagggaccagcatgtttgggttctggtgagggctctcttcctggcctgcaggcagccaccttcttgctgtcctcatataggggtggttggaagaactcactggtatcttttcttataaggacactaataccaccaccatgagagtcccaccctcacgacctcctctaaatctaatcacccctcaaaggccctatctccaaataccatcacattggggattagggcttcaacatatgaattttgatgggggaactaattcagttcatagcaactattaaggaaaaaatttaaagaaaaaaatgtcttgggccaggcgcggtggctcacacctgtaatctcagcactttgggaggccgaggcgggcggatcacgagatcaggggttcgagaccagcctggccaacatagtgaaaccctgtctctactaaaaatacaaaaattagccaggcatggtggcgggcacctgtagtcccagctactctggaggatgaggcaggaaaatcgcttgaacctaggaggtagaggttgtggtgagccgagattgcgccactgcactccagcctggtgacagagcgagactccatctcaaaaaaaaaaaaaaggtattttattattttagagtatttccttccagtcttggcttctttgcatttatgatgttgtcacagggcacctcagattgttgctcactgtttacttgatatcatgtcattagcacttttccctattattaagcagttgtgatgactgtttttgatggttgtctaatattccactgagctcccttcctgacactggctaatttagaagaaagacatccttgcttttgggaaaggagcacagtttgccattcgagtttagaactcaactaaagacgaatatttgggatgtgagaagcagccaggcgttttagtgattatggcatattttgacatgaaattcttcagaggtaagtgtcatcctcttcagatgataaaaaggaaaaaggaaagcaagctaagatttagcaagctcactcctgctctctgagtttctgctcaatgctttatatacacgtatttaatcatcccagatggatccataattacccacttcttgccaacaagtaagctgaagttgagagaataaattgtccaagttaacaagttagtaacagagtcaagatttaaatctaggcttgttatatttcagacaccctccttttgcccctacttcccacaaaaagctgttgctgtttgtaagagcatgagttaagtctacaaagaaactcctagtttggtttttcttccgagattccattaaatagaaagaagaacaaataagcaagaaagagccctcctctcccttgtgtgctaattaaaataatcctccccatggactaatttctcaaaaagcacttattaaggacagaggcagaatagcagtgtgggtaacagtaacaggcttggaatcagactgccaggggcttgttctcactttactcctgactcttggccttgtgaagttactacacagctctggatcttgttttcaccatctctatagtggtgataataattgtacctgccatatgaggttgtggtgaggattacatgagagaattcattaagtagtaggtgcccaatatatgttagttgttattgttaatgtggttgttgatgctgttattttgttgacaattttgaagaattgctgttgacttgttgactttgttgatgatattggtgttgacttgttgacattgttgacttgatattgttgaccttttcacattggtgttcacttgttgatgccgttcatgttggtattgatgttgttgacatcaacatcgttgatattattgacttgttgacattggtttggatttcttgacattgttgacttgttgacattgttagtatcagtcttaacttgttgtttatgttgttaacttgttaactttattattgacttgttaacatcattgatgttagtgtcaacattgttatttgttgatgacttgatgttaacattagtgctgatgttgtcaatattgacaatgtcaatgttgttgttgtctttattgacttgttgacattgttgttgacttgttattggttcattagtcctgttgttgtcattgttattattactaatcactgtatttccttcttactttttcacaaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaagggtaagaacaatggatgtgccagtgattggaaggtgggtggtacttctccaagtcttcaaagtttcgtttaataagacaaagaaagtctcctagagaaatggagccaaagaaagcataatagtggggagtccttcacgtcagctccctaactctctttcccaaggttcattcatgtcattcacgtctttgctcctgtggtttttttgttttattttgttttgtttttgagacagggtcttgctgtgttgcccgctggagagctggagtgcggtggcataaacatcgctcactgcagcctcaaagtcctaagctcaagccaacctcccacctcagcctcttgagtagctgggaccacagtgcaaaccactatgcgtggcttattttttttttttttagacatggggtctcttcacattgcccaggctggtctcaaactcctgggctcaaacagtcttctcacttcaatcctcccaaagtgttgggactacaggcatgagccaccatgcctgacccagtgtccttattgcctagaatacctccctctacattctgcccatctgagtcctatgcagtcatcaagcctcattatctttttttttttttttttttagaatcagggtcttgctttgtcacatagactggaatagagtggcatgttcatagctcacttcagcctcaaactcctaggctctagtgatcctccggactccaacccattaactcttccctcattgctccagccacactggtcttcatttcctttaattggctataaaatctacattctatgtcattgattttgatccaattgatccacatctacggtctcattcttacctgacatactatttcatatgtctttttattccaattggaaaggtatggcaaatagatttcatctcacaggtcagtcctcagttaacccaggatgttcttatcttgagctcattaacttaattacatctgcaaagatcctttttccaaataaggttatattcactggcaccacgggttagaatttagacatatctttcgggggtcaccattcaatgcactgtatcagggaatatatgttttaggctttatttatttatttattttaattttaatttttttagacagggtcttgctctgaggagtacactgacctgatctgagctcactgcagccttgacctcctgggctcaagcgattctcccacctcagcctcccaagtggctgggactacaggtgcacaccaccacaccaggctaattttcttttcttttttctttttttttttttgagacggagtctggctctgtcgccgaggctggagtgcagtggcgcgatctcagctcactgcaagctccgcctcctgggttcacaccattctcctgcctcagcctcctgagtagctgggactacaggctcccgtcaccacgcccggctaatttttttgtatttttagtagagacaggttttcaccatgttagccaggatgatctcaatctcctgacctcatgatccgcctgcctcagcctcccaaagtactgggattacaggcgtgagccaccacgcctggccacattttttttttttttcaatagagacagagtctggccatgttgcccaggctgctttatttcttttttaaaatatgaaatatgttgtcacttaatgtcaatattactaaacataaacaaggaaaagcaaaagcatattgttaaaagattgatttatgtattttatataaaaccaagacaccctggtggtaacacatgggacacatcccctccactatttatttgaagatggggatgctcctttggtttgagatttatggccacaaaagtggcctgatgttttgtgaggatcttgtggattttccttttatccattctgaggaggaaaaaggatgaacatttggggggtaacccaagtcacccccaaaactttcatgtcaaaaggaacactttttaaaagcaacattagtaacagagactatacttctaatttttcaataaaaactattttattgaaaaacagtcctcgctggtccgaggtaataacttatctcagttgactgttcacaaccagttacagatcaaacagcttctaatacccttctcccccttctcactactgcactgactagtctttaaaagataaataaataaaataatggtgcactagctcactcctgtagtcagtcccagctacttgggaggatcacttgagtccaggagtttgagaccagcctgggcaacacagtgagaccccatctcaattaaataaatccataaataaataaatctaatttttatttttcttcacagctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacgccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaaggtgtgtgagggttcagttccccttaaagaaatcttccaacattccctgggtcatatgcctgaaatgttttgccgggatgatttatgaaccatcaatagatctctctcttaggtcccaactccataattctttatctgtttgggggttatatgttccttgagaagctgggggaaaaaaggctatggttgtctctgcagaggaaaaatacaaacactacacacacagggtccctagcagaatattcatattgtcatgggtccattcattcattactgagcaagttctattttaggtgctgggaatacagcaatgaacaaaacacaaatttctgccttcgtagagcttatcccatgcaccccagaacaagaaagttgtgttaattcaaacttccttttttttttttgagatggagtcttgctctgttacccaggctggagtgcagtggccaccgtgcccggctaatttttttgtatttttggtagagatggggtttcaccatgttggccaggctggtttcaaactcctgacctcaagtgatccacctgcctttgcctcccaaagtgttaggattacaggcatgagccactgtgcccagcctaaaaatcaactttttgtttcattgattttttttttttgagacagtctcactctgttgcccaggctggagtgcaatggtgtgatctcggctcactgcaacctccatctcccgagttcaagcaattctattgcctcagcctccccagtagctaggactacagatgcattgggcttaacttcctaagtgggctgaagatcttgaatttggggcatgtttctttaccccaagagaagaatttgatttggagatgatcagtcattaatgcttgctgtggggtcataggtactggcagaaaagtaagatcaacagatgatctgttggtctctcagggtgtatgtcacttttaggaccacaaccttgaattgaggagctggcagtgggttggctgcatggaggtcctgactcctggtgtcaagctctcctctgctccctttgggatgttcccagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcaggtgaggagttcaggatggtgggacaccagtgactgcacacctgccctgtgccaggctctgggctcagtgctgggaagggcagatgcatgaacaggagattccagcagacccatggaggggcagcatggggtctgggaggtcctcttccagacagcctggcttcttcacacccccaaatttacccagaccagcatggtgaggctcgctgtcctgagatgggtgcttgcagggccagatggagcagggggagcctgggcagaagtacttgggcaaagacacacaaatacagtcacgcattgctcacaacagggatttactctgagagatgtgatgttaggtgagttcatagttgtgtgaacatcacacagagtgcacttacacacacctagatagtgtagcttactacacacctaggctacatggtatagcctagtgctcctaggctacaaacctgtacagcctgttactgtactgaatgctgtaggcagttgtaacacagtggtatttgtgtatctaaatgtatctaaatgtagaaaggcacagtgaaaatatggcataaaagctggacagggtactcaccatgaatggagcctgctggactgggagttgctttgggtgagtcagtgggtgaggggtgagtgaatgggaaggcctaggcattactgtacactactgtggactttatgaacactgcacacttaagctacactaagtttattttttaaatgtttttctttcttcaataacacattaaccttagcttactgtaacatttttactttattaactttttaattctttaaacttttttactcttttgtgataatgcttagcttaaaacaagcacattggtccaggtgtggtggctcatgcctgcaatcccagtgctatgggaggatcgctcgagacgaggagttcaaaaccagcctgggcaagacatggcaaaaccctatctctataaaaaaatcaaaaaaattagccaagtgtggtggtgtgctcctgtagtcccagctactcgggaggctgaggcaggaggatcactcagcctccccattagctgggattacatgcatatgccaccacacccaatgaattttttatttttaatttttttgtagagatgggggtcttgctatgttgctagggctagtctgaactcctggcctcaagtgatcctcctccctcagcctcccaaagtgctggaattacaggtctgagccacagcacccggcctgcatgtgctatacttttatactgctggccatacggtagatttattgacatgagcactgccacaagcatgaataatgcagtgctctacaacgttatgatggctgcaaagcactaggcaataggaatgtttcagctccattataatcttatgggaccaccatcatatatcaggtccgtcattgaccaaaacactgttctacagcccatgactatgacgagtccctgttggacccctttattccccagctagatccttccaagcaggcagtttgctcacattggctctcagcatgggcctgagcttattctgatgtcctaaaaacatcacaccactactgtattcatgccaaaatgaggcttactcatacagaaaataggatggttttattttgtgcaagaaaaatggaaaaggcaagagtgacttgcctggcagttagtggtggttcctgctttccatcttctgtctgcgtctgtctctgtgcaagagtgggcctgccacatgcgtagagaaagccaggggagttccgagactgagcgggggccagagcaggctcccagaggaggtaaccacacttggctaatttttttgattttttttatagagatggggttttgccatgttgcccaggctggttttgaactcctgggctcgagcgatcctcccatagcgctggggttgccggcgtgagccaccacacatggaccaatgtgcttgttttaagctaagcgttatcacaaaagagtaaacgtcctgacttgagactcacccagtgaaagaaaggaggctgtgagtgcttgactgaatgacttaataagaccatgtcttgtcatcttgagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggcgtgtcccactaccgtttttccatctcctggtctcgcatcctccctgatggaaccaccaggtacatcaatgaagcgggcctgaactactacgtgaggctcatcgatacactgctggccgccagcatccagccccaggtatggtgggtcctggcaaggccttgggaaagtccacatgcaggaaccagcagggctgggggagcacatttatcatgtaaacaaaatgctggtttcaaatttagcttttgttgttattgttgtttttgagacgtagtctcgctctgtcacccaggctggagtgcagtggcggatctcgtttctcagcctccagagtagctgggcttataggcacgcatcaccatgcccagctaatttttgtatttttagtagagacggggtttcactgtgttggccaggctggtctcaaactcctggcctcaagtgatccacccgcctcggcctcccaaagtgctgagattataggtatgagccaccgtgctcgacctcaaatttaactttttaattgtcagtgaattcatatgatgcagaatttgaaaagcataaaagagtttccttcccaaccttgacctcagccatctagttctccctgaaagcaatttacccttttcccaaaagaaaaagaaaaaaatctttgagcctttttgtctcataagtcactctcaggatttgcagcagacgttgatgctggcacatctaacctagggcttcccatggaaagcatgactgatgcaacagctgatctggcttcttcccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgttgaatgagccctttgtcattgcttaccagggctatggctacggaacagcagctccaggtaagtcccagccctggctcataggctctttgaatcatggcattcttagcacatcaagagttgaaatccagatggcacaggacgaggcaaccaagaaagccccatggcagaaaccctgcctcttgctcagggctgtagaggtttccctcctggcattgcattgttaaacatgaatttcacatctcaattcctcaaggtgggttcatttctttgctctgtgactctgatcggcctcaggtgggaagctctctgagatcagagatgtgggcaaattgatgtggggaaggacagtttgtcaggctgtacaggtctacagtctatttccacaattcccaaaccccaaagtttctgacaattggtttggctgacctgagctcatttaatagtagtgaaacctgactcaaaccaacaggaggctgctcatggtctttatcgcactgagcaaacattcctaagttctgctgcagagatatcagtgtgcttgactatggagagctagctgtctgcggcccatggggctgataggtacttttctcaaaggaaacatttaattccaaaacacatctgaccctaaaagattttttttcttttaactttggttgacatgcaataattgtacatatgtatggagtacaaaatatattttgatacatgtatacaatgtgtgatgatgaaatcagaataattagtatattcatcacctcaaacattcatcatttctttgtgttgggaaaattcggagtcctcttttctagctttttgcaaatatacactaaattcttttgtatcattattttttattcattttttatttttttgagacagagtctagctctgttggccacgctggagtgcagtggtatgataccagctcactgcaacctccacctcctgggctcaagcaattctcctgcctcagcctcccaagtagctgggattacaggcatgtgtcaccatgcccagctaatttttgtatttttagtagaaatggggtttcatcatgttggccaggctggtctcgaactcgtgacctcaggtaatccgcccgcctcagcctcccaaagtgctgggattacagatgtgagccactgcacccagcctaaattattgttaactacattcactctacagtgccacacatcactagaacttcatcttcttatctagcttaactttgtatccattaaccaacctctccctgtcctccctccctactacccttcccatcctctaataatcacaattctattctctgctgctaggagctcatctttttagctcccacatgtgagtaagaacatgcagtatttgcctttctgtgcctgacttatttcactttacataatgacctccagttccagcgatgttgtcacgaatgacaagattcatccttctttatggctgtatagtattccatcatatatagatgccacattttctttatccattcatctgttgatggacacttaggttgattccatatcttggccattgtaacagtgatgcaataaacacagaggtcaaggtattgatttggtattctgacttactttcctttggataaatacccaaaagtaagattgcgggatcccttagggttttgaataagaaattgtggacctatttttgtgccttgagaaccatccagtttcccttttatctagttctgagttaataagaataaatttgtgttcattcatgtgattcctcagaacactgtgtaacagctggaaagagccaccaggagatgtgcctcaaatcgttatcagaggcatctccattggtcctagttcgcccctttggtttacactccttcaacacatgagaggcgcctctcttgcagcattcactatcagggtatctccgtgtcagctggttgcattagctacattctccaaccctaatgatcacaatgggtccccaaggagctccagattatcaactcctgtcaattcatttgagcccaggagttcaaggctgccgtgagccatgctcatggcaccactgcactccagcctggatgacagtgcatgaccctgtctcaaaaataatcataggccgagtatggtatctcacgcctgtaannnnnnnnnnnnnnnnnnnntgaagaaacgcacgaagcgagtaaagaaaggcagagagtaaagactgaataaaaggggaaggagaagaagaggagaggaaggggggaggaggatggtaggagattaagattgagagaggggggggggtgggggggggaataaaaaaaaaaagggccccgggggggggggagtaaggaggaggggtgtgagggaacgggaggggggtgtagggaaggatggagcaaaggaggcaggcatagtggcggggcggcggaaagaagaaaaactcattaggttgagtcaggagaattgtttgaacccctcggctcactgcagtctccacctcctggattcgagtgattctcctgcctcagcctcctgagtagctgggattacaggcgcctgccaccacagctggctaattttttgtatttttagtagagacaggtttcaccatattgggcaagttggtctcaaactcctgacctcaggtgatccacctgcctcagcctcccaaagtgctgggattatgggtgtgagccaccctgcctggcctgggttgtcttttaagttttaaaaaatcatttgtacatatagtcctttctgaatataacattggtttgaagctaactcaatagaaagaaattccatctctttagtctctctagtttgactatagtagctaacagagctgggctgcaatgtcacacttcacctttaggtgccaccatctgatttgatttgctccagcctaagcatttcttaaattgggggctttagattctgcgataggtatctctattatgggtattttgcctgagacgtacgagccactcttctggaggaggggaacagaagccaacatttatcaagtggccttccctcttccagacacagtgctgctgtgggcgggtttcatacactgtttcatttccctctcacaagcactctctgctgcccatttcaccaaggaggaaactgaaaggctgaattactcacccaaagttacacagccaggtaataagagggagagccagggtttgaattccagttttcctagtgtcagaatctacaccccttctcccaaacacagaggggacatctgcaggcagggactaacaatctcagtcacatccattctatccattctctgttgacatccatgtgtatgtttccaggagtctccaataggcctggcactgccccctacattgttggccacaatctaataaaggctcatgctgaggcctggcatctgtacaacgatgtgtaccgcgccagtcaaggtggcgtgatttccatcaccatcagcagtgactgggctgaacccagagatccctctaaccaggaggatgtggaggcagccaggagatatgttcaggtctgtttttcctctgggcacttgttcttactcttgtccatctttccttccagcctaatggaaacagattgtgaatcaaagatttagggtgtggtggctcatgtctataatcccagcactttggaagtctgaggcaggaggatttcttgaggctaggagtttgagactagcctgggcaacatagaaagaccttgtctgtgaagaaaaaaaaattattagggcatggtgacacacacctatagtcccagctgctcaggaggctaaggtgggagcttgagtccaggaggtcaaggttgcagtgagccatgatttcggcaccattaaactccaggtgacagagggagaccacccccaacccccaaaaagaagaattattaggatctaagcctagttttgctattgcctgattttgtgagcttgggaaaatcatctaactttttcgtaccttagtttcctcaacttcaaactggagatgtcctgcccacctcaaaagtttgctgtgatgaaagtgataaagtctgtggggttaagttgtctttaagtttttaaaaatcatttgtacaggtaattctttctgtaacattggtttgaagttaactcctagagagaaatttccatttcttcagtctctctggtttgactatagtagctaacagagctgggctgcagtgtcacacgtcacctttaggtgtcaccatctaatttgatttgctccagcctaggcatttcttaaattgggggctttagattctgtgaaactcattagtgcccctaatttgccaactcaatgagtttaagaacagcatctttcagtcatggaatttcacccaaggaagtagagacattactaggaagccaactgggcaaggtggctcacgcctgtaatcccagcactttgggaggctaaggcaggctgataacctgaggtcaggagttctagaccagcctggccaacatggtgagaccccatctctactaaaaatataaaaattaccgaggtgtggtggcacatgcctgtagttccaactactctggaggctaaggcaggagaacccagaagctgagatcaccattgcactacagcctgagcaatggagagagactccatctccaaaaaaaaaaaaaaaggaagcaggtgccagcatggcctacctttatttccacctgaacccctgactgacaagaggagagaaggaaaagaatgatcctcgttcacggcacagctcctctggctcctcctagaaagggatagaaggtgctctctcctacattttgcatcaggaaggaaaggcaagggtttctctctggattggttcccactttgggctccgtggaagagtctgccaactgtggcactataactctctcgggggaaacaccatgggccttggtttgccaaactcttcacaagagaacttgacaaagatagtcaaattaataaatgcaacgaagggcttaattttctggtctgctagccagctggggaaacagttttgaaacaaaattaatgtatccctcatttcagactcacagaactggtgatttagaacaacatttccttttttcctgaaatcaaaacttcaaacgtcaggaaacgttaggctgtcatatcattagattgagccacttactggtgaactgtgatactgcagccatggactatgacagatgcatctcttattagaatcagcttccacgaaaatatctagtgtgttaccttggagtgggtgcatttaagcctctttaccagggcatgtgtgttccatgcctcatctctgaccatgagtggaagctgccctcaccccacattcccagcagcagccagtgggtgaggagaggatttggagagactacagaaggctctcaaacccccagcatcatagtgtttgggtgccacgtatccccgcacatgataaggatggcctaggcctcattagagaaaataggtcaaacggttccccactctggggctgtgaaagcccattaagagttatgctttgcccggaaagtcaggaaagccttgcatttcagccctccccagaaagttctgtttgctccttgggcactttgatgaggaagtgcagccgctcagtggtgagaaagagaacccggagcctggaggcttgtgggttctcccttctcctctgcaggacccatccaagggcagccaggaagcatttgttgagcaccagggccagtgcccaggtcagttactgtcacctcaagctacaactatgaagaggtggccctgtcctcagtgcaacagcaactgagcaagcacagacccagctgggagacctgtggacactgaagctgcaacaggcaggagccacagggaagagagcttaacctgggggtccaggaaaaggagggaggttgtgaggccaggcacttctgagcggggacgatgctgtctcttgctgtgcccacctgtaacgcctgggctgtctcccccaccctacccgcagttcatgggaggctggtttgcacatcctattttcaagaatggagattacaatgaggtgatgaagacgcggatccgtgacaggagcttggctgcaggcctcaacaagtctcggtaagggcctggtgcccgcagtggtgagggcatgggcgtcggggtcacagaggcatgtctcgggcaagttaccatgactgagcttctttgcttgctgggaagttacatgtgatcatatatgtaaagcttagcccagcacctggcactgctatatgcttgacagaggggtttgctattatggttattatattgtggaacagccaggaaatctgttccaaggctatccacctctgagcaaccccactatgccactccacagacaaatcccagctcatcctatcctatttcatcaccgcacgtgtgaatgtgggtggcagtggctgacagtcaggcgtgtgctttgcatcacttggccagcaggtggcgatggtctgcaccaaagcgtccttccttacccgcccgccccttcttgtcaaggaaggagtagcaacattagcagccaacgtttacccatcttctgttggtatctttatttctatttaaatacgagtaaagtgaggcgcaaagattagggcaagatcacccagctattaagagatagagctgagatttgcagccaagctgtcggcccccagggcgcatgctgggggcttgagaatcatgcaggtggggtgagaggtgtggtgtgaggaagcgcaggaagcggcagtcactgcccacgggaacatgcccaccgctccaaggctggcgggaatcaagtgtgaattctcaacatagtctttgagtcctgcccctagacgcccccatatagtccagctgaggattaaaaatccagctcccaggccgggtgcggtggctgacgcctgtaatcccagcactttgggaggccaaggtgggcggatcacttgaagtcatgagttcaagaccaggctggccaacatggcgaaaccctgtctctactaaaaatacaaaaattagctgggtgcggtggcgggggcctgtaatcccagctacttgggaggctgaggccagagaattgcttgagctcgggaggcagaggttgcagtgagccgagatcatgccactgcactccagcctggacgatggagcaagactctttgtctcaaaaaaaaaaaaaaaaaaaaaatccagctcccacctcacaatgcacaccctggcctagttagggtaagttccccagagcaggctgtgcctaaaggtctgatctgcgaactgtgatctccagcaaaaccgatgagcgcccggcccatctgcacaactttgccgagcacctaccatttgcccgagccagggccagggggaggggtccatggaaggagaggattccattcggctcctcaagctgctgacagatcagctggaaagacagttctccatcccattccccaggctcttcagtacaaagaaaactcagaagatgagatcagggtaggctgggtagacccaggagatttcatggacaaggcaggacatcagctgagctgggccttgacaggggatagaatgtgggggattgcaggtcattctttccacggggcagagttgtgaagacaggcctagaggtaagaatgagtgggggtgccagagctgagagtggggagaccagcccagcagcagtgaaggggctgaggccacatggtggagggcctggaagccaagcacagggccttggctttggtgccacaggccattgctggcttctgagcagaagcgtcagggacaggaggaggctgtgctttggttttctcccatcatctcagaaaccccagggaaggaaggttcttgatccctcaggttaatggtagcagaaaggtcaagatgaaagtgtcagaggcctcagcagggcatctctgggccacacctaaaccagaagccccaggtctccctgtgggcatgcgcatgcattcaggatcacctgtacatgctgcacacaagtgtattagtcaggttctacaggagaggcttttcactcagagtgcctggaaaatgctccatctataggttaagaagccaaagttcccaggctcacaagtaatctcagcactttgggaggctgaggcaggaggattgcttgagaccaggagttcaagaccagcctgggcaatataatgagactttgtctttacaaaaaatttaaaaattatctaggcatggtgacgcacacctatattcccaactacttgggaggctgaggtgagaggattgcttgagcccaggagactgaggttgcagtgagctatgattgcaccactgcactccagcctcagggggcgtgcagtgtcctcaggaggacagggcgagaccctgtctgggaaaaaaaaaaggaagaaagaaaacaaagttcagtgaaatcgtgagaactgagaaattcaaactcaaatactcaatttgcaaattatttcccctgctactttgaagatcttgaagctattattattattattattataattataattattagagttggagaaaagaggcatgcctaaacaaaccccaagaggagcagagaaacttggaaagggcagaaaacggaaatacaaattacacaagatacagggccgggtgtggtggctcatgcctgtaatcccaacactttaggaggctgaggtggggggatcacttgaggtcaggagttcaagaccagcctggccaacatggtgaaaccccatctctaccaaaaatataaaaaatcagccaggagttgtggcaggcgcttgtagtcccagctacttgggaggctgaggcaggagaatcacttgaacccaggaggcggaggttgcagtgagctgagatcgcgccactgcactccagcctaggtgacagagccagactcagccacaaaaaaaaaaattatacaagatctaactttacaaacataggggaagagtctcagatatgtacctcaggcatgctcttgattttgaaatctgtcatagatgctaaatatcagaatttgcatatgttgtttgaaggaaattaaaaactgtttatgcatgtgtgtgtgtgtgtgtgtgtgtgcgcgcgcgcgcgcgtgggtgcgtgtgtgtgtggtccttcaggtttcagaggctcttgtagagacctagggaagccaggtttatggtctggcgggaggagccgcaggtgcttcctgcaccgcctgaaggacctcttctccttccctgccagtttcccctactcactgccaagtgcctggggttcggagagctcccccgccccagccctatgacgttctcttctcaaagcatggctctccctgaagccctgccctcaatggcttcttccacccaggctgccagaatttacagagagtgagaagaggaggatcaacggcacctatgacttttttgggttcaatcactacaccactgtcctcgcctacaacctcaactatgccactgccatctcttcttttgatgcagacaggtaagtccaccaacagggagcccggagccatctctggaaaaggcagaaaggtgcccttggctgtgctctctgaggcctgcccagcctcaaaacagggcctccaacgccgaatgtgccggggtttgcaagatgctcgccaccccacagatcccaaggaaatctccagcaagcaagagggagagaaggccggggtctccagggcacctcccattagggcacatgtgcttggctttttgtttttttatttcatttttaaaatttatttattttgcgttctttttcacaggctgcttaactctaaaaatgcttggttgttaaaaaggattttcaagaaaaaaattgtttaggttttatcaaaattcgctttaatattaataaatattacaataatacaagagtaaaattttattttctctttttaaacaatgcttttatgaagtagagatagtaaaagattttggttcaccttttaagtaacagtttttatttttattttatttattttttttgagacagagtctcactctgtcaccaggctggagtgcagtggcacaatcttggctcactgcaacctccaccacccgggttccagtgattcccctgcctcagcctccaagtagctgggattacaggcgcgtacctccacgcctggctaattttttttttttttttttgtattttagcagagacggggtttcatcatgttggccagaatggtctcggctaattttgtgtttttagtagagacagggtttctccatgttggtcaggctggtctctatctcctgacctcagatgatccccttgccttggcctcccaaagtgctgggattacaggtgtgagccactgcgcccagccgattgtctttttctttatgatatctatttatctagagactttttcatccatatcctgtattgttttttaaatttctctaagttaattttcacctttctctagtacctccttgagtagtttaataatcaaccttctgaattctttatctggcaattcagagatttcttcttggtttggatccatagctggagagttagtgcgaccttttgggggtcttatagaaccttgttttgtcatattaccagaattaacatttctggttccttctcattcaggtagactgtttcagtggaaagatctagaactcaagggctgcccctcagatccttttgtcccacagggtgatcccttgatgtggtgctcaccccctttccctaaggatggggcttcctgagagccagactgcagtgattgccattgcccttctgggtctatccacccagcagaattactgggatctgaactggtgctgaggaatgtctgcaaagagtcctgtgatgtgatctgtcttcaggtctcccagccatggataccagcacctgctccagtggaggtggcaggggacttaagtggattctgtgagggtccttggttgtagttttctttcgtgcactggttttctcaaacgctggttatgcgagcagtgaagttgtcatgtggacagactcaggacctctggttagccaggatgttgcaggcagtggaattagttgttgttttctctttctttggagcagggttcttctgttatgagttgctataatggcgtgagttggttggtctccagccaggaggtggcactttcaagagaggaggtggcacttttgaggtgctttccccttccactgccaccagctgcggtagtagaagggggattacaaggttgccctacgttggccagggtatttgggtttctcaggttatgggcggggccatagagctcccaagagtttatgtcttttgtcttcagctaccagcaaaggtagagaaagaccatcaggttggggcagcattaggcatatctgagctcagactctcctcgggtgaggcttgctgtggccactgtgggggaatagggggctggttctcaggccagtggagttctgttcccaggggtattatggcttcctctgctgtgtcatacaggttgctagggaagttgggaaagctggcagtcacaagcctcacctagctcccatgcagccagcaaggccagtctcactcctgctgtgccctgccaacagtgcgcagggcagagatctcaccccaggccacaagccttctctctgagaaagcaaacagggctttcaggccttgcccctccccacctgcccacactgttggctgtggcttctgtgcttttatctgcacttcttgtttgcccccaagattctgctcaggaaaattcatgcttctagttgaaattaataagttgagctagaagcttccttaatcctgcccctccctaattccactggcttccttctacaaggacccctgtaggataaagtcaggaatggcttccctgggctcaagctggggacagggagtggctacagggctcttcccactgcttcttctacttttacatttcacttggctccctaaatccacttgcgctctaggtaaggttaaatccttctcctatgatctggatgttcaggtccccagagaggatgtgtgttcagaggcagactttccccttctcacactttgggaactcacagttttgcagctgtctcatggagtttgcagtagcattctgcttctttcaaaggtctgtgaattcttttggtttttctggtatgttccagcagtagttcttggagcaacagttaacaatgtgagtctccacacactgttctgtccatccaagtgggagctgtacctaagtcctgtctcttatctgccattttcagaaaatctcattttgttccttttccatcaagcatctttccacaccagtagctctgactgtgtccaggttctttctttgaaaaccagcccctccactcccactgtatcctgaaacccccagagtcaggctcaccaagggggctgaggagactccagaacacccctctactccttctgattctccctccctcttatgagccctggggctgtccctgggaagacctccactagtgcttatgaaatggcccacattcaattcagctgagtcagataaatccaggtgctgataaaaccaacattttttttttccctgaaagatctgagtgtaggaagtgtctaaattcttggttcttatttgacatatgtgactacaggtgatcaggcttctgtggcctcccccagcaggcacccctgtggcaggagctgtccacctcctcgtccatcactgaagagagaggccaggctcttggacacttgaaggaggtgccagcctgtctgctgcctgtcttcacacaaagcagggcccctacaaatattcgtgcctgtggcctcacccgtggtctgcaagtggcattgactagacatgggtgacttgggggagcccattctctgaagacacagcactggcgtccattggaagcctggagctggggacccatagcctttcatagctggtgtaaggagccatctattcagagtagtggagggctgggctccatgagcaagaccattctctgcacaggcagagaaattgaaggacggagagctgagtggcttgtccaatgctatacaagcacagagtgcaggcagctagaaccagcgaaaggaggagaatttgaggcaatttgattcttctgggtttagtatgattcttaaggctagacaaaacctaaggcttttcctggtctaagtcctgttttgtgtttcgtgtaaagggcctcttgagatttacaaaacaagacctcatctttagtttttgaacttgtagaggagttgcttccatcgcagatcgctcgtggccagactctggctccttctggctgaagatgacgccttttggcttcaggaggatcctgaactggttaaaggaggaatacaatgaccctccaatttatgtcacagagaatggagtgtcccagcgggaagaaacagacctcaatgacactgcaaggatctactaccttcggacttacatcaatgaggccctcaaaggtacgacgggcccgcccttccccagcgtgcacctttccctgttggaaacatctgctatctgcaggagtgtgatacagcgtccttgggccacagtaagaagagaacgataaggcttcttgctcctgtgggggttaagctttgctttagggccgcactctgagtttttttccttcctatgtctaagctcagcaagcaagcccagtggcctgatgccaccaaaccctagttcctggcctgagtcacttgctccccttgatcctccctgatgtcggaacagcagtgccctcctgagaatggtctgggtagggcccaggaggagtaggctgtgtggttgcctgtagggtctcttagtctccgagcaaaagtttgaggctcttggctcagccctaacaacttgagatgggaccatgaggataagagaatggaacaaatgctgagtaaaagagcaagcaatgcaccagcaaaggaaatgattagaaaaatcctacccagctgaaatatattctatctaagggctattttctacagggagaagcattaacattctaaggcactgaccaagatcatggatagaagtgtaggtgacccagggaaattagtccacccatgttcccgactcccattcagggctgagcctttctaaagatgctggtggctctacatctccatccacagaggacccgctaacagtcactgcatgcaaagaaaggggcagctttctcacagagctaaagccaaagcttaccgccatctgtgaaggcggtggggagagcagtaggcagacctggcttccgaaggcctggcaggaagctgccttatgagataggaaacttatgcctagtcctctgtgtttgagcagctgtgcaggacaaggtggaccttcgaggatacacagtttggagtgcgatggacaattttgagtgggccacaggcttttcagagagatttggtctgcattttgtgaactacagtgacccttctctgccaaggatccccaaagcatcagcgaagttctacgcctctgtggtccgatgcaatggcttccctgaccccgctacagggcctcacgcttgtctccaccagccaggtgagatgtggctctgggagggaataaagcctaagggtgaagggcaggtggaagggcctctctcagtctgttttcttctagtttattaccctcctctctgctgccccatctccttcattcattcaacaaatgtttattttctttgaatgctccagacatttcctggggtggaacaaaggacacttagggtcaatgttacacctagaaaccagagccctgacctgggaataagcaggtctagactcttcttccagccctaccactaacttgctgtgcactcatagataagaaaccaggcacatgcttcagggcagttataaggatcaaataaagggaccatgaaagtacaatgcctgcaccatgtgggtgccccgtatttgttaaatgtaagagtataaatcactacacaaatgtaaatgacaattatccagtttcaattatacaggctgagaatccttcatctgaaaattcaaaatccaaaatactccaaaatctgaaactttttgagcatgactggcatgacaacacaaatggaaaattcaacacctgaccccatgtgacaggtcgcagtcaaaacacagttaaagctttgtttcatgcacacaattatttaacatattgtatagaattaccttcacaccacgtggataagttgcatataaaacatatatgaatttcatatttagacctgggtcccatccccaaaatatctcattatgtatatgcaaatattccaaaatcttaaaaaatcccaaatctgaaacacttctgatcccaagcaagcatgtcagataagggatattcaaccgtattctaattgctgatagagatgtttaaaaaatacaactgcttaacttcactcagaggctcctgacacacagtgaaaggggatgggtacctccacctcggcatcccgtcaatggctgtgcggatttggggtaccgtgcagcctctgctggggtctcagagatctgagaactcaaatcagcgccagagcaccaaccaccctgtgtcacactctcctagatgccggacccaccatcagccccgtgagacaggaggaggtgcagttcctggggctaatgctcggcaccacagaagcacagacagctttgtacgttctcttttctcttgtgcttcttggagtctgtggcttggcatttctgtcatacaagtactgcaagcgctctaagcaagggaaaacacaacgaagccaacaggaattgagcccggtgtcttcattctgatgagttaccacctcaagttctatgaagcaggcctagtttcttcatctatctttaccggccaccaaacaccttagggtcttagactctgctgatactggacttctccataaagtcctgctgcaccgttagagatgactttaatcttgaatgatttcgacttgctgagtaaaatggaaatatctccatcttgctccagtatcagagttcatttgggcatttgagaagcaagtagctcttgcggaaacgtgtagatactggtctagtgggtctgtgaaccacttaattgaacttaacagggctgttttaagtttcagagttgttaagggttgttaagggagcaaaaaccgtaaaaatccttcctataagaagaaatcaactccattgcatagactgcaatatcatctcctgcccttctgcaagctctccctagcttcacatcttgtgttttccagaaaataaaaacagcagactgtcctttctcctatggttgcccctccttgagaaagtaggttcaagagaagttatgaagtcacacaagccatctggagctccgattaagctttctcaccagaccaagtctttctgttgacattatattccttggggcaaataccacaacatgcagaaagtggccttttcccacccctcgaacacccccactgccactttttatgccatccccagctctcccatctgaccttggttcatttagtctgtttccttcctcctttcccaatttgtggtagttctaaacggcacataggacaactatccatattcctttgtgtcttcccaaatgctactccttccacctaggatgccctttcttctgaaaatgcctttaagtctcagctgaaataatgtacttcctcctctgaatggcttccctgaaatccccaggcagattctccttcgtctgctttgcttgtaaatatcccctattacaacttgaccatccagtttctatactggaattgcgtatttctctatcatcagcttcttaaggccaaggaccatgtctcattgtctctggcaagcacaacttggagagagcaatgaaaagcacaaatgctcctttcgtgtgttcacccattcacatagcatttccagggcagtggtgggagcagagatatgttctttacaatcccctcaaatgtgctgagagacaatctcagtgtgaaacacctaaacacttgattggcccatatattacatctagatagctgggaaaatgttttgtaaaaacagagtaattttgggctggtcttaaaaggatgatcacacttgaaatttgcttcttgtaagcattcctttccctatcaaaacattccaacgccatgagtcccaacctggcagtcaggagcttgtggtgcacaagcatttttctccatcaatcgactggaaaagtttgtcagatgggggtgggggtggttctaaaattgatattaaagacatttgttggccgggcacggtggcgcacacctgtaatcccagcactttgggaggctgaggtgggcagatcacgaggtcaggagatcgagaccatcctggctaacatggtgaaaccccatctctactaaaaatacaaaaaattagccaggcgtggtggcgggtgcctgtagtcccagctactcaggaggctgaggcaggagaatggtgtgaacctgggaggcggagcttgcagtgagctgagatcacaccactgcactccagcctgggcgactgagtgagactgtctcaaaaaaaaaaaaaaaaaagacattctttggggagaaactcagtatcataaggtgccaattatacctaaataatctcaaaactcaacatcacttttttgggacaacactaacaaaataatataaagaagtttcatatatgaaataaacttgtaagaagagccaggataaatctgggggaagaagattaaaacacattataaagctagcttagtttggtatagcagagagcaaacagatcaataaaggaagagaaagcctagacacagaagcatctgcacatggaacagatgcccacctcgcaggcagtgcgcctactcggggcagagggcccatgaaggcagtgagggaacaggctcctggggatgttagccacgggcatgggaaggagccaggtcctttccttggataccagatttaaacatacaaaaaggaaaccataagaatcctaggatataaaaaaattaatttttgaagtgggaaaggtatttataagcaagactcaagacctggaggtcataaaggaaaacacagataatactgtggaaaaaattaccaaatatactcaacaaaagggagggagaagccaggcgcggtggctcacgcctgtaatcccaacactttgggaggccgaggcaggcggatcacgaggtcaggagatcaagaccatcctggctaacacggtgaaaccctgtctctgctaaacaaaatacaaaaattagccagctgtggtggtgggcacc

SEQ ID NO: 12078 - DNA, 12124 bp, Human
gaatgacttatatttcctctaatcatttaaagtatgacttctattgtatactacatgctgtatatatttgtgcctatttctgaatcatctgttttgtttcactaacctattctttcagtacattgactcagatccttgatgtattcaatgcgttggcattctatattgtatacattagatgcctccttgaaaggttgtgtgtgaagcaaaaacaattaggtgcataatctcattggcatcgtttagttattgttgtgtgacataccacaccaaaactcagtggcttccaatgacagccagttaagcccatacattcatagggtatactaagctggattttgtaggggcaactgtgctctgcatggcatccattcccttcccagggcagcaggatcatctgcctcacggcgatgtagaaacacaggaaggagtgtgcaaagactaaggccccagaagacccaggctttcccgacccactgccacttctgcctcatcttagtggtcaaagctacacagctaaacccaaaatcaagggtgaggaaagttccctttgcccccatgaaacatggcaaaggtgtggatgcagagagggtgaagaactggggctacaatcccaatctcccacagctactggcacataatttaaatggggaagcttccatagaaaattccaggtgctcatctaatattaagctaaaaaggagctgctaacatatatttgaaacacactgaaaatttaattccccagaaaagtacagggtaacataacatccatgtgtctatctccaataattaacaaattaatattttaacatatttgcttctgatttttttctttttttagaaataaaatattttagagtttatgtactctgtatatccttccacggttttatttctctcactatccagaagtaattagtaccttaaaggtagtctgtgcatatttttattatacatacagcattcattaagattaatatacttgttttcagattttacatattataaatagtatgatactatatatataattctaaaaatagctttttaattcaacagtatatctagagatctagctgtgttaatacatgtagattgtcttcatttaaattgttatattttactctgttgtatgactgtattattctgttcttgcattgctataaagaaatacctgagattgggtaatttataaagaaaagaggtacagaaagcatggtagcttcttgggacgtctcaggaaactgaaaatcatggcggaaggcaaagggcaagcaggcatgtcttacacggctgaagcaggaggaagtgagaacaggggaggtgctacacacttttaaacaaccggatctcaccataactcactcactcactatcaggacaacagcactaaggggatgatgccaacccattcatgagcactctagccccataattcaatcacctctcaccaggccccacctccaacactggggattacaattgaacatgagatttgggtggggacacagatccaaaccatatcaatgactatattataattaatcttttttcctttattgatggatgcttttaatggtgttaacttaccattatcataaacaagaaaacatttaaaaatcacatatttaaggtgaatacatgcaattttattaaaatattaaagttatttgcaaatattacacaggtgaaatataattaaactgagaattcaaaaacacctaagggatatattaaggaatatgttatgaagggctacacattattaatgaccaattttcttctgaaatatgtgctatcaaggaaataaaagaaagatctaccagcaggcagcactaaatattccatcattcgcacgaacattctcctacaagccacagcccagaagactgtcgatatgcacctagccttatcattttctgttaatatttagtcagtatttccaatataattggcttcttcttcagatcaaaggcttttacataggccctacctgcaaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccggtaagtcgaaagtgcaattttagaatattgattaacttttaaaaactgatttcaggggaagactaaaaagattaaaaagtcattaatagcatgatcacaacaaagacttgtgtatttggctattaaaaatgaaataggaatgacacatggtcctgaggatgttttaagtaatttaaatggaatgttccggttctttaatgagggaaacataatagtgggttgagaagacattacaaagcctttcagtctgagtctgggtctgggacttaactagaacaaaactagataataaaaagttgatataaatatttgattctgattttgatcaaaatcaaattctgatacagatactaatacagagactggtgtggattaagacaaagggatggctcccttaatactcaccgaaggaggaaaaagtgaataaattactacactgtctgatatttgcctcaattcccaaggataaatattagttgccaaagtgatgggattatatcttgatcaaggtgttgatttggagcttggctccaaggcataaaacttttgaaacccaccttttaaaagtattttaaagaagaggcttaatggccatattctgtaggttctcttcacaggataggtattaatgaagagtaaaatgtctttaaataaaatcaatagtcaaattaccaggctctcgcttttgcttgtttgtttcaaagtgcaaggttgagtgtgctcactgtatctctctgtgaatgttaacactggaaatccaggacatttaattccattgaacatttattaagtgcttactatagtaaagaaacaaattgtgcctgaaacaaagtttgcaccaagtctgctgagaaagcagcccctcctccacgtttcataatttttcatataattggttctactccttctcctaccttcacccctaatctcagtctaggctaaattggtttgacatttcagattatttttaagaatctccctcttccatgttggcaactatgagagatttatctagtgttaaacaaacttggctagtacagagttcgtttctcctttaattcaaacatttgcttggatttgattagtggaactaaccatttcaaaattacaatttctaaaattattttctgagccatgctattttattatttttgcttaatctaaaaataatgatccccatggcagataatgagcaaagaaaaatagaaaagcacaacttataccatttactaatggatctgaagcaaagtataatgatggaggccaatgcttataaagaaacacattcagctgggcgcagtggctcacgcctgtaatccctgcactttgggaggctgaggcaggcagatcacgaggtcaagagatcaagaccgtcctgaccaacatggtgaaactccgtctctactaaaaatacaaaaattagctgggtgtggtggtgcgcacctgtagtcccagctactcaggcggctggggaaggagaatcacttgaacccaggagatggaggttgaagtcagctgagatcacgccactgtgctccagcttggcaacagagtgagactccgatccaaaaaaaaaaaaaattgtattcactgatactctaacgtcacaaagcagaattctgtggccagggaaaaagccaattttacatctgaatcaggaaataaaattctggaaggacgatcttcccataaatacataaagtccagggaaaactacagtgaaaacagaattgtcaggatcaactgtgtgactgataaggcaaatggggataggaaatgtctgaggccaggagctctgctctcacttttctcctttttagcactggcagggccatgggctaatatatgtgctggcaagtcttccaatgagatccggacgtgtgaccgccatggctgtggacagtactctgctcaaaggtatgaagttgcacaaccacccacccaaccctttggtccctaacctcttttcttagtgtccttgcccaacgttggttgcctcaagggctcacagttctgacagcatgaaaaaccagagatgtaaccagttacatcactgtctttggagcagcttccaagaactctgcttcaagtatgagctataaattgggatcagaatgtggaagaaggaaaagatcagggagcaaacacaatgttttccttctgaatgtcttcacacattcacttatctcaactgtttttttccaaagggttattaaacacaactatcccattttatagaagagaaactttaactgaggtaccaaagggttaagggacctgccaagcacagttggagatggtgaagcctggacctgaattcaggcttttggttcctcttcccaccaaaccacgcggttactggctcaggctctggatgttgaatattagaggctggccctaagcaggagagaaagcaccactatctcttccagaaaatgagggtcacacttgtgaattttcagttatacccaacatcaccttggggtgccactttctaatgaaatagccatgtgtccagtcatatcactgatctccatcctaactagaggggaactctcacatatacagatactacttacaaagcaacctcaaatactgaaacaggactaagagaagggaaatatgggaaacgtcccttgaattgccaaaattcagactcagcttatactgcaaagtttatgcacttgattgatacagtaaattcttggctcttgagcttgctcagtgttgctttgtacataattgcagcaatcctggtgaacctgatcgttcaggtgacagcctattagaaggtaggggaggctggtgagagcaggcatagtgacagcagcgggaagcaagagctgaggggttgctaagacgaactcaaggcacgtcacaatctagaatagtttgatttgggctccatgcactttaataaacccaggaggtatcactcattgtattaaaataccatatacagtaagtgacgtttacaatcacttttctagatcactgcaagaaaaataagactagggtaacatgtgatacttttatgataggttcccataaaaagacagctgttttcaaagtgggcttgaagatgtcaagatctaggtatctagaaaatgcacttacatggactgcctcattcccccaacatgccataaaataatagtagctaatatttgcttaaggcttattatgtaccaagtaccattttaaatgctttcatctttatgatatggttattagcacctgcggggagggaggttaaaattgggctaaacagagtgaggcatcctgggacatcccaacatgttctggcagcttcaagctttggtacctcgtctgcaaacagtgggctaacaccatgttcccaggcagtaaagctcccctaaggcagttcctcagtctgttcgttcttatttacatcctagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtaagagaggtggagtctacacctggggtgcctcctggagatgttgatgctcatttatttaatgcaggttccatacgtagagattttgtacttctttcaaaatgataaaacctggaacagaaagaatatagagtgtacccaaactagctgatgcattttttaaaaaacttttattttaggttcaggggtacatgtgcacatttgttatataggtaaaccacatgtcacagacatttggtgtacagattattttgtcacccaggtaataagcatagtacccgatagatatttttttctgatcctctcccagctgaggcactttcaaggacgtttcaccattttctctgaaaacttctgcttcatgcacacacttcacgaaaccccacagctgattggaggcattccttcctgtggcccatgtggttttgcttaacaatctataaacaaagccactttcagcaatgctaaccataatggatagatacttgcatttactcaaatcccacaaatcataaatgctggcacttctgcaagagttgaatgtgaaatatttttgaaagcttctaagttttaggtaaagctagatctcctggtactccaggtattggttttgttgtttggttactccatcaaggtataaatacacacataaaagtgcacaacacatccatgtatagctccgtgaatttcaaaaagtgaacacacctgtgtaatcagcacccaaatcaagaaaaagaacatcacccacatcccagagatcccttgtgctaccacttagtcattattcccagcaagataatcactatctcaagttctaacaccatgtattagttcttcctgtttctaaaaatggtataaatagaattaaacagcatgcactctttgggtcttctttcattccacatcgtgattatgcagtttatgtttttgtatccacgttctttctgatgcatgatattccattatatgcgtatactttcatctatttatctattcttcctcagatggacttttgggcagtttccagtttaagatgattataaaattgctgctacgaacttccttataccttttaatgaacatatatatgcattcctattgggagtgagtccagaggagaccctcctcaccaagcctgtgagaggcatcttttgagcgaacccacatccttgaggagctacatagtggttgtcctctgtaggccaatgtcacaagggaaacttctgccattgaactgtgtcctctgtagtggcacttaacagttaatgccaaggtcagtgagagcagaagcagtaatcagattcgtctaaatctcagagatttgtgacactggctagtaatcatggtgactcaggaactgaatagatgagcagccaactaaagccttattggacttgtatgaatggaaatgctccaggtctgatgaacaaaatgctgacttcagtcatcacaataatgggtcccaattcccaataaattcccaggcttgaattggttcacagtcccagagcctcttgaacaaaagggaggctcagtccttttgcgtaagggtcctgctacgcagccaaacatttatactgtaaaccttacttctagctgtccccaaagggacctgcaacggtttagcaggatgacagcacattagggaagaaataattaggctcttcagagattactggacacttgctcaaaactgacactaattcctggagatctaaaaggccactgtggttcaccagtcagactaggggcttagagtcaggtggtaaatatagcttttcactagggtccatcttacagtgagcccagtgcatcctccaatctaccaagaggttatttccccagttccagaatgcataattggaattgactttcttcttctttcagactgccttggcaattcttggttatttgcatttccaaataaattacagaatctgtttgctaatttccaccaaaaatcctgctggggctttgactgaatctgcagtaaatatacagatcaaattgagaactaatatttttaaagtagtgagtcctccaatcaatgaacatattatgtcctccacttacttaggtcttccttcactgttatattaatggttgttgtagttttcagtgtagaggtcttgcacatcttttgtttaatatttattcgtaaaacctacctgatggagttttagctcttctacagcagaactatccaatagaaatataacagaagtcatatatataattttaaattttcggctgggcacggtggctcgtgcctgtaatcccagcactttgggaggccgaggtggatggatcacgaggtcaggagatcgagaccatcctggctaacacggtgaaaccccgtctctactaaaaaatacaaaaaattagccagatgtggtggcgggcgcctgtagtccctgctactcaggaggctgaggcaggagaatggcgtgaacccgggaggcggagcctgcagtgagccgagatcgcgccactgcactccagcctgggtgacacagcaagactccgtctcaaaaaaataataataataattattattattattattttaaattttctagtagccatgttgaagtaaaaaaacatggtattttagtattttatttaactcaatattttcaaagtattatatcaatatgtaatacaaaaattattgagatattttacatttttaaatactaagtcttcaaaatccactgtgtattttaccattaaagcacatctcaattcatattaactacctttcaagtgctgcataaccacatgtggctagtggctaccatattggacagcataattttacagccttatttttatgctcacttgaccggtttgcagtgccactagtgtatcaaagtctcctattattggtgggtttctatctatgtttcctggcatctcttgtagtgtctgctttatatagatgacttgtgctatttagtgcatggatagttgtaactgttatatcttcattgtgacttgtggcatttaccctcttacattatcttcgtcttgtttcaatgccttttggcctgatttccactcttctggtaacaggacaatagcccttgctttcttattgcttggcaaatctttgtccatgtgcttggcaaatctttgtccagctcttcactttcagccttttcaatcgctgtgttttattccatacagcattcaattggggtttgcttttcaacccaatgggacatcttttaataggcaagataaggccattcacatttatagacatgactcctgtatttgtacccaacaccattttattgtataattattatattgtactctatttctctacttgggtctttgcctttttaattcttttgatatttagcaaagtttgtatttttgttccagttatttctatttttctttatctctaaagtccaatcattctatcagaatatgttttggagttgacattgttcagggctcaccttttctaactagctagtattttcctgctattattcttcaatgcctttattagcgtttcatttgaatctattcttcctttggcatcttgtaatttagtcttcctttttaatatcattttgtcattttcatctattcctctcctgagttcattcaacattcttttttttattttttgtccatttgttatttttttaatttcagattcaagattactgaagcccagataaataattatacttattttcttttaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacaaatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccgaagatctaagataaataaacaagagaacttacgctgggccaggctgcatttttgacacctctaaaactagcaacctttctgcttgaaaataagaaaaagcctgaaagtgtttctatggtacaagaacagtgagtggtttataatgctagatttagtatacatttaatacatattcaatgaataagttgagtttaggtagtagactctcagcaatatccttaggtttatcatattggttggagagagagctgctttcatggataataaaggatttgctggtatttccatccactcacccacatgattatgaatgatggcagtccaagaaaacatatcccaagaaaacagtgaggctgcactacaggaaggactagagtgagaatgaggcctacctttatctgaagtgtctcatggaattgggcctgtcaacttcatctagccatatgcatattacagctacttatttctacacatcattgtattatatctatgttattctgtcttagttatattgacaacaggtactatgaggaaacaagaccatacaaatgtccaaaggaccagaaataattctggctccttagagtttagccagttggtaagaaatgaatacattgaactaatcattctggaaacttcatgaatttctgcttaaatttgttcggaatgcagaaaatgccagcagaatgattatattcttatgtgtagattgttagaggaaaacataattaactgaagtttattgttagagaaatggctgcatttgtgtatcagggcatatgtatgagaatgttcatgatatcactatttttcatagcaaaaccttcagtgacctaaatgcccatcaacagtgaaatccaataaataatctcaaagttatagaatgtaatagtcaacagcagtcacaataaatgaacttcagctaaacataatgacctgaatgaatcatggcaatataattttaagttttaaaaagtccagaagattacataatggatgataattctttttataacattaaaacagttaaaatacaatttcctttttatataacaaaatcatatacgaaggcgagcaagaaaataatgaactctagttaactcataactagatagagaggaccacacagaaagatataagttactatcagtgctgtagttttgcagttgggaggtgatttcatgggtatttattattatgaataacatgtcacagaagcaacaggacttgcagtgggtggccaggaagaaagagttatcatgatgactctcaggtaattgagaatctatgtcacacatttagcaccttcttatatctattaggttggtgcaaaagtaatcacggtttttgctattactttcaatggcaaactatatctagcactgtctgatttgaatatgcatctccttggtaccaaataactttaggttgtttccagaaatttggctttcaaaaaataaatgctgtacaccactgaggacacacaaaaaggaaatagcacatcagctcttaaaggcaattttaaaagaaactctgaaatatttgcacaataaaatataagcttagttttccaaataatcatccttctgattatttaggaggcaaaacacaggtggatatggatattgttttaaaaaccagactcatgacctggaatggagaaattcctcaaggtagagcagggacattgccttcccctcagccttctcacatctgctcaatggaaatgcaaactttggaccaaaggacttatttctcaggaagaactggaatacagcgccctctagtgcaacaacaaatccgtgttattttcccccttgtcttttaggtttggatgtcaaaacgtttgacttaagcataaaaatgttacaaaggtttgaatggcaaaggggtaacagtatggagaaacttacttttcattagtaaccatgatgataatatacacttcaaaaattgtgatattattctgtcaggtttgatagctacacattaataatgtgaataaaaccaatatttactttgaaaatgtt

SEQ ID NO: 12079 - DNA, 10303 bp, Human
gggcagctgcagaactcttgagcctaatgagagactcaggccgggcgacgggggtttgatgggtggaggccacagtgagcccctggtcacatggatttggggtccatgtcaggagagccaggctgagtcaggtggcaggggtctgggtgatgtgggatgggactggggactggtccagagctcacgtgctctgagtggtcaggtccttgtgcaggagatgctgggggaggtgtaagaagaagggttgagctggggtgtcctgggatgtggggttacctgagccaggccagggcaggtgagtctcctagtagtgtacgctgaccccagagcaagtgtataggagcagtaagtgccaagtggggccctccatggtccctcaaagaagagacaaggtgtggggtgagaggcaggaaggaggaaggagagccagttcgggaagtgccagctgggatgggcagttttatcacctcacatccgaggccctgctgggagagaatggggggcaagagcgtagataaagcagggtgtgtgtgtggtggggaacggcagcaggcaccagggctcgtcctggcacgatgaaggaggaacccgtggctgggcaggtctgggatgtggcaagaggcaggaactgggggcatggaggatgggcgagggggcggtgggggcccgggcgaggctgcaagagctccctggccttggaaaaccaactcacacaccttgatctcaggtcagggtcaggcggaagggctgggaaggggccacaggggactaaatcatctcctggtactgggggtcccctggcagctttagggacggcatggccccagacgcgtggccatgctgtctggccggcattcccgcatctcatagggtgtatttattttcacttttctgttgcatttcttggaggtgtccctgtgctcattttgcccggctccccactgctcctttctgcccttcctcattcacaaatcgcctggcctcagaagacgccagaacatgtgacactgccttagagcctctagaagcactttttggggacctccatcattctctgaggctgggctcaaaggggcttccaaggcaggtctggaagggaccagccacttctcagtttccccaaccatcaatcagcaccccgaggaggaaactggggtacgatttcgccaagcctctctcagtcctgcttcagaatggaaatgctggaccgccttcccagaagcaccttcccagagtgtcccgacagaactgagtcagtcacccctacccccatgtcttcctagccccttccccagcctcacaggtacagtggtcagcagggcgagtgcactggtggtgtctggaggcctgaccctctggggccctgggcaacgtgttcccctcggagccccttggggcccagtggcaatgtgcagattggaggaggctacctctggggtggcttccagcgcccatgttcagttccactttatgaccgtctaaagtccacgccggccccggcccctcctcctggagcctccttctcagccaagccctagccctcctcctcccactgcccccctaaagccccccaaccagggggcacaggggccagtctccatctgctagtccagactcgctacctccccaaacccaggtgagtcagggccgtctggggcgcccactgctgggacccctgctgactcggccaggggccccctcctggcgatgcccatcttcagacaactcccgggacaagccaggcaggaaaaccacagggcgttttgtcgaaggcttcattataattttatcaatcaaattcttagaagagggaaaaagtctgttctccccaccctcccccctcactcgtccccccccttcactctcactttcttccattcataatttcctatgatgcacctcaaacaacttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcaggtaaatacacccgccccgcgccggcttcgcgtccccgctgcggggcgcggcggcaacttggggcgcttggcagcgcgagccggacgcccacccgccgcagacacacgaacacttggggcgcccgcgcagccaccggaggcgctgggtggcggcccggagcgagcgcgggcacatggtcccaagcaccgcacgccccgcggcaggttggcggcgagggagggggcgccgagccttcctcctcctcctcttcttccccctctccttctcctcctcctcctcctcgctccggacactcgctggctgctcttccctctgcgctttctcccagattcactctccctctctctttttcttttctttctttctttccgctttctcctttccaaccgcggtcccgggctgctcccagggaggggcgcgggcggcgagcagcttgcaaactccggcctgggacgggagcaggtgccgcctccatctgctggtgtctggaagcgtgtggtctgcgctaggtgagatataggggtgtggcccccctcccgcagccaccccggggcctcagcactgccttgggatgctgggacgaacaggggacccaggagaagtgaacttgaggaggcccctgtccccgctgttccagcatgggggatccgggggaggtctccagcctcactcgcccgctgaccccggcccccaccatcttcaggtgcccttctgcagagccctggaaaagcgtctaagggggcctggggggagtcgggagaacaggcccccctgggggaggggcaaaccaggacatgtcgggacagctcccagctctcctgtcacctttcactttccttcctccccgcccacccgactgcctatgaccttttgccttttctctctcctggtgcaccatttcctctccctccctgagccggtgtgtgtgtgttaggagggaggggaacccctgggacaagggacagcggatgagtcgggagaaggcatggagtcaggggctgtccggagctgggggaacagagagttttgaatgatgatttggggatggagagtggggacagccaggcagaaatggggtgagcttgagtgagataggggacactagggaaggaagagatagaggatgatgggggcgggggcagaattgggggcaattggcccagggagccagaatcaagtggcaggtttgggagggagatgagggtcaaccgaggactcctccccactcccccatgccccgtggcccccatgggtgcctggcttcggagatttgggctgcaatgggccagtgagtgggaagcgctgctgaggaacctgggccaccacgggaggtgggaagagaggggtctcctttctcctggtgcctgctgggcctggggcctggtgccttccagccagagggccagggggccttaggacctttgccttcctgagggaaagggtgggatggctgggagtctctcctggaccctgcaccctttgggtggaaatggcttgtgtcttgccctcatctttacgtcatcccagaagagagcagggagaactaaggtagagaaagggagacagagaaacacacgcagtgacagagtgaagactaggccccaggaagacagctgcaggtggtgagggggaaccaggagtcctctcccatgcggccattgttggacccccatccggtgtgccatgaccccaggccaccctttcctgcctttctactcatggcttcttcctgactgtccccaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctatgtaagttacccctgggatactgacaggagatggcagggagggggcttgtaaatatcattaggggctgtcctgatctgggttgaggggaccttttggggctggaaggagagaatggggagagggcttgattaaaccacccccagactcctgccacttcctgcccaagcttccccagggaagcttccccagggtgcccagttagcaaggggagaactgagtgcaaaggtggggacctggcacttcttatcttgtgattgtcctgctgcagggagcgagggatggaggggaaatgggcgtgaggcaccagggagatgcggttgagaggcagtgggctgtgggtgctgggcatggaggggcgtcccggaacattgtgagtgcagggatggaagtacttgtgtgtggtgccccagctagggctagacaccgagttttcccttctgtccccttagggtggtgatgatgatgatgatgataatgatgactgcgtgcatggctcagtctttgatctttagcaagggcactcacattacaattagttttggctctcatgacaattccagatgcttacagggcaaggagttgggtcctcatgcgctagatggggaaacagacgcaagagcttgcccaaagggttggcggcagggctgggacactgacccctgactcccacgtcacctcccttctgcccctcagtacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggtcttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagccttacgggtgaagctcagagaagggtcggatctgagagaatggggaggcctgagtgggagtggggggccttgctccacccccatcccctactgtgacttgctttagcgtgtcagggtccaggctgcaggggctgggccaatttgtggagaggccgggtgcctttctgtcttgcttccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagacgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatacttttttttttaagaaaaaaaagagaaatgaataaagaatctactcttggctggctctccggagtgtactgatgtggggagatgggctggaagggctgggactgtccctgtcctgggcaccagccaagtgggactcagcgaagggtggaggagggtgggggaggggcacctggcataggtgggggcagttaggtggtattttggccaaggcagaacaaggtgggtggtgtctagatcatggggtgcccccaaggagagagatggattgctcagaggtaaagggggtgctgggcacggtgggtcactcctgtaatcctagcactttgggaggctgaggcaggtggatcatttgagcccaggaattcgagaccagcctggccaacatggtgaaaccctgtctacaaaatatacaaacagccagatgctgtggcgtccgcctgtggtcccagctactcggggtgctgaggtgggaggatcccttgatcccaggaggtggaggctgcggtgagccatgattgcgccactgcactgcagcctgggtgacagaggaagaccctgtctcaaaaaaaaaaaaaaaaaaaaaaagaagtaaacggggtgccgtgtgatatctcagctcattccctcccaactcctcacttaatctcatgggatctccaggagttgccatccccacataccagaggaagaaatcgaggctcagagccatgaaaccacgtgcccaggggcacttgaagtgtttagggccagttagggccactccttcacctccagatctcatgatctttcccctacatgagacttcgaggacctgtaagataccagctgccaaggtctctgttgcccaggaatgtcctgttgaccattcagagggacataacaggacaactcgaatggctccagagtgggaggggataggtggtcctactcagaatcacacaggacactggggccagaaccaaggaggactctgcccgccctgattccgtccctcctcccgctgcctatttgggaaccgaatccccttccactgcaaccttcttcccagccttctgcaatcccttcctggggggattcaaggtcagaactgggaaaccacagacactgagactctggagcggccccgaatgtctccctgctctttgctctagggtttgggtctggggctccccgagccgagatttatttcggggatctgggcagtgtttctgagagtcacctactggcttgttcctgaatatttgtaagtgtcagctcctgtgccgggttgcaatgccttctagaagctcacaggctgggagggacacttaggatgtatgtgatggacgaggcacacagagggcggtgagtccacgatggggagagcctcgctctgggaggcagcagggggctcgggctgtggtcccctctgctctctgtaacatgaagggactgcattcaacaacatggcgcgaccttggcctcacctggaagctgattagcagtgccgaatcttgacctcaccccccgacctgcagaatcagaacgtacacattagcaagatcccaggagactcgtgtgcacattaaagtcggagaaaggccaccctgcgctttcatctctcgttcctcaggagtcccccacgccaagtgcaaatggccaagggccgggaaggcagctgcttgggagggagaggccggcaggcccacagctgtttctgagtcttcccctgaagtctcccgcccagtctccaggaggctggctcaggccctgggccacaccccacaacgtcctcccccaccgcccaggagtggaaacactcctcccctctgctcagggagacaaggttgaagcttttcaaaagcaacctttactaggaaactagaggaaaacaaaacaaatggcaaagcacagaaaggtagagaatgacagctaagtcctgggtggctggctggggacgccagggcctagggatgctccctgcctctctcagcctgggagagggccctgccctggcaaaatagaacaaaggactgttaattggttattgggtcaccctccaaaaaagag

SEQ ID NO: 12080 - DNA, 119594 bp, Human
cttgtccttttggcatcctctcaccccacgagctacttctgtgtcttttctttatgtaacactgaactctccagctcaggcctccaggtcctaagttcataatctcattacaactaatcctgtttacggccattctcttggcagaacaatcttgtctggaccaaggctctttcctcaccacccaatgttcttgttgctccattgttcctggggactgtggcctggctgagtataagctttcattgatagggtttatcctgtttacagggagtctgcagaagggcctcatcaaatacttccatcccttccttcaataaatggctccctttgatctgtgcaaggcacaactttgtttatcagaagctgggcttcctctagctgatgatggggacatcctgtcccagaaaggctccccaaaataacaccttctgaatttcagaatattttcaggttcctctattttggaagcattttttttttttcttgcatgccatttcttatggcaagcaaagaaaggagctgattttgcattttgaagcccaaggtaacacaaagttgaacaggtcaccgccaaaaatgaggaaaggacagtgttgataataatataaacatttggaaccagaacaatatacaagattagggttgaccaggtgtgatcgtttttcatattgtcaatttaaaactggaagttatctaacaaggtgaaaaagaggtcatgggtgttagtcatctatatgacaggatggtagaagctagctgaattatgtggatgaatggtaagggcgattttacactgtccgagccaggtaaagagctctatttacagcaatggttctcaaagtgtggtctctagtccagcagcatgacctggaaatgttttagaaatgtaacttctcaagccccatcccagatagtgaattggaaactctggaggtggggcccaggcacctgtaagctcacaagccctttaagtgatgtgattctcatgcttgctaaagtttgagaacctctgatctgccccaataatcttcaaacttcggtgtacacaagaatcacataagaagctaaaatgcagattcccagatcccatacctaacgatgcagattcacttggtctagagtggacccaggaaagtttgcattgctaataagcagcccagggtgatttgggtgcaactggtccatgaatcaagcttcgaggagcattggcctatatataaaggagtggtacaaattgtccatattgctccagtcttattctaaagaggctccctccgtggctaagaatgagccagtatcacaattcatcttcccttcccagtcatctcatgaagcaggctgctaagattacctattgtgggccgggcgcggtggctcacgcctgtcatcccagcactttgggaggccgaggcaggtggatcacgaggtcaggagatcgagaccatcctggctaacacggtgaaaccccgtctctactgaaaaaatgcaaaaaaattagccgggcgcggtggcgggcgccttgtagtcccagctactcgggaggctgaggcaggagaatggcaggaacccgggaggcggagcttgcagtgagccgagatcgagccgctgcactccagcttgggagacagagcgagactctgtttcaaaaaaaaaaaaaaaaaaaaaaagacctattgtggttttcaggattactctaatactagaaggttagattggccccatggattcctttcacactgacatctgaaacacactgctgactcctaacctgggttggactcatgctgctggcctggaggcaaaagctttttatcccattactagttccttgaaccacaatccaagacacaatttggttttcccaagagttttgttttgcactgctgatgcattccagtcattgttgtgatgcatttccttctcctctttccctccagtccctgggcaatgccacacatgtatatatagcctcctagtgtgaacttactcaaatcctaaccctctctcccagaacgtgtctctgctgcaaggcaccgggccctttcgctctgcagaactgcacttgcaagaccattatcaactcctaatcccagctcagaaagggagcctctgcgactcattcatcgccctccaggtacagcactgctggggtttgcttccttccttcctggctttgtgtcccatgtccccttagacctgtcccccctttagatttcttttcactctgctttaataccagttgtgagggtctctcagggctctgaccttacctctttgtcctacaaaagtgtatttcttgtgtggtttcctgtgacctgtacttacccagactttctccagtcaatccttggcatcctacagagatggtcttcctcagtcttcagtctctgtaacgataccagcccttgtttagagacccagagtagaaatggtcactgtatacagttgtacagtttctgcaccgcacagacacctgaggaagagagcaagtggttaggaaaatccagcttgcacactgctcaccaagatgaatgcctgaagctgctctgtggaaacctagaggaaggtacattgtttcgctttttttccatgtcagatattgatagaatcacatataactacattagattatcagctaaaaccagattagtgtgttttattgtcatgtcattgtgtatgtgaacatgaagacttttagagtgcctgaaaatattttatgagaaatagttaaatagcttccctttttatttttcattactagaccttatttcttagagcagttttaggtttataaaaagccagagcacaaagtacagagagcttcatatacccctgcccaccctgtccaccccactcccagtctcccctgttagtaacatcttatgttagtgtggtacatttgttgcaattgatgaatcaatattaatagattagtatgaaccaaagttcatggtatacattactatgtatactatgtatactcttcgtgttgtgcattctatgggttttgacaaacgtgtgatgacatatatgcaccgttatagtatcttacaatagcttcattgctattgctaaaactctgctgtgctccatctgttcatccttcttttcttccctgccttctccaggccctgacaaccactgatcttttaaccatctccatcgttttgaggaaagtacacttttttctttgcacaaagaactgtctactagccaaaaccacaggatgcttctgcccagaggaacaccatttaaaaaaacatgcgcaaaggttttatcgcagccagccaatgccttgaatccaagctctaacccaattcaagacctttccctggatcacgtccgtgtgtcctgtctctcttgtttccccttatccatctagcatatacttttcctggtaaacgtttctatttttttctgtttaggctgctgtaacaaaaatacgatagtctgggtagcttaaacaaaaatcatttatttctcacagatctgtaggctggtaattcccagatcaaggcaccaggcagaatcagagcctggtgagcacccacttcctcgttcttagaggaccgttttcttatcatgtcttcacatagcaaaagggacaagggagctgtctggggtcccttttataagggcactaatctcactcatgaggcctctaccctcacaatctaatcacttccccaaggccccacctgctaatgccatcacattaagggttaggattttaacatatgaatttgggggagacataaacattcattctgttgcaattaccttatgtgcccctctcatctacccacccatctatccccctcctcttctctgatgcatcttctatgtcagccctgtctgaaagcattttctgcaatgatgagaatattctacacctgtgtggtccaatataatagccactagctgcatgtggctattgagcacttgaaatgtgtctcatgtgacagaactgaatttttaagttacatttcatttgaataatttaaacttaactccatgtggcaagcaacaattgtattagacagcataggtttaagtttttacctatgccagattccccattctaacagaattcattaacatcccccccagtttcatactggacatcttcccctcccctgccttttttatgttttttgtttgtttgttttgttttgttttgttttttggttttgagacagagtctagctctgtcacccaggctggagtgcagtggctcgacctcggctcaccgcaacctccgcctcctgggttcaagggattctcccgcctcagcctcctgagtagctgggattacaggcgtgcaccaccatgcctggctaatttttgtaattttagtagagacagggtttgaccatgttggtcaggctggtcttgaactcctggcctcgtgatctatccgcctcggtctcccaaagtgctgggattacaggcgtgagccaccacgcccagctgctccttctccttgattctttcctggctaatcaggaaagatacaattgttcctgaccccattgctgaaatagtcagctactatgtccgtcacatttattaccattaaatttgcaaatatatgtacaaccattatatatccatacaaactaaaaatagttttaaaagtattagtttaatttaattaaactattagttttttctaaaaaaatagaaaaaatgtgcacatatggtgccgtctcacgtaactttttttttttttttttttgagacggagtctcgctctgtcgcccaggctggagcgcagtggcgcaatctcagctcgctgcaatctccacctcccaggttcaagcatttcttgtgcctcagcctcctgagtagctgagattacaggcatgtgccaccacacctggctaattttttgtttttagtagagacagggttttgtcatgttggccaggctggtctcaaactcctggcctcaactgatctgcccacctcaggctcccaaagtgctaggattacaggcgtgagccactgtgcccagccttacataatgtacttaaaatttctttaatttatgaagctagttgatgttgcttgtctataccttttaattctttcctctttttttttcttaaagaaatttccaatttctttaaaattttctgtttaaaactctatactcccagaaaacagagtagagttacataactaatgctttatttggcaaaaactacaaggccatagttagtgggctaatatatgtcagttcagatgattgtggcaccacctttaaggcatgaaaaggagagaagggaagaaataataacaccaaaagaaattaagagtttaagtccaagagtcagcatggagtggagttaaggaactatggattgtggttcttgggaggctggagttagtggtaagcatgtctgtgccaccaaccagtccagggcattggtgatatcactgaatctctcagagactcagctctctgcttcacagcatgcaggttttcactagaccctccaatttaaggtgtcttctagatcaaaatgctctttaggtcaaacacagtcttaggaataactaggaaagttgaaacaaactttcgtcacacagactgtttcacattatcccacctcctgtcacccccttctcccacctagcaatgtttgtgacgaatacaccaactttcctgaggacaagagcaaaacaatattttaagaaacaacaaaactcagtttagagtgagtcactgggcctgaccatggtggctaaactgaccacaaaagtttgtgaatagtctatatggtgtccttcaaacatctgcacaaaccttttatttccagtgctttgaacagaaataaacatagtcattaagccaaattctacattctacaaaacagatgaaaagttaaagcataacgttaagtccaaaacattagtgtggagtcctcagctgaatacctcttgcctgcatgcccatgtgagcagtcagttaaatgcctggtgtctgttatatgagcagtgggaaatctttgcatacaaaaaagtgtgagttgtactaaagtaaaatcagtattctggatcccttaatgtgcacataattaccacttaggcttctaagcgaaatgatttgctaatggcaactaaaatgtgacatggcccagagtgaaaaaattgattcataacttgggaaggtttgactagattgcccttaggcaagtgcctagagggctttcctgtctctccctaaaccttgcttctgcagttccaatgtacaaaatagggatagggttgttgtgaagattaaatgaaactagggcaggtcttctggacagatactattacagtgctgcaagcccttccttcagaatccttggcaccattacagttctacatttatttatatcatcatttgactactgtccctcagctgactgtacattccataaggacaggatttatgtcaactttttctcaacattgcttcaccacctcctcatagaacctggcatataaaagggagtcaacaacaatcttttgaatgaaatgtgtaagtcatttgcagtcactggtgtcagatccccgggtttgaatgctgtgtgcttggacaagtaatgtttctgcctttgtcttagttcctgctttctataaaggggagataataatggtatctacttgactgaatagttgtacaaatttagtgggataatacttgcaaagagcttggaacagtgtctggtacatagtgaggactcaatacatgctaatgaattttgatgatgatgatggtggcggtggacatgcaataagctcttcataaataatagctcttcttctaattgttattcacggtcatcattgaaacagtatttgcctcttgattatcagtcataggtggtccttagttacctaaaatatcacaggaccactgctttacctttccatgttatgccaggcacagacaacagaggcagtgtcaaaggagatacccaaatgatgtttacaatggtacacgggtctctagggtccaaggaaaagttaccaagtattttcccacctccctactttcatctccctcttacttcccagtcccttccccccatgcttgtatggtcttctggctttttgaccagtcctccctggggattttcaagtacccagcttgcaaatcagcctccccagaggatctgtctctactcatcatagtcaaaggatgtaatctgttctcatgtggaaataatttgttcagagaatgtaaatgatcaaagcctatatttctgtattcaggagaggaagagaaaataatagaaaagacttgaggctaactctaggtcctgcatttactaagtcacctctgataaattacttggtaaattatgtcttagaaaaaccattggtttggtaggaataatcaaaatgggatccgtgtcccgggtttgtaagaattaaatgagttaactacatagatggtttggttccaattagataagagagtttctaaacagtgaaaagtagaaattttgccacaccctgccctcacaattctagcatttccaggtttccaaatctgggaaatgtagctaagggcttttcctttctctagggactccctttacaagtggtggagctactttctgctcgaggacaaagaaggagggaggacacacacacacacacacacacacacacacacacattttcttctctgccttctgaccctttgctattgcaactctaatttgggaattaaattttaataattctaaaatcccatttccgtactttccatatactattatttaatggaataaggttatcaaatcttatccttaacccttttcccatttttttaaatttgatggtactagatttgaattttatagcattttcaagaatcacttgggattaatttgggattcaatttcacttgagaactagctgttgtaaagttgaattatttttaataagcaaaattactttcatccattttatttttttaatagttaaggaacattcactttgatattcatagtcctctaaagtataacataagcattactatttcttgtttaaacatgatcagtagctaagttgtaaaaaaacatggggaaaggagttagccctacacttaaaggaggcagtatcccaaagaatatgatttttaaaatgagatcagtaacatagagctcttcatcctggctaacacagtgaaacaccatctctactaaaaatacaaaaaaaaaataaaaattagctgggcgtggtggcaggagcctgtagtcccagctagttgggaggctgaggcaggagaatggcatgaacccaggaggccaagctagcagtgagccaagatcgcgccactgcacttcagcctcggcaacagagtgagactccatctcaaaaaaaaaaaaaaaagaaataacatagagctcttcaaagtagaagtacaataaataccaataaacatatgcataattggatctactttatttttatgggtaaaatgtataaatgcattgctaacctatagatagatgatttggggaaataatgaaaagctcagagtgtttcatacactttctagagtaattccagttctaaagaaaaatttccaggcaaattctcaagttcagatcgtaatgtgccttttatcctattaggggtcatttctttcctgagcattgtaaggacaatatctgagatgtgcttgattaatccatagggatttaaggccttttgaaaaagacattcaaagacctaagcaaatataccttctgatttttataaatattttattctttacttatttatctgagcaaaattgcataacttactagcaactccaaccacatgtaacatttaacttaaaaaacaagtagggaagaaaaatgaggtttagttaaaattgaaaattaatttcttttctctgtaatactgacttctgtgaggatttttaacaatgaggtcaataaaagtatttaaagccacggggaatgattagacagtctcatcatcctgcatacagtgtccttcatattaaaattcttcctcaagccctttcttctccccttccttccttttcagactgagcacctgatcagagaaaacctgcttgactgtgtagccctgagagtttggtttcccagaggacagttctaggcctctcaacctagaactttccacctgtgtgaccttgggctagtggcttaaccttcagaacctcagtctactcatctgcaactgggtatccatgtcacatgttaatgttggcattatattgaatattggggattttgctaatgagagaatggtttccctcacaacctccaattgcagctaacttatgctttgatataatgttgctctaggtcaaaaataaaacaggccttgtgatatgtattaatggatagagtcagaaatacagattccaaattctacagtagcaactgagaaggaacagaaggcagggcatatctccaggccagggcctttgaatccctacacctaatgtaggcccaggcacatggtaagcactagatacatgtgcttttgaagggtcttttgatggattttgataagttgccccgactagaatgaagctggtaaaactagaaggcaatagagattcatgggttaggagcaaaaggtgggaatctagcccgctgggttcaaactccagctttaaagtgactttgggcaatgttatttctcagattctgggtttaaatctgatcattcttctccctatttgtcccccatcccgtacactcttttaaaacagtaacaaccaccaccaccaccatctttaatagcttttcactgcctttaggataaagttccaaatgtggcccacagcatctggtccctgcctatctcaccagtcttctcttgctagttctgttagctcaagcaatagtggccttttttttttttcagtccttcggaagtgctacctgactctttcttgctcctgggccgtcttgtccaacagcatcttgtctcatctgcctggagtgattttcacctccagcaccagtaacgcctccctgtttgccagaataacttttaatgtccaggcttaaacatcttttttatccgtgaggtttttcttcccatccctgtctaggttaggacccctggtatatgctcctcagtttccctctttcttgacactcactgcattgggatgtctgttccccattagactccatgggatgtttgtgtgtttgtagagggctggggtggggaggggtaaggggcaggaggtctacttttttcagtactgtattcccagggtgtagtcctgtggctgttcataaaactctccaaatggatgagtgaaggatttaatatcgagagaccaacatcagtctaccttatagactggtgaagggtaatgtagatcagcacaattcttggcacacagtgtctcagtcaatggtggctattattaataacacaaatgcttaattgatggatttctttcatttctaaattctttggtggacacttttccaaaaaggagagttaaaggaagatatgcaagctgccattttgcacccattcatctgaaaactatttgagagttttaaagcagaacgagttgaaacaatgtgccagacctaaaattggaagcaacacagaaaatggctttgatgtgatggatctagtataattgtgtgtttgcaagggcctcgggtctggctacactccaggtgtaagcatccctaacccagtctatcaatcagatgttaccagtttgaacgtttctgttgttttttaaacagaaatatgagtggtgcctataggaatctacatgttagcacttggaaaatgactacagtgagtatcacataaaaacaaaatttgcaaaagataattatggaatccacatgaaagtcttacatctgaggcttctacatgaataatgaaaggtgaacactctaactacagttagaattctgaggtaggattttcataatgaggaccatgttatgtacagcttggtgtaacagacttgtatcttcttttatttaaacattataagtgtgagacttcttttatttccaactgaccaggtctcttaagttataaactttgctgaaaatttaacataggtaggacagtttgtcataattcttagcactggaagaaactgtgagttaaaggaacgaggccataatgttgctatgtcatgggtcagagccgatgttttaaaatgggggcttttcattgacacccgggtgacaagagtgaaactctgtctcaacaaaaagaaagaaaagaaaaaaggaaaccaaaagcttttaccagaaccccaggcaaatatctacttatgtctcagtggctggggaagtggggaaaaggggaagcggataccggataagtaaccaaaagtgatgctacactcggcttagttgcttcctattagcccagttgcagatgggaaacagaaggggattgactgctctgggtcatcaatcatgctctcttggtggggagtggatgaagaagagaagatgtgacaggtcatttctggcaacttccaagtctataatagcctagctagcaagggaacttacggacaatattttgccattgacttatattttttaaaattattatgttatttagagtaaagtagatagccatatgagctgacctagatgctttcctccatgaaaaaaaaaatgagcaactaggttaccatttacaatggttcatatgtgactctgaatgactgtgtgtccctctattttagaaatatctgggccttcctgatgtccaggttgacacacatcctgttttgccaagttggaaagagttctgaaaatcccattccattttatttgaagaaactaccacagcatttcttcttctaaccctaatgggaagcacatggagatcattgaacgttgggagcccttttatgcccaaattatgttttttaagcaaagagctatgttaaagcgacctccaaacatgaccctggcaaaagtcagtagccttgcttgttctggccaggttcctgatgtaacccaaggttctgggaagattcactttaattacaaccccttttgatctgttcctcatggtctcttacataacatgtattacagttactaaaactgaaattttcatctttgagctaattaaatggatgtaatttgtacttgacttcttttcttttagaagagctggttaagtcagtatgttgtactgtttttctaaagcacgcaacttaaattctctttatttctttaatttttgatttaagtaaaactttagcttttgtattctattacaaagataataaaaacacttatggcatcatctaatttttctttagccatcatacaatatcctatgaagaatatttctttggaaagcattttcttcttttttaaaaagtaaattttactgtgtatatttgaggcttacaacatgatgtgatgagatgcatgtattaatagatagtaaaacggttgctataatgaagcaaattcacgcatctatcctctcacatagtcacttttgtgtgtgtgtgtgacaaaagctgctgaactctacttatttaacaaaaatccctaatgcaatacaattttactacctatagtccccattttttacatgagatctctaggtgtgttcatcctacttatctgctactttttatcctttgacctacatctccctattttctccccactgacccataaccactgtttcattctccttgtctatttgattttctgttttaagattccacatataagttaggtcttgcactattttttttttctgtgtctggcttactcacggagcatagtgtacaggtccatttatgttgtggcaagcattaggatctctttcttttttaaggctaaataatattccagtgtgtgtgtttgtgtatgtgtgtatatgcatatataccacattttctttatccattcatttgttgacacttaggttgtttccatgtcttggctatggaacagtaccacaatgaacatgagagtgcaggtatctttatgagtgggtgatttcatctttgtgtgtatacccagaagagggattgctgggtcatatggtagttccatttttaaatttctttaggagcctccatactgttttccctcatggctgtatcaatctaaattcccaccaacattgtacaagcgttctcttttctctaccatctcaccaatatttgttatttcttgacttttcaataatagtcctattatcaaaagggtgtgaaatggtatctaatgagtatgagatggtgtctcacagtggctttaatttgcatctccatggttgtattaatccattttcatgctgctgataaagacatacccgagactgggtaattaattaaaaaaaaaagagagagatttaatggactcacagttccacatggctggggaggcctcacatggtgaaaggcaaaagttacatcttacatggcagcaggcaagacagaatgagagccaatggaaaagggaaaccccttataaagccatcagatgtcatgagacttattcactaccatgagaacaatatgggggaaaccaaccccatgattcaattatctcccactggatccctcccacaacacataggaattatgggagtcacaattcaagatgagatttgggtggggacacagtcaaaccatatcaatggtgtttagtgatgttgagtacccttttcatatacctgttgatcattttatgtcttctctggagaaatgtctgtttagcttctttacccctttttaaatcaggttatttatttttctgctattgagttataaatgttctttataaattttgggtattaaccccttatcagatacgtgttttgcaagtactttttcccagtctgtaggttgccttttctttttgttgactgtttcctttgcagtgcagaagctttatagtttgttgtagtctcatttatttatttttgcttttttagcctgaacttttggtgtcagtgttttcttaatacactaataagttctcatgagaattggttcgtttccaaaaagccttgcatggtgcttatatatgaaagtgaaaatctacattacttaacataaagcatatgattaatactagaaacactccattctccatgtatcatgaaaatattagcatatgttagaatgcaagatcaaaaaagtgttataagttgtaccatattactgatcatgaaatttataactcataattttggccttcagttcaacagcagctctacgtaacaagcaagcatcaattgaacacgttacgtatgtgcaaggcactctgctctgagtatagggaggaattagcatactgcagtgcctgttctcaaacgactcttattccatcaagaggaaacagacaaataaacaaataattacaatgcaatgcgatcaaacacaatgataaaaagttacacagagaccggatttaactctgttggaggacggtgaagatagggcgtcagagaggtttcagaaggaaggcaatgcctgatgaatagcttcttgattgaagggtgctgaggaagtggcagcagggaattccctgggcagaaggaaaccaagtaagcattgtgataaaagtgcagattaacagtgatgagaaccgaaactaagacagtgccagtgaaatgctggcaggggatgaatctgcagtactttggaggtaacactgaaaacctagcaatttgatttagtattgtccaaaaaggttactaaagatgaagcttactggtggttcatggagataattttgctggccttgtctttttaatagatcacttgatgtgaagcaaagttttaacaaacactatatgtgcataatttattttaatttgaatattatatatatataaatgcccaaggctgtttgcataaatagcatatctctaaggtatttgttcttgcatagcaacagactgagggcaaaataagaaaacgatgtaagtatttagtgaacatggagaaaaaaccaaactgagtctcactgatccttccaactcctttctgcctgattgaaggatttacttggtcacctacctctgcatattagttcccaatcctgtctaataaattgccaagcaacaaactgcctgatttattcattctgtcagtatgttctgagatgcttggaactggagacagagaaatcaagaaaaggctgtagccaggcatggtgtcacgtgctacttgggaggctgaggagcagggatcacttgagcccaggagttcgaggctgcagtgatctatgatcatgagactgcacttcagcctgggcaacagagaggacaccatctctaaaaaaagaaaaaaaaaaaaggaaaaaaaaagaagtggtcatttgtccagtgtaataagcacattcttagaagtgaggcttgcaagaatgcggagaagtgagctaactctacctggtggcaaaagaaacgcttcacaaaggaagtgataatgcagctttgaaggtttgaagaatggggaaaaggaggaatgtgtggtggcatttcaaatataggatactgtgcgagatcacattattgtttccaattacttgttccatctccctgtgacaggtttatatttccctgccccatttaaggtcaattttggccatgtgacttgctcagctcaataaaatgtgaacagaagtgatttgtgtcacttatgagcaaaattcatcgtgacattccagtattactcttctccctctgacatgtgagaaaaccatttccagaaaggacctgctcatttcacttcagtcccagaaaaaagaagactcttggaataaagctgaggccaacctgcagccaatgtgtaatatacaagcaagaaatagaccttgctgttgaaaacctccaagacatgggatgctggttacagcagcgtaccttaggaaagctgattaacacaaaaatagtcactgaaaaggcacaggactatgaaagggcatggagtggttgcggaatggtgagaagttcagattggctgagagtgtagactccgcgtttagagaaagacagccagaaatactccagaaaggtagcctgggaacagattttcaaagggtcttaaacgtcctgctaggaaagttgagttttagtctttaaatagtagaaagccagcagaagctaaggagtgacctgataagtttttttttttcttagaaagatgattctaataggaggggaatgatgctagtaccagggaaatcagctaaagcgtttttataatcctaaccaccactatttattgtgcacataccatgtgtgaggcattttgcacctatttaccaaagtaatacaaccaccccctggggtagacattgtaatgatcctttttttatagatgaggaaactgaggcacagagaggttgaataacttggctaagtcactccaaagacattgtagcattagagttccatcccaagcagtctgggtgccagaatccatatcccactctcagaagcctagaaagtggtaataagcatctgaagcacacggagatagagaagaacatctcgagtctcatatttatggggctgcagaggctgaaggtgggcatgaggtgaagcttaggggtgacagagatggaggagccacagataatgcctcattctttactgaagaggctcaattggtgctgaagcaatgaattggaacgagggaaaaaaagagcaggtttaggaaaggaaaatgacgagttttgcttgggatacattaattttgaggcagatgtgaggttaggtggagatgacctactggcagttagaatacgggaccgaagctaggagcaatgtggggtggagacagatctaggtggggcagaaggccaggtagcagattaattcaccctggcagatgtagaaagtgacttgaaaagagtgtcaagggaagaatttggaggaaccccatgatttaaggagtagatctaggaggaagagccagagaaactttgactgggaggcagtgataagggaaaggaaggtggcagggagagaagagaggatgggttttcaaaatgatgatcaccacaatgacttaaaactggaggaattaggaggcaaccacagccacctctgtttgtggcacactccagccatagtgactttgagaaacaagaacctccacttccacagcagcataaatcacattgcaccttatgagtatcccagtggaggaggtacaaggatgcatttgggtggaggtggagaaaaagtagaaaatgagcttccctgatgatgactctcatagaattaagtacttttatactaatttataactgcagaacttatttatgaacttctaaaatgacagattcccataaatggggaaaaaagtgcattgcttcaatttacaggaattgcctaattccaaacatagtaatgagaaggatttaaaattaaaatccttttgggaacactcttctacctggaagagctagcttattagagtcacctcttatgtgttctccattaacactattaaatttcaacagcctgtaactgttgaatattaagatatttgcatagaattccccaggtttttggatgacctagtagaatatcacatttttaaaaacacacgaatagctcaaagctacacagagtttattatgcaacattctattaggaatagctcaaatgaatgctttatagtagaagaaagtgttgcagtattttgtctataacataattgactttcttggtgagtatacctcaaattattgaggtatgttgagatggtgtttggaaaatgttccatggaaacaaagcttggaaacttggggttaaacaatcttgattttatttttctattgcaggacttctgagagccttcggtgtgctggtttacattgcatagctctagagatgggtattatgtaggagttcctaaacttaactgaccatacatagactcccctcttttttttttccaaaaatatttgacctactttatgaaatgtcctatatagcagattatatttctgttcaaaatgttggctgctcctccctgtggtatcccttttctgtagaaatattatccttctctacttcactggccccaagtgtggccacgtgacctgttttggccaatgtaacatggctgtgggtaaggtgtgtttcttctatcagacactcgaagagccaggtgtagttcatctattctttgtatcctttgctacaagaccagctatgtcccaaagtttgttctgacatcttagagttctggagagtcctagaatggaaatgtaaatgcataaaacataagtctttgaaattgtaagccattaatattttgcatcatttgttaccacagccaactgagcctaaggtgactaatgccttctacttctaagtatttctaaattatctgaacctttaccacttttcacaggtgtactcattctgtattgattgtctaaatgaggaagtgttcttggaattattctttaggttaggacagtacacttgaaggtgaactaaaaaaaatatatatgaaacgtgtcttaaagaaatggtgtctaggctgcgcgtggtggctcacgcctgtaatcccagcactttgggaggctgaggcaggcagatcatcagaggtcaggagtttgagaccagcctatccaacatggtgaaaccctgtctctactaaaaatatttttaaaaagttagctgggtgtggtggtggacacctgtaatctcagctactcaggaggctgagacatgagaatcacttgaacccgggaggcagagtttgcagtgagccaggatcgcaccactacactacacactacagcctgggcgacagagtgagactgtctaaaaaaaaaagaaatagtgtctagtagttacctggaattttatcaaaaatgagtagtcttggttgggcgtggtgtctcatgcctataatctgagcacttcgggaggccaaggcaggcgggtcacctgaagttgggagttcgagaccagcctgaccaacatggagaaaccccgtctctactaaaaatacaaaattagctgggtgtggtggtccatgcctgtaataccagctactcaggaggctgaggcaggggaatcacttgaaaccgggaggcagacgttgcggtgagccgagatcacaccattgcactccagcctgggcaacaagagcaaaactctgtctcaaaaaaaaaaaaaaaagaaaaagaaaaagaaaagaaaagaaaaaggaaaataaaagaatattctcaggctcaattctcagagattctgatttaatgggccttggatgggtcctaggaatctgaattttaaactagatgttaccaatgcagcttgtctgttaaccacaccttggaaaaatgccactctaaagccactgtttgattaacagtcatgtgataacatgcatttaaataaatgtcatttcaatttaagaaggcaccatggagggtcctccttggaattcctggaagcatgtatgaaatcagttttatcacatttgagtttatattcattacattttagtgcaaaatattttatgcacaaatgatactttcatgcttaaatgcctatgttgttcaaaaagcctgattctaagtgacccttagctctttcaaaaaaataaaaccaaaaccaatctgctttaaaaagattaagttctgttaccaatgaagatcaagggctatttcagttgcaagtgacagaaacttaattcaaactgtgttaagcaaaacaaacattggttacagagctaaaacgtccatggtttttgagaggatgaagttcttggttgacagggcaggacatgtcaaaactggagagaagcactctgggaaggtgtctgggaggtggggatgctatcagtcagtgggcaggaagaggagggtgtgcaggttcttgtgggaggaagactaggcaggcaaggcactatctggacagtgtgggaaaaggtgaaggggcagtctaggcagatgactggcaccggggagatttgcccaggtgtggtaaatggaagtcctgagagctgggtagggaataatcagaaaggaaggagtaggtgggtaggcagagcgagaggtgtcagtcagctgaaatcagggctccatttacaattagatctagatactcaaaacgtagcttcaaatatctgcttctttccatcaatcagcactacatcctcctccattgttagcttcatactcagacattaagtcaggatgagaagaaaggagagggaggagaatgagttggctgaataccatgaccagatgtttagaaaccaaatcataaaaatctttttaactggtgtctttgaatgtcttaagcttttcaagaaattcttataaccttcaatatctgtttgtgtcatcagtgtcagttcaaatcgattccactgacagcttgataaatgatttccaattttatctcagacaaatgcagtatggttcaatcaatggttttgcttatgtgagcactttaggattgtgtccgatccatttctacttaaaaatttagtttcagtgttgcttgactaattttcacaactctgtgctttgaatgtgtctgaatattgccccgaatccctccctataacaggcatgaagaaaatctgagatagaaataatacgtacttgattacttgatcctttatcacaggcaactaactactgtaaccagatgattccctgctgacactattgtgatacctgccaaagaaactgtctaatgtcacgttaacacattaaaaatgacaaccagccaagcctctaagccttctttcactcttggcatttgtagttgtttgcttatcggatggtgtcacgtttctatgagtcccagcgctggctcgcattatagtcaagtggaaccaagaaaatgctggcaagtctgtcatggaaagctaggcctataatgcacaggacaaccctctttaaccaaaaattatctggctctggatgtcaagagtgccaaggttgagcaaggttatgcctgttttagataatcataggaactctggctcttacctgtaagaaattgaaaggcatgatcaggttttaagcaaaaggaagaatcatccaagttacatttttaaacaggattgttctggatatgatgttgaccacagatggcagtggagcaagcaggaagcagagaggactgttagcagattattgcaataacagacaagagatgatagtgacttagaccagcaaggtggtttttgaggttcacaactttaaatttggttcttttatccctaccatagagatgaggaaacagaggctcagggaggaatataaccaggccacgtggctgattaaaccacggcattagtatgtgggcccagcagtctgatttcaaagccatggtctttccacagcattatgatgcccttcccccatcaccttcctctgtatctctttctcaaacaaaatgcaaaaccagtgacacaggaataaatcctagaaagagcaatcttcacaaggttcctttccaggcctaccattccaagtatctgagctaaaccgacttgagcccgggtcacctcagttacccaaatctgtctctttaaatttccccctaaggacaagattggtcccagaacccagagcagggatgagcctataggtggggggcctctgggtcctacagaggatggagaagagatatgagaggtgggaaaccagtccagcacattttctggatcagcggactgtgtaatgtgtgtttgttaatttgtgccccaaaccacagctgcccatggactcagcacagccattagtggatttctgacagtctatggcaggcagccctgtgttcttcacaattgtcacaatttagactttaaacaattcagagtggtctcttttcatgtataggaagctctctctgggcaaacggtgggtaaccagcacatcagacaacggcatcagattgcaaacttgtctccgtaaattgaagtaatcagaaacaaacagatacaaagttgttttataaaacctcttaaagtataatatacataaatataagtgcatatatcataaatgtatatattggtgaatttttataagctaaacactaagaacattatcagtaccctggggcccccaccatccccttccaatcactactcttccaagagtagctgccattcctgacttttaatactgtaaattagttttgccagtttttgaactttttctaagtggaatcaaatagaatgttcttgacttatttcctccaacatcacatttgtgagattcatctgtgttgttaagtttagaccatttatttttgctgttatataatatgacatatgaatacaaaacagttgatctgttctgcttggatgggcatgtggatagtttccagtttggagttattatgaatagtatgctgtgacaatttcagtgcatgccttttggtgaaaacatgcacaagttcctgttgagtatatacgtaggtgtggaattgcagggttgcaggggaacaaaagatgtcttgataggatgaaatataacatattctagctatagaggtaaaacaatgtgtatagatattacagggaaggtttggataggctcaagaatgaaagcaaaagtccagagcttaggaaaagactgtgaccgtcagcatgcaaagtagagtatagtctaagctaaggaaaatgatggtgtgtgtagatagttaggtaacttgcagaaaccaagtggcagcagtgctgggtagtaaagggctttcgttgaaagacctgagttcgaacttgctctcagtttgactgtgtaactgaggtgtgtcacttgacagctcaaagccttgactttcccttacagaaaattgttgagaagattaaattcattcattcaacaatgattgattgactacctacccatgtgctgaagactggagatccagcaggaaacaaaaaagtgtccttgtcctcattgattttactgggaaggaatacccatggtaaacaatggccatgtaatgacaattatgaaaattgcaatcacggaatctaaccagtccggggggtctgggaggagtgtctgaggcaagtagacatgagccaggccaagaattggggtgacaaatttcaggcagatgaaatagcatgagggaagtctatagagggaaggagcctggcatgtgtaaggaaaagagacagtgagtgtggctgacaggagtaagcagaggggagagtgaagaccagatgcagtggcaggccgggcttttaagtggttggcttaccttgattgctttttttttgttttgttgtgtttttttgagatggagtctcactctgttgcccaggctggaaagcagtggtgccatctcggctcactgcaacctctgcctcccaggttcaagcaattctcctgcctcagcctcccaagtaatttgggactacaggcatatgccaccatgctcgactaatttttgtatttttagtagagacggggtttcaccatgttggccaggctggtctgcctcagcctcaagtgatctatacccctcaggctcccaaaatgctgagattacaggtgtgagccaccgcacccagccccttgattgctttttaagccttttaaactgaaggcaaaaagaggactgggaaatagggtgggagtggtgacaaaatcaggaaagtgcaaaaatatatgctgatttgtaaatttacatttcagtattcatccagtcattcatttatatttatgcgatgagggactaccaagtgcatctgatcatgtctgaaattatttgggtgtcaataactactgaatgggatgaatgcataaacagtaacttacaaggtcaacacgctggcaaaagaaattctgtttaaaattatttaatttcatttgctctgatattaagttagttctttcagtagattttcattctaggaacagtcgctaatatttgttgaatgcttactatgcatcaacttctgttctaagtaatatggtaatatgtaacaggtatgttttctcattcactcctaaccacaacaacgcagacaggtaggattcattattatcccctgctttactgatggtgaagtagacatcgaaaggcacactgacccactggcctgagatcacctagttagtaagcagagagtcaagatttgcactcaggcagtctgattccagctcaaaagctcctaatggctacttctagcttccagaaagaagtcacagacaagcaacacaaatatctggttggtttaattgttgcatttctcattttaaattagtaaattggtattgtgcattacacattaagctcttgtgagctgattagtgtgacttgactctctagggttttgctcccttctagtgaactaataaggctgaatttccaaacctgcaatccagctgtggatcaatggttagaacacaggagagtgacagaaacaaagatggggaaagttgcagcggccacatcttgcaggttatatagaccatgcacacagtttgaactgtttcgtagtgtgtagggaaggagtatgattggttaggatgtgatcacaacagtttgggtgagagatgatggtgacttagatgactatgatggtagttaaaatggagatgaaataacagattctaagtaaaaggctgcacaaagtgcttggcatgtagtaggtgtgctattaaggggtagctattgttaacaaccatggcaaattcatttcaatccagcaggttacatttcatggattggaaatgactgcctgaagcatagcgttggaaagatattctgaccccccttcaggcccgcacagaaggagcactaggatagactggagatgtctgtcataagctctggataaacaggtggtagcacaaatgttgaggggtgctttataaggattttcaaatcaatagtttggatctgtgcccccacccaaacctcatgttgaattataatccctaatgttgcagtggggcctggtgggatatgaatgaatcatgggagtaggtttctcatgaatgatttaacactctccccttggtgctgttctcatgacagtgagtgagttcttgcaagatctggttgtttaaaaagtgtgtagcaccttcccctcactctatatatcttgttcctgctcctgccatgtaagacacctgctccttctttgccttctgcatgtttggaagcttcctaaggtcaccccaaaagcagaagctgctatgcttcctgtatagcctgcagaattgtgagccaattaagcctcttttctttataaattacccagtctcaggtatttctttatagtaatgtgagaacagactaatatacaagtaaagacaagattcttatacagacgattttgaatcgtttttctccataataatattcaaagataaagtgggcttaagctatagtaaaaacaatcctatttattagaaaaaagcaatacctaatggatgatgaaccacagaaacttacaaaattgaccttcggtttgaaagtactcatgggtaatgccctccctgcaaacaaaagattccacaggcaagttagtttgacttaggtcaaatgttttaggcctctcttagaggttcatgatgcatattagcatgctaaaagttcagaaagggaagcacactaaaagacacatttttaaggttgtttaaccagaagtttccaaattcattgaccatgggatattttttcactttatgcttaacatctcatagaaacataatgcctgcattaatattgcattatgataacaagacattgtgctacaaaattggtaatgtcatgtcatcttttttcttctggcttttgtacagctcaatcagtaggagcaaaggagaggaggagaaggaggctagtgcttttttttttttttttttttttgagctggaatgcagtggcacaatcttggctcactgcaacctctgcttcccagattcaggtgactctcctgccccagcctcttaagtagctgggactacagacacccaccacgacccccaactaattgtttttgtatttttagtagagacagggtttcaccatattggccaggctggtctcgaactcctgacttcaagtgatccgcccgcctcagcctcccaaagtgctgggcttacaggcatgagccactgtgcccagccgactagtgcatactatttgttcgtttctagtgaaagatgctcacttaatgataactggttgtatatagcagcaccttggctctgaatctgatcactgacgttgtggctaacaatatttaacctttggctgatgaagatcaagttgcagcctacacccacattttgaagttgcttaaatttggactactcaggagacacacagattctacagatgtgagccagtcacagaacactagggcttattcattttcaaagtttccaatttttagttcagtgcttcgtacataaaagaggctcacaaatggcttttgagtaatgaatgaatacacaaacgaatgaataattatggtaactatttttgctcatgagaaaaggtaattaattataagaagagtaagtattgtgccaaatctaggataaattttaaataacacaatagccttaaaattaaacaagagttctttttttgttctgtggagatttagcaagttagatctacttttgtctgaattatacatgctgaaaaaatggcatcttcagacacaaattggctaacgttattaagtaactttgtcctttaattaggcaagtcactgaatctctttgttttcttgtctcctgcgataggtgaactctaagttctaaagtgtccatgaatctattcacttataaatatgatgctttgtactttttttttcttgcaacaccgggaaagtgcataatgttcattctaaaacccagtctaagtccagaccgaaaaagcctcaggaaagcacagaattccaacatgttttgcaagaaaatcctcactcattaaaggtatgctcataagaggaaaacaagaactctattatattttcctacagaagaactgtatgaagtcctctccacagaatctcagcaagaacaacactctcttctgggacaatcttgatgaacatgggctaccttgggaactggtgacttgggcaggtcccctaataatctttaggtaccattataagccaacacttacatgtacttattaaatagcagccactgttctaaatgctctacttagacaaattcatttaatcctaaccatagccctaagaactgggtgggattattatcttcattttacagacgggcaagttaaggtatagcatgcttaattatctaactgttatggacctattaaatggtgaggaatcaagatagtatgggtccagaatctctgctggtaacccctctgctatactgccactcaggatatcatctagctattgacgaaggctgaaacaaactaagtcaactaacacttatcgggagtccaccatattaaatgctgtaaagaactaagggggaataaaatgatgagggcctcattactgcacttacccagctaacaaataagcaacatactctaggcagaatgaaatgaatattagaataaagattcttcggaaagaggaggtagaatttgatatagccttgaagaataggattttaatagatagagtggaaagacaacatttcagattcaagcaacagtgcgattttagggtgtgccaattaggcttgtctgcccagattgtaagacacacagtagggcagcggtccccaaactttctggcaccagggaccagtttccatgggagaaaatgtctccacggactggggttgtggagatgatggtttcaggatgaaactgttccacctcagatcacatcgggcattagattctcataaggagtatgcaacctagatcccttacatgtgcagttcataatagggttcacactgctatgataatctaatgctgctgctgatctgacaggaggtggagctcaggtggtaatgctcgcttgcctgcttctcacctcctgctgagcagcctcctgcttctcacctcctgctgagcagggttcctaacaggccacagtccagtgaaccctgcagtaggggatgacatctggctcttgaagagtctcaatgctgtgctgagtctaaatgtcattgtgtaggcaataaagactaatttgacttttactttggagtataactcgagatagaatggtgggctataatctgagcaagaagaatgagaaattaaatcaaggcagtttcagtaacaagtgtaaaaatgggtgatgtggtaccagggtgttgcgatatggtgcccagacctccccttcagtaataatgatcagattatccaagtcactgggaatgctgccaaaagagggccttcggccaaggtcatgacctcttcctgggatggtggcatcaatgactgatcatcactggggatataaaggcccctacctctcaccacagctcaggacagctctgaagggccatctcagcctcagaactcaccacattgtagttgaacttctttctctgcccagttgtgctttctttccttctctttgacaaactactgtctcaagagcactcccaataaacctctcccacactaatctctgtcctagagtctgtatcctgggacgctcaacctgcttctgatggctgtaaggtgcattataaaaacaaaacccccagttgggcatgtatgcacgaatgtagcaaatgaaggagaagaaaaagtcatagatgatgcccaaccagcatagctaggagggtggtcttagccagcatggtcactccctactcagcccctcagtgcagtgtctcttcttgacccctataatctactcctcacacatgtggcagagggattcatgctccaaatcttgccatcatgtgcagaagaaattcaagagtcctttatcctgcctacaacatcccacctaattggccccccagatacctctccaacctccccatgcttctggactccagccacactgacctccttgcagttctggaacatgccaaccatgtgcctgttggtcccccagaaactcccataggcccttgtctcatttcatttagccctctctgctcaaaaattccttctcaagaaggcctcctccaactactccatttagcatagaaacccctgtcattctctatccgtttaaacccacttaatttttttccaaagcacttatttcaagttgccattggtacattatttacctatgtgtttatgcatggtctctttctctctctagaatgagagctccatgaaggcaagaactttatcatcttcactgttatatccctggtcaggcacataatttgtacataagttaatgaaaatgagagtcataggagaagtgtgttttcagcagaaaatatcagttcaattttgaataggttgaatctgaacagcctttacaacaaagcagtcagatcagatgtttagaagacagttactcatagtacccagtctctgtgaggtgtagggagagaatgagctagaatggcagttcctaagttgctctgggggaatattaacctcatggcaggctctttgaaatacagaatggttgggccaggtggtggctcatgcctataatcccagcactttgggaggttgaggtgggcagatcacctgtggtcaggagttcgagaccagcctggccaacatggcaaaacctcggctctactaaaaatacaaaaattagctgggcatggtggcatgcccctgtagtcccagctatttgggaggctgaggtaggagaattgcttgaacccaagaggcggaggttccagtgagccagatcatgccactgcactccagcctgggcaacagagtgagactcagtcttcaaaataaataaataaataaataaataaataaataaataaataaataaataaatacagaatggtcatattccttcaatgaaataaaaaccaaacagctttaataaaagaaaaattaataaacaaataatggataagagggagatgaagagaaacagaatgagagacagagaaacgaaggggatttattggctcatgtaacagcaatgtccagaggttcaggctggacaagatccaaggactccaacagtgatcccagaatttggtctgtctccatctctcagctctgctagtcacttctctgagggtctgcattctcagccaggctctttccaaacagaccacatggaaagtagatcaccagaattggttccaattccttcctttcaacgaacgcagtgaaagatggtgcctcttccacaacagttctttaaaaaaatcaaaggaattggacctaaggagctggtctggcttgagtcctaggcccagagggataaatggtctgattcacttagactgggtcatctctgacactgtgcgctgcaggttcccaggagctgatgatgtgcctctcttcccaactccatgtttagtgatttcaccttggtagcttaaagttggccatggtaaaagtatttacaccatggaaaatgtcaaatgctacaaatcaaggattttcttctttttttttagaattggtttttaacacttaccaatgaatcacttgtcatatgaacatttctaaagccaggaatgggggacagattcaccagaactcagggactaagaatgaggaataggttccctaaaggacaatcaagatattgttaccaggaaaagggatgactgttgggaagcgtcctcccatatattatattattacattacattatgttataattgaggatccacaatgaactaagggttctaaaaaggcctgtgacttataaagctgtttaactcagtgttagccaaccttctgtgattagaaagtctcctttttcataaacttctgattaacttctcaatgcctttggaaaatagtgaacaagagtatagagatattaatacaaaagaagggaactaacaatttatatgtagatctattgctgtgttagtggctgggggaaaaaagattcttaatgttttcctctcccttgaatggcaaatagaaaatgcctaaaatgaagaaaatattgattttaaaccaactgatacgtctgcaaactttattttaactttgagccactaaaagggatttaaaatcaaaggaacaatatatttcctatatcttttaggctgaatattatatgttaattctaatatttttatgagctgtaattaaccttcggtcattgagaaatcaaatactcaggcttttaagcttatatctaaaacttcatctagtgctatgataggaagaaaaaatgaaagacagaaagcaataaaaattaattttaaaatagtttctttttttcttttcttttttggcaactcaggctaatcaaggacattctgaccatgttttgagagtcttaatacgtaagcttcatcagagtcttcataagacaaagggctttatctcactcactgttgtttccttagcatgcatatgtattaagtactcaataaatatttgttgaacactaagttttaaaaatcaacaatggggctgggagcagtggctcacgcctgtaatcccagcactttgggatgccgaggtgtgggggatcacctgaggtctggagttcgagaccagcctaacatggagaaaccctgtctctactaaaaatacaaaattagccaggcatggcagtgcatgcctgaagtcccagctacttgggaggctgaggcaggagaatcacttgaacccgggaggtgggggctgcagtgagccgagactgcgccattgtactccagcctgggcaacaagagcgaaactccgtctaaaaaaaaaaaaaaaaaaatcaacaatcatgacagaggtatattttatccacttgatgctttctcatacacatcatctcatttcatatgttttgtggacatatgaaggcactgtctgcccttcccaccttccttcatgtaggaatttaccttcccccaatagctatgtcaccatccgggactttatattcttttacgtggcctttctcccttccctttttgcctaaattagttaggcaatagctatgctgccatttgggacttaatattctttttcatgatatttcccccttccttgtttgcctaaattagtgagggctgtatttctaccacttgcaggaaaggaatcttcattgaacaattttcactgttatatctgttatactgaaaactatattaatggaatactgatatgctttgttcttcaactgaaaatttttattttctaaagataaagtattaaacatccaaggctcaatactgaatataagtctagtataatttcaacaaattccttactaaactgctgtgcaaaataaagatgaaagctcacacctgtaatcccagcactttgggaggccaaggtggatggattgcttgaggccaggagtttgagatcagttggccaatgtggcgaaaccctgtctctactaaaaatacaaaaaattagccaggcatggtggcaggcgcctgtaatcccagctactcggcaggctgaggcaggagaatcacttgaacctagaaggtgtaggttgcagtgagccgagattgcaccactgcactccagcctgggtgacaagtgagactctgactcaaaaaaaaaatatatgtgtgtgtgtgtgtgtgtgtgtgtgtgtgtgtgtgtgtgtgtagtgtgtgtgtatatatatattgtgtgtatatatatacatatgcatatgtataacactctctaaatccaatggagacaaaaataacactctctaaagccaatggaagtgtctagggatgctcccggctgttggtggttttgaatataacatcactttcaggttgaagaaaggagtaacccaccagagatgaatagcagtatgagaatccagtcatgggggactgggtgtggtggctcacacctgtaatcccaacactttgggaggctgagatgggaggatcctttgagcccaggagtttgagacaagcctggcaacataatgagaccctgtctctacaaaaaataaaattagccaggcatggtggtgtgtctgtagtcccagctacttgggaggctgaggtgggaggatcacctgaacccaggaggtcaaggctgcagtgagctgtgatggtgccactgcactctagcctgggcagtagtctaaaaaaaaaaaaatccaatcatggggtctcaaagcagaagagtagtgtggggaagggggatgggctgatcctacagagacacaattctgcactcaaacaacacccgaaggaaagagcaagtctctatctcaactagcaatacaatctgaaacaggaatgcaggagagaaagagttagattcaaccctacagagacaaaggacaggagccatttggactaaagagagacagaattcagagcatgtcctttgggttgagaagagcctttgacagcactcagtcaaaacccaactttgtcaaagcctcactcacagcggcactacggtgtaggtgagatcctagtgaagctcctgaaactagaagtggcaggagaaggttcagtggccagcactgaagtggaacatagcgttcaggaatgaggagtgtgggctttggagccagactgccatggtttgaatcacactgttgtcagtaaccgtgtggcctttggcaagttagtgaacctctttgcctgatttgtaaatggagatgacagccctccctgtaacttgcaggattgtagggaggatgggctgagttggtacacagtacctggcatgccgtaagtgcttaataaatgttcaatgttttctagtgattatgaattctgagccccacttttagccaacatcttctaaatcattataaattatgatgactttggaattaaacagactggtgcattcatatctttgttattttactcctttgagctttggtctcttcacctgtaaagtgagactaatatctacatatataaaacacagagaaagtgcctagcatggggactctttatgttaataaccaattaatattaatctcccaacctgagagtcacctgcacagctatgtttctcttttctagagttaagaaaaaacccagtaaggttagactaattggtatagtccaggtcaagactacttgggtaggtagaatggaattctatgtgaactcacatttgagtgggatactacattgattagggtagtggaaaggtttctgtcagcccttcaagtccaagaccctgggaacaaaatagcctgaaacacaagatttcttgggcgtgtcacagaaaaaaaattccaagctgcagactttccctttgagagtggcgtcctcagttaccttaaattccagtagaaacaccatccacagaaatgtccctgtttgccagagctgccatagtgatggccacttttgttttcccaatatgagacccaggcagtgttccagattaggtacccgaagaaaaccctggggatattactgttatttaaattaattatttaactgactagttatttttcagctacccagtgtttcagagaccttgaattatgcctattggcaaatgtgtaaccactgaaaattcttcacagtcagaaactggaaagaaaaattcacccctgtagttttaggttttttggttttgtacataatattgaaggtggtggattaagtgcaatatttagaataatatattcaaggatttaaggaatttgagttcaattttgaaccactcgaccacccctggctggacctcagctcaatcccttaatcttttggcttctttctccatctgcacaagatgcctctggcaacgcactgagtgcagtagcataggaatacattcaataatgggcttaatatcaccactcaaaagggagtaaattgcttttttgtgggatccattagcttaattgagaatattagctcagtattctggatgtacgatgggctataagaaagaaggtagcatcaatttaaatgttttgctttgcctccctaaatgactctggtcaacagctaagaataagaatataagaataaggggacagaaagaaaagcagggacagaggagaatgctcaggaagtcaaaaggaagaggtaaagggatggaggctcaatggctaagaagtgaggtatacgtgaagacggaggcggaaaagaagatgggagaggcaagaagggaaacaataagattccttaaggagaggaagagtaagaatgtgaaacgaagattccaatcagatggaagttaattgggaccaaccatatggagaggggcagagcagaggggatggacagagttcactcgggaaagagagggtttggtagggctgtctccctccctcctgtcactggctgtcttcacatttgcggtgctcccacgatccccaacactaggcttttggctcagggagttggctttaacagctgtgccatttagcctcccaagagtataagaggtctccaagacccagggagttaagcaaatgttagtgtatcgggggaaagtgttcttacttcatgttcttcaaattaaacaatgaagtgaagtcatagaggacaggaggtgatggtaaacaatacaatggaaccaaagggaaaatgactgctttatgggtatctcagtgataccaatttactcctcataattctctaagctttactttgcaaggacaattggaggctagaactgcctcaccatcactcctactcccaaagctttgatagacttaggagtggtagtagaaattataataacgataacattcacagcaaatatttattgcttactttgtgtcaggcacatacacatgcatccttccaaaagggatttcagatggtctacaataagacaacttctaagaggggaggaaaaaatagatatatataccttggctgaggaaagctacagtaaatttgatatagcaataagtggtttgataggaattaactcattttgtcatctctacaaccctacgaggtaggtacttttaataagccctttttatagagaaggaaactaggaaaaccaagacttgattttacatcattggcttcacttcaaaggctagggaaaacaaaaacaaaaacgaaacaaccacagtaagagtctcactacttactttcaacaatagcaatgttcaagttaatcaccagaaaaaaaattagctctgtatgccaccaaaagatagccaaaattgttgtgtagtgtccctcttaacttagatatgtgagtatcgctcaggtaagtacccttaagacaaattcttcccagagactgggtcaggaaaggctttctcctgatgaaactgtaggactccttccacttgacaatgagagctatgcaaaccttcatttcccctatttcactgctatgaggaagcttgggctcagttttatgctcaaatactattgtttgtctcagccagaatttcaacttttcttttttaaaaaatatttgtctttcattgtaaataaaccaccttaagtcccttttggaagaaggcacggtataaataaacaaaagacaggctgggcgtggtggctcatgcatgtaatcccaacactttgggaggccgaggtgggtggattatgaggtcaggagttcaagaccagcctggccaagatggtgaaaccctgtctctactaaaaatacaaaaaaattagccagacgtggtggcggacacctgtaatcccagctactcaggaggctgaggcagataattgcttgcacctgggaggcggaggttgcagtgagccgagattgcaccactgcactccagcctggacgacagagcaagactctgcctaaaaaaaaaaaaacaaaaaacaaaacaaaacaaaacaaaacaaaatgcaatcctgttggggccaagctagagatataatttatcaaattacttgacatagcaccctgaaatcattgcatctaaaagagaatatcctaaacagaattttgagcagatactatttttgatggtctttgtcatatttttcatgtctctcaaatagcattccaaaccactttgggtaaagaacataaaatctagagaaaattatctgattactctcaaatgtcttcatgttacagggatataattaaagttttgaatcttgtccaacactgtgctcaaaaataaaccaatttaagtctacatttatcagtcaggcttaaaatgaaaaaaagtttcactcatttcaattattcaccggttaataaactatgcttaatttgtagaatgtttttttttttgcttccaaaatttattccaggaacacagccatatcttctcctgctgactgataaacactatatatattagatcacacatagagaagcctgtttaagggtcaagatgtaggtgatttaatgaaaaaaccaccatcaactcaaggttgctgtttctgtgagtaattgatctgttcaaaaaacaaagcgtttcatttccagaactttcattacaggtgtgactatgatttttgtttcatttaaacattattatataatgatgcatttcaaatgcaatagcatttacaaaaaagaaaataaattatcaaaacaaaaacagaaagaagagccagtagctgggaagaagatcacagacgtttagcacaaaataattaactaagaagtcaattctgcttatccagcaagtacttacagctcaacattttgctacttcagtcccattcaattttagcttgtgacaaaacctacacttttacttcagttttgtgacttactctgtttcattattttatttattcaacaaacacttatggagataaggctcgttgtattatgcaatataagcatcaaacaaagtacgttcttgttctgatacttattttgcaacacttcatgaaattgcaaaaagtaaatattatataaattagaatttacaacacagactggtctatgacaaagtaagtaaaaatagtctcaatccatgagacttgaaattgagctgaaattccttcaggagtccatatggattaattcagatttttatacaacagataagaaaaatttattcttgacagcacagacagcagtcaggtgccccaagctgggttatggcctggtcaaatattgctaacatatttttaaagctcttgctttgttacagaaactccgtttttcctcacgaaacagtgcgtataccgcaactcttcaaattgtacctcagtatggtgtaaggaatgtggtgttccttagaagctgtggcaaatccctaaatttcttacctgtaaaatgggtatacatggaaggcaggtcttctgtgaagctcacacagcataaactttcgggcatcttctctaggcctccatcccaggccttggcaggagccttggcgatacattcacctggtcatatgtttatgtacaatttgcaaaagcaatatattgtcaccacaattagctgagactgaggtctctttccactaggactttccctctgccattttcccttctattgggtggtgctagggcagcctggacatgctgtgggatagggtcaggctttgtgttcctacccaaacctcatcttgaattgtaatcctcacttgttagggagagaaatgacttgattatggggacagttttcccgtgttgttctcgtgatagtaactgaattctcacgcgatctgacggttttgtgtttggcaagttcctccgctcacaattctttccgcttccttgtgaagaaggtacttgcttctccttccaccacgattgttaagtttcctgaggtctccccagccatgtggaactgtgagtcaattaaacctctttcctttataaattacccagtctcgcgcagttctttatagcagtgtgagaacggactaatacacagtatttgctttttctttaagaggaccacccaaattgcataaattgcaggccccacaaaacctgcattaccccctaagtgtgagaatagtacctatttcacaggtgtgctgtgaggattaagaggtaatggacacatggtgtgtatcaggtggatgttagccattatcactactctgaatctccatctttctattatagcaaggccacagaaatgagcattttatgtaatattcttaaaactaaattcttctcatggaatgggatttttcaaccccaggcaacagggccacatcatgtttttcttgggctctaggcctttttgccttcgttgagccccttactccattaaaatatatatacatatacacacacacatatatacatacattttaagattgtattagcacaaaaacaaatatattaatatatattaaaatactttcttaaacctaaattttttttccttctgatttgaaaagaaattaaaatattttttgtgggcctctaaaaatattgtggaccttaggcactgtgcctaatggaaaagacagtgacaggattgtgcaatatgaataatgataaatttcccaaaccatcaaggactcaagaataagggtaaacatcttaaatggggttggtttcgagtacttataatagaaaaatgttatccaaacaaggtcttaggggtaacaggaggcgtttttagtgttcaaaatacgcacatggatggagttggccattaggacgctaatagcgaccgtatctagctgtgaaatacatatttttgttttgggagtctacttttcagtaaatgtcctttcaggtgttttgttgcccatttaattacatgatcaacaaggaagagttattttacaaaacaagcttcattttgccaatttataaattgctttggagtttcatcgaaaggtctttaaaaaacacgttggccttggtgctggtgcatcacataaatcacagatgaaacaaacaagcctgtttcctactcaaggtgtgtctgtagagtcctgactgcgtgccaggggctctgtctggcacatttctgaactttgcaaaattaattgtgccgaagagaacaccatcaaacgcgtccggcatacagcgtaaacatcttcagaccgtgattctgcgccatcaaacgctctccagctaatttcatttggtgattactctgctagaaaaccgaggccaagtgaaactgcggaaatgggaacaatgtacggaggaaaaatctcaccccattaagagatccgtttcttctccgcacaaataagcccaccccgcctccgaggcaagactagatggctccaggatactctcggcgcgcccgctggccatctcgggcaggggagccccacacccggcaggaggaccaggacgcgagcggcggcgcctcggccctgggctgtttaggtaattcgcaaagtcccaacaatcatccccctctcccagaagctggttttcttgtgtgcagtggttacagaggcggcgaaaacacggttccccgctttcctctcctcaaggcactgtttgcagcggcagcagcggccgcattcggggaggcgcggtcctccccgcagagccgtcgcgcactcggcctttctcgaggatttgcctgggctcggccgcctcgctctcccctgcgcttccatgaccttctgagagcggcctcaccaccggaggctcggaggaagcaccaccctcggcgtccggggcccgtcgcgcggccgcgttcctccgactccttggagcacccgcgcgcgcgggcgcgcggccggggatcggcgggggcgcgcgggttggggcggggccggggccgggggcaggggcgggtcaggggcggggccgggcccgctgcgcccccagccgagcggcgtgcaggcgccgcccccgcgcgccgcagtcccggctggagcgactcggccgtggcggtggccgttaccgttgcctctgggaggctctggcggcggcggcggcccgcggggttcgcggagcgcagcgggccgcccttcgcccgtggccgcctcaagcagcctcgcgccgacacaggggaggcgagacggcggctgcggaggcggcggcgcattgtgcccggccccctccttggcggctcctgcccccgggcggctgtgggatctgggcagccccggggcggcggccgaggctacagagccggcggcaggggatggcaagatagcggcgcgggagcgtaccgtgagtcctgggggcgggtgggcgcggcgcggagcaggggagccgcggagccccgagcggggtccccaggggcggcccgggcggggtggggcagcgctcccagctctgcggagcgtcctaggggagtgaccccggagagcgccgctccgggtcccgccgctctccgcgcgcccttgggtcaccctcgtgtcctgggggacgcggactccagcgcccagaacttctgccccacgcagggcagtgagttctgaggccagaggttacctgggggatgggagggagcttgaaatgtttttccttcggagaggtgacctgccaggtgatttcgtgcccctctgcttcaactcccctttaaacctgttcctcgtcctttctgtatccgtagtgcatttgacttacctgtatttttatgtgctaacttccgaaggtggtgtactggttaaacccaaagttaaagtgttggaggtcaaagttaggctttgtgaaagatgccatttctgttatgttgtgtaaaagcacaaagctggattcaggagttctgagcgacacaaaactgcacatcacgtgttctgaatttacatgattaatctgaattaatgtgatttttgccccccaccccccacattccgctaccaaaaatatatgaggtcttttatttgcagttgggtatctttgtgttcctttttgaatgtttaatgcagtcaaatattgttataacctgtattgttattgagtggcatttatatggaaatcggttctttgcatttctttttatgtgtctttaaaagatacattctttcaacagaaaagtttcagtttaaagtttgtcttccgattcctgttcagtttcagattagtttttaattttaaaaagtatttgcttgaagtaagattaatgtgatatagtagtatcgtttaggcaggggtccagaaatggtacagaaattaaatttaaggcaaacctttccttttcacaagtggaaaaaccaaggagttttttcagcgcgaatgctacttgcccttccccttacatgattattttgtcacagatctgaaattacatttcactgttaccagagagtttcttgtctaagcctggcagagaaaaggaagcctaagtataatgtgttttttaaaaacacgagaccattcttttagttgtcttctacgttgactttatgctttatagtcgggggcaactgttcatttggaaacttcattagggagttagttgcaagctcaatttaaatatatgatgtgttcccaaggtgatcggagcagctatttcctcttcaagaattgaattgagacttctttgctttgtaataggtgagtgagatcactagcaagcctcttgattagtggagacttgtattctcttctggggaatgagaatcagggactctgctgttgaaggagcaaaacttttgtgatttttgaaaaatttgcttctgaatggtcatccttgacaaatatgttggtaatagtgtgcatttttcttacattaattgtgcagcaggtaatctattcacactggagaagattcaatagatataaaagatacggagtatacctctctcccatcatgttccacagctactggctccttgtgtatgtctttccagacatagcctatgctcatgtaaacattctgtacgtgttctttttgtttgtattcctaaagatgaggacccattgtatactctgcaccagctccccctgccccgcttccctccccagagtactaaatcatggcagtctccattggtatctaagagaatctgcctcattctctaacagctgctgagtactccattagggatggaccataatttatttaatctcttcattgtgatatatgtaggttgtttctaataatttgctatgaaattgtaaagcattagtttttgaggtttttaagtggatttggttattcccaaaggcctaaaggcagtagtcatttgtttctttatatcaccttccaggaaataagtgtgccttctccccagcatacactgtttgcttctatataacttcacagtaatccataagagtctttggcatctttgctgtgaagtgggagccatgatggtcagtaactaaagtcattattccttgggtaacaacttggctctttgttttaacaaaagaaaagaaggaacagatacacattttaaagaataatctgaggaaaaattcttaagtgtttaaatatttttgaacgtagagaggcagcttgtacctttgattaaattgaagatgagggtagtttatgtttcataaaattcggttgccattaggcactcaaatccctgccttctgtagattatcaccagtatcttatattttaatgttagtataatatggttacagattttacagtttatgatggggttaataacttttaaggggatggatgcttttaaaacatacttagctcttgcttttctttaaaacaaaaaaattggggtctcgtcagcatgctcttgaaaaagaataaattgtaaaagtaatgctaatgctagaaattgagcctaatacattataaagcttgaacattagccaatgttgagcttcagtattttcattatgcttatttttgagggcttttaggactagtgtaagctatcataatcttttaaaatatatacatacatataatatatatatatatatatatatatatatatatatatagtttaaatggtccaaactcctcttagaatttaaggcattctcttgccttttatttggtactgttgtgatacaaaactgctaacgttgtctgtattttttctgaaataggtgtttattgggcatctgttaatattccagacaactttctagggactaaattatggcactgcacaggacagacagaccctgctataatctcagcgaaggagatggataagaagcaaagatacaataagtgatggtgactagatagtgctaagtgctgtgaaagaaagcaatcagggttgcatggcagaatgggacaggatgtgggctgctgttttacatcaagtggcctgagaagcctctctggggtggaggggtctgagctgagagttgaatgagggggaagaagcctatgattttggagatctgaaagaagagtggcttaggcagagggaagggcaagtgcaaaggccctggagcaggactgagccttgcatacctgagggacagaggaccacctctgtggctggagttggtgaaaggaaaggagagagctgcaggcagaagaagagtgggctggggttggtgcccatatgtgttgcatgtcaagaaatgtttacagacgtgggaaagatgtgagtggtggagttcctctataggctggaagctccagggggctagcaacacatctgcttgttacccattgcatttgcagcaccaggaaccaccttcatcacatagtgggctatgaatagttattgagtaaatgaataattagagaatttacgaaataatcttacctgcttttggtcaaaatacttagattcgggagtcttttagttttccagcttggctctggcctttgacatcagccaatcggttatactgttatcacttttctttcaaattatcacttttgtcaaactgttgctttaagtcaattacacttgactgctcttccatgaaattcaagtgtaaaaccttaaaaacaaaccttttcagtaaattatagtgatttatgagagattttcagaaaggtgagcatttttatcttttatttccgtggaatagccatttgtataagtgtaagagttcaaagatgccttttgtgtgtgggtgtgtgtattgaatgttttaattctttgggccagatgacagactaatgagtagataaaatatatgtaggtacttttattctcacaggaggaatgtgtgcctgccctatagggaatatcaataatttgtggcatttccttttcccaacttctaatctgtcattctaaatattaattgaaaacttgggaaatgagttttatgccaagcaattgttatagatgtctaataagaatctacatctttctcctgtgacttttggactcctgttccatattagaagtgttgtgatcttccagaatgatggtttttaacttttttatttcctatcttaatcaattaataacttagcataataagcagtttctacttaagacaattttatttccaactgtttctcttaagttctgtgcaaattatatgtaaaggagggttctttaggtcctcagtcttcagtaaagaagcctgtgtccttttgtcctgatatagtaaaagctcttcagtaaaagagtagaaacacctaccagttggggtaaatttagaggcttagatgcccgagttaaagtacttttaccaattcctttacctttccttttgtgaaatatgggaattgcaaatttgtcttacgttgtctaaaatgacaacacatgcattcttataggatgttgctgctggtactgctcaggtgagcaaagatatgtgtttgggagatactattctatgctttcatgttggaagttgaggaaaaacttctggtaggtggattttttctatacttttgcacagaggtgaaaatcttggcttccaatcattcttctggtttgtaaggcagatacagagaaagaattggaatcattgtttatatgctatattactaagcggcagtatccttagaggccacaaggcggtgatatcactacctaaagtgtatgtgtggtgctcttccagagaatgccttggaatactgaggcctcttgcaataccttcttttaacttctccccaaagtgggcttctccaaagacaccttgaatccgaggactgttgaattgtggaacatctggtggaaaatagcaagaggtgacagaaatgctaatggggcagtgagatgtagacttcaggcagaattgttgtacctgtcgagttggaggtaaggtgagtgggagagagatgagaatcgccaccaggactttaggctgcagcccctgaggacacccgagtgccacagtaagcactaaggcgcctgctgcatggggacaggatgccaactgtttccatgcaacgggcctggagacccatagccctgccatgcttcatgccttagtgtttataatgcagtacaaaggtgaaggaggcaagaccattgcaaaaacatctccatagaaacagttaaagttaggagcatacattttcttcttgctggaacttcatcatgactacatttattccttgaagttgcctggatcaccacaattttactgtaaatgtaaaattgttcttttgggagagtctgattttgtggaaaaactatttagagcttaaaatgcatagctcttatgaataatagaaaattaagcacttaaacaaaaatcaagtaaagtagataacttgattgaaagctggaaggcccttcagatccatctggtcagcttcttaagataaagaaacttagacccagaggtggtgttataatttgccgaagaatccaggagtcctgattggcagtgtaaccatgatcttcggactctttaagtgcagggttctcaactcctctctagaaccaacagctcctcaagggcaggaacttttgcgagatttaccaccgtgtccctagcattagaacagtgcctagtctatagtagacgttcacatatttgttgaataagtgattatctaaaggaattttaagaacttcagattgccatgttagctataagacagtacttatacaatctgaaagaatatacagttttatgagtttcttgttagaaaaatagagcatgttgctattaaaacccaaactcttaagccagacaggcaaacgaaggtgcagtgttttacatcttagcttggtacctttcaaagtctgttatcactggattttctaaagccattctgttaagttcagcctactggtatctggtatcattaagttttatattttgtatttgaaaacagatgctttaaaatctagcatttattgtttgaatttttccctgtttttttttcagttgtgctttatcaatagctcagctattttaaaaatttatggccatatggggatatgattgtttaaaaccaaatctaatcaactggaggattttggaaattgtcactttcaaatgctgttggtgggtgtttcaattgttataactttacaggagggcaattttgtattactcatcagaagcctcaaaaatgtgccccgtcccttagtcaggcatgttcaccgctagcaatgtaaacaaaggagaaacgataaagtatgtgtacagtgaccagtctttagcagtggttatagtgcatttgtgcaccatactcctgtcgatacctttctcctcgcagtgattcttaagaagcctacttactgggatgtaccaaaatctggagggaggtcctctgaaatttggaaaaaactcacttccagattctagtgaccaccacaaaaaaaatacatttaaaaaaaccctcctctaatttgcaaaaataatttttgtaagtttttttttgtgtgtggaaacggagtctcgctgtgttgccctggctggcgtgcagtggcgcagtctcagctcactgcaagctccgcctcctgggttcacaccattctcctgcctcagcctcccaagtagctgggattatgggcacccgctaccacgcccggctaattttttgtatttttagtagagatgcgtttcaccgtgttagccaggatggtctcgatctcctgacctcgtgatccgcctgcctcggcctcccaaagtgctgggattacaggcgttagccactgtaaccagcctgtaagtttgtttataatagttataaactagaaacaccttaaatgctcaataatagggggactcattaaatgaattgtggtgcatacatgtgatagaataccctttctttaacagtgatgtaggggaatatttatagatgtggaaagatactcaatatttgtaaactgaaaaagcagattgtaaaacatatgggtacgttgatccttgtttttgcttatggagtgtgtgtgtgtgtgtgtgtgtgtgtgtgtgtgtgtgtgtacaattttctacatattatgtagtaaaatgccaggaagactataggccgaatgttaggtgatactgtctttcatgtgtggaaattacaattgactgttattctttttactttcctggatttcccacacataaagcatgccgtgtggtgaagagtcttggatcagatcccatttcccatttgctactactggttgtgtgaacttgggcaagttttgtatttccttatctgtgaaatggggataataatatccagctcacggtgcccacatgtagtatttaataaacgttaccttgatctcactgatctgatatggtgattaaagccagtattctattcttaatacagaatttccaagcagaataattgtgttatgtaagttttatcaaactgttacggaaagcatttcagggcattctgacaaactattttgttgcttctggtcactgggaaatactttgtcgagttttatttactttaaaactgaaatgccttccattgccaatacattttattttgaattgaaggcatttttcttctttttctgttgttgtcttgaatagtcctgtataaatttttgaaggtcagggtctgatctttctttccttttatagaggtgttagagtgggatgtgagtcattcaagtcactgttgagtgccttttctttaacaggcactaggtaggcatcagatttgcagcagtgtcctggacccacatgtctctgccctgtgaatgacatatggaagtgaccaatgtggttcaaagccaggaggcccactcaataaatagatagttactgcagttaagtatcaagtagttctcattttctctcctctgattttaaaaggaattttgttgtgatgttacatcttactgaacacaaacattgcctcctgcttattcaacaaactactgtatatgaggaacatactaggttatttcacttcgttgacattcatgaatgatttagtgatgacttacattacacaagtgtgagaatatcctaggttaataggcttaaaattgctactatatatcttctgtgaaggataatctttcattatcttaagtatgacctcatgcctttttgagattatcttttgtaaaattattgaaaatgagctcctcctagcaaatctaggatgcatggaatttatggctatcccacttgagaaattctagcacatgatcttactgagagagagtggcaataaagcatttatagtcgtgtaccatagaaagatgtttaggtcagtaacagaccatatatatgatggtggtctcattagattatgatactatatttttactgtaccttttttatgtttagatacccaaatacttccgttctgttacagttgccttcagtattcagtacagtaacggtgcacagatttatagccttaggagcaataggctattataccatatagcctaggtgtctagtagactataccatgtaggtttgtgtaagtacactctatgatgttcacacaacaacaaaattgcctagcacgtctctcagaactgtatccttgtcattaagcacacgtgactatatttaaaaataatgtttccatttgacagtgtgtaaaactacattagttttgtaattagttttatgtagggactttttttttaaagttggcaactgttctaaatattttgataacatgtagaccctcagtagtcgtgaaagatacgtcttggaatctatgacaaatactgagcttgcattttattttcctcatacggccaaataaaaaaaagaaaatttcttgagtcatgttttcatgttcctgtgtagaattcatggtaggataagttacatcacaggttgtgtaaccaacagcaaagtcaccattttacttctttttttgctttaataaattagccatattttgagagggtgtaagttaggggaagaacaaatttaggagagttatgaatcaagaatcatttttggacacagtttaagatacgtgtgagacttgcaggtgacaagttgtgcatatagatatgtattctatctatctcgtcacactggaggtgacaagacttgcaggtgacaaattgtacatatagatacatattacttctatctcacattgttctaccccataccattgccttacatggactttactccccttgcccccactggaactggcagttagctttcttttgggggtgttggggatttacttttcacaaagaaacactgtatgagctgcactgagtatgtaatggtgactggagagcaaccaagctgtgttgacatgtagacattgggtcgctggctagacttaggactttgccaactcaccctttcctgaaggccagcttcaataaaattacagatgactgttttgaaactttttcagctcacaaatagtcaaagctgtgagtgctgaactcagtacattccacaggctgcattgctgggatcaaaaactcaaatgcttacagggacagtggacgttacataaatggcagaagtgggcctgtcctgccttttgtctttatgcttttgatatagagacaatcagaaatatatcactttctctttaactctactgcaagatagacaacattgacaatctagatggtaaatggcaactggaacttgtctcagttttgaagaccagtaaggaaaggtgagaactatgaaaaactccagaacacatgttcttaggaaggagtaactgctcttacctggagttgattgttatcctgtgagatgtggaatgagtatttccagagcttcttaattttgatttttaaacactccattttgcaatattgacaaataattcaagggtttttaaattttgttttttttatgtatatggttcaaacaaaacacatctaaaggcaaagcctgccagttttaaactatggtaggtaacatttctttgcccatcttttccttcacttttttcatatagttcaggtcatactggatattcagttttgttccttatcttttcatgtaatggcgtatatatgtttcttcatgttgctaaaaattctttagtatgtattgatgactgtgtaacattttattctctggatgaaccataacttgagcatttacattgttttaaatttttccagttcgtaattaaagttacagtaaatatatttaagcataaagctggatttttccccttctccaataaatttcacattcttcccttaaaattggtttattgagtcaaaacaactaaatatctttaagacttttgatacagttgaattttctccacatttatttgaatactaggaaataaaatatttgttcattttattagctggttttattttgtgatttatccattatttgattttacattggattttttcttttttttttttttttctttttttttgagatggagtctcgctctgtcacccaggctagagtgcagtggcgtgatctcggctcactgcaaggtccacctcccgggttcacgccattctcctgcctcagcctcccacatagctgggactacaggcgcccgccaccatgccccgcgaattttttgaatttttagtagacacagggtttcactgtgttagccaggatggtcttgatttcctgacctcgtgatccgcccacctcggcctcccaaagtgctgggattacaggcgtgagccaccgtgccctgccctggattgttatttttttaaacataagtagctttttaaaaattataaaagtaaaaatgctcattttataaaaattaaggaagctcagggaatataagtaaaaatacaaaaaaaaattttagtttcaccattcagagataaccccaggcaacattgttacatatccttctagattaatttctgtgcatatatatatgtgtatacacacacacacatacacacacacacacatatatttatgtctacatctccaaatatgttaaaccgtatgtacattctgtcttgtaacatgatttaattttttttttttttgagacggagtcttggtctgtcacccaggctggagtgcaatggcgtgatcttggctcactgcaagctccgcctcccgggttcaagtgagtctcctgtctcagcctcctgagtagctgagactacaggcgtccgccaccacgcccggctaatttgtgtgtttttagtagagatgggatttcaccatattggccaggctggccttgaactcctgacctcaggtgatccacaggcttcagcctcccaaagtgctgggattataggcatgagccactgtgcctggccatgatttaagttttttaacttatattaataatcttccatggtgcataactgcacactagattcagtttattcatccattattcagtttacttaacaaatatttactgcacactttttgtgtgccaggcagtttttctagctcttgggggctatagcgctgaagaggagtgctgaacaggagcctgctctctgtctcttcctccccacctatgctgaactctcaggtcatgctggatattcagtactggatactcatagagctcagcatctaggtggggagggagggacaataagtcaggaattatgtatgcatagatacctctaggtattgatgtgtacgctgaaggatataaaataggataccacaaggaagagtgagcagtgtgtggttgtggtgcgggatttgggggagggaggcaagcagggaattgtccccctttctaggtgatgagtagaggccttcctgaggaagtgagtgttaatttgaatgatgagaagagtcaggggaaggtgattccccatgataggaatgacaagtgccagggcccttggtggatcaagcttggtgcatgtgaggaatggaagaaggccctggaggagactggaagccggtgaccaaaggagagacgtgtatgtgaagagtgtggaaggggatgcaggacagagagtggggtgtgcttataaggagaatccactagacggttttaaactggggagtgacatgatctgatggctgtttttgaaaggttctgctttgtgcggagtggattggtggggagcaagactggaaacaagaggaccacttcagaggctcttatagcagttcaggcaaaagaggttggtgcgcttaatttgggggtggcaatgaggatgatgggtgttttttcccttcggcatgcatttgaaggtgtagcagctggtagtacatggggagtgggtagaggccgatagggaaggaaaggaatgactcaagggtgactgctaggtttttttgcttgaataaattagctatattttgagagggtgtaggttaggggaagaacaaatttaggagggttatgaatcaatcagttttggacatagttcaagacacctatgagacttccaggtgacaagttgtacgtatatctggagaaaagtcaggtagaaagtggcatataaatctgggaggaaggaagggtaagataaatttttaaattaccacatatagattttaattaacatgattgagaaattattaagagtacagaaagagagaagtgggctggaatgcatgcagagatgtcatcttctttactcaatcccaaattgatgaacattcaggttatttcatttaaattataagtgcatttagtgaacacacctttgaaatcttgtctgatatctcctgaggagaatttcctagaagtagatcataagttgcatgtgaagtgcttgaatggagcctaccacatagtgagctcttgataaatatttgtagccttggtttatcttcatcattcttactgttattgagtgaaaggctttcaattggaaagacaacataatggctcacaattcagactctagagtcataattgcaagtctaggttcaaattctggctttgctccttacgagccacaatactttggataagtcacttaatctatttcctcatgcatgccatgtgaaaaataccaaacctctttggagggttgagagagtacaggttaagtgcttgggcctccctggagcatgtggcctgtggctttacacaactacaggttgggttccaatttctccacattgtccagggtagtatctagtatcattcttattaaccttttccaatcagtagaaatatggtttcacgtcattttcatgtttattgcctatttatatttcttagtatgtgagttgcatatttttatttctattgaaggtattcatcttgctttagcatcttttttagccatttgtatatcctaagtatagtgacacttgtcatatttgttgcacatattttttcccagggaaaaaatcttcattgtgctcagtttggtgagaaagatggttttataaatcattgctatataatattatatgtagtaatgtaagcatatgcattacgacctgagaacactggggaaggttggatttggaacagtgtgcactgaaatttgaaggacgagttgatatttgttaaagggacaaggaagagtggagtgggaaggacattccaggtagatgatctgtctgtgcgggaacactgaggcaccacagagcctgacatgtttacacatttggtggaacttaagcacggggccactgtgaggaggtgcacagagatggcactggggacttaggctggcatgaaaaagctagagcctcatgccctgttcaacttgggacctttccctgtaggccagggagagccatggaggattctaggcatacaaaactgaatttgtgctatgggaggatcagaagtcctgagaccggttagaagcattgcatttgtgcaggctgagggaaagaggccccaactaggcccgactctggaggtttgtccttatttacctggtaaagttgagggagtggcacaagtggtagtcataactagaggcatcatgctgcctctaccgtcttctatcatgtcctttttataaagcttctgattaaacttacataataaaaaaggatgtgttatttaaagctctcaaacacagatttattgatgccttaccctcaagttgctaaacgttcaagtgtccccacatgtgggtacttcttctatgaaataggtagtagctggcacttacggtgagatgggatttactagagtaagatttacattgagcaagaatttatgatgacttgggcagtaataaaaccaacaatcataatttatgtttcatgttaatactttgatattagattatctacttatttttcaaactaaaatgaatcctccaattttaataccactggaggacacgattttagacattatgtgtctgataaagtgagaagacaaaaaagtagtccttcttaatatttttatggccatcttacaatattggcccagcttattaacctttttttgtggttttcccgtgtgttgctgctaaatcatatctcctcccatctgtatttgttcattttctgtgtgttattgttatcaacattatcatttcattttggaccctgacatccatgctgaatttattttattggatttatttattagaatcctattattacaccctgtatatttgctattttgcccatttttttccatccacagataagttggatatgattcctatatcttcatgcaactcattaatgaagataccaagaaaaacagaagtttttgatatctgtctatatcacttttgtccaggttgacatcatcctatgaattagcactctgagtaaggttgatcatgtgataaaagcagcctcttcactctgtttacacagcttgaatttctttaccttgctaatactcatctttcatgtattagaaaagattttgttcaaacagagatacattttgttgtttctgatccttgcttttcccagtacaacagcttatcaagtcgaggctaaggatgggctgacgtgcatgggtctgaggttttctaggattcctttcttagtactgttgatcatcttatccaggatcagttatcaagctcacaggcctctgtgtctgtaggattttatttcttaacaagaatgcccctttctgaaatagctttgccaaatatcagttattttaggtgctgttatgtttttcatatgctgttccactcttacatagaagatgtttcacctgcttagatgttgtagaccgtggtctgaagccagagctaaaggctttattttagttgttgttttgagaagcataatctaagatgatgcttaagattttgatatctggggttaaataatgtcataaagaaaaaaattttgaattattttggagtggaaagcttcagattctgaccctaaagaatgttaagaaagcattcaggcacattttggtcaacatctgtgcattgaaatctaggtcttaaaacagtttatattttaagattatttcagcagcaagacaagaattttttaatgccagtacattttgtgacaggttaactggctccctaagaactatatttggcttgcaaatgtattttgtttggcccacatagtgttttttttttaattggaattaattgccagcatttaaaaataaggatatttcataataataataataaaaaaaactaaaaaagcaacaacctggatttcctgcccttttggaaaaactggaagatctgtggctgtactggccgctcgtcctctgtggtgtaatacagacacaaggagctggcgaggggctgcccgccagcctgtgtcatgtgaatggctccagtcatttcatctggctggctcttggagtatgtttgagtttgcacctgctgagttgagagcttaaccaattaaaagtgtacttagagttggaaggagaacagtaagatggcagttattttccatttgttctctgaacatagactgtctgatctttgttataatgtgattagtggaagtgcttggtagagcaggtggtgtttcccccagcaacagtattcaccggacaggtcgggggagagctgaatttctaatcacattgtacatctaccagtttgttcctgcaggtgacaaacaaggttttctgaaaacaaaacaaccgtaagtttcttatgatacttaaagtagggaaagcaggtgctgggtcttagttgtgtaatttgagagctaagacctgagatgttaggtgatttatctgcgagcccctacctgtcacctattcagtggtagaatagggactggagtccaggactcctgactccagcttagttgctcattttacagtttagtataatggcctggagctgagatttgcagtcagagttggctacagatcccactttgctccttactagctgtatgacctttctgtgcctcagttttcttattataaaaagagggaaataatatgaataataccgaccttataggattgatatgaaaattaaatccaatttttcattgaaagaacttagaaaagtggctgctccttaataaacagtatttaaataatgcataatatctgaaatatatgtataaattatattttacatggtagagttagctaaaaccagcttgttacctagatagaattattgtgtaattagtatttttccccctcctagaatttagaaaggcctttagggatagttttactctatgtattaccccccccaaaaaaccaaaaaaacttcaatttgagccagtattctttttattaatgaatttttgtatagcaaacaggttcattgaaaagcataaagtttgtcagcttactcttcagaatgtagacaaataactgaatggtatgaaaatattttaagtcctcaccgaggactctatttgaatggatttgcttcagtcaccaaataaatcttgtacgtgtggtggatataaagcactcctagactatggattttacaaagataaggctctgatcttagcttatagtggaaaagagggtggaaggaagggagagaatgatttccataatacctggtatgataagaacaatgcctaaaggggaaattgatgtccagtgggagcataaacagagcactgtgtctggttggacatagtggtcagcatgagaaccaagaggaaggccgggcgcggtggctcacacctgtaatcccagcactttgggaggccgaggcaggcggatcactaggtcaggagatcgagaccacggtgaaaccccgtctctcctaaaaaatacaaaaaattagccaggcacagtggcaggcgcctgtagtcccagctactcgggaggctgaggcaggagaatggcgtgaacacgggaggcagagcttgcagtgagccgagatcgcgccactgcactccagcctgggtgacagagcgagactccgtctcaaaaaaaaaagagagaaccaagaggaagagatgcccctaggaaaggagtagaggaggtggaagaagattgcggaatagacgtgtgaattttagtgtggacggttgtctgagctgttggtgggccagccttctgatatttggcctggagcttcaaagaatgatagggttagtgatatagatgctatttaaagctttgcaactcactatggaagatggattgtgtgaggcccttgccagagggttgtaaattacgtatgccagagagtgaggagggcctcagcctccagagcagtagaaatggactggagggagaggatggggaaagagtcaaggcatgttttaggtaaaagtggcaagtcaggtgggaggtgtgaggaagaaggaagagtcagggttactcagaagacactggtgccatgggctaagacggggctacaagagagcaggtttggaggggaaagtgagcttaattcagtacatctggagtttttgaggaatctgaaatatccaagtggatatgaagcatcagaatattttgtcatgcctgaaggaaccttacttgagtggatttgtctaagtaagcaagaaattgtctagtgaatggttaatctgtaactgggaagaggccaatcctgggaacacggatttggaagtaattagcatacaagtgatgttatagccacaagcacagataatactgttcagtcaggaagtgaaggatagaaggagcagtaggctaaggagtcccaccaaggaagctaagtaggaatagaatctgaatggcatctcaagtcagtgagagaaggaatggattacctaataagtggtgttgggataagtggtaaccacttagagggaaacagaaaaggtgggtccttgactcaactgtacactgaaattaattttatatggcatgaagcttaaaatgtgaaacaccttaaatgtacttgaaggcaacatcaggacaatttgcatagtcccggcatgagaaaaacctttatggttagaaaccacaaaggacaaaatagagaaatctgatctagtaagagttaaacaaaagactcactggaaagtaaaagcgattggggaatctatttgctatgtatgtaacagagttaatatgcatattaagattttttttcttagcaatcattaaggaaatgattaatgcccaattagaaaaaggagcaaaagagaataaacagcttataaataaagcattgcaaattatcaataaacatatgaaaggatattttaattacgcaataaaaagaaatgccatttatggcccaacagaataattttttttttttaaagacaatccttggtattagtgagaagtactgggaaatggagatgttcctgtttctttttagagataagttttcgtcatgttttcctgcatgttaaagatttattggaggaatgttcttcaggttgtttaataatagagcacttcatcgttaaaagggaagaaacaagttcattcgtttggtagacttttatatttattgaagactgttacataccagtcactcttatagcgtagttgaagtgggatatgagtagtcagatgttactctaaagtatgatagcgtgagtcccgaaagatggaagaatgggaaatataggagacattgcagggggcactccattggaggcagtggttttgggagaggccttgagaccaaagggaatgtggagtgtttggggagctgctgcggtatggagaggaaggggttcatggccgtctcgaagggctgtgcccacagtatggaactggaactgtgtgttgaaacagtggagagcctttggaggattttaagcatggaagtgatgtattcaaacttgttttgacatgctgaggttcataatggactggctcttgaattaacagggaagtccacactgcaatggagattactaaaactgacatggaggatcctgaaaaagaaaaactttggaagacagtctatttttaaaagttcccaggaaatgcaaaggaattaagaaaaaaaaattgacaagattattctatttgaataatagaccaaaaagttattttggggaatgaatatcctgcattatgcacagtgatagatttgtctttataatgtagcaaatgttaaatttcaatattattttcctacatgcagaacgcatattgaagtatgatacagtggaatccctaagcagccaagctatcctctaactcaggtccccagactgtcatagttcacagtgcccgtcgtgttttgttaatgttttttatgatgcttgtagtcaaaagaattacctaacagttctctttatgaaatagctgggtccaaacaatttaatgagtatttatgatcaagcactttagtagcagtttgaagaaataacgtgtatccacttaaaaggaaaaatataattgtccctctatctctgtgggggcacgttccaagaccttcacagatgtgaaaatctttggatgccaagtccctaatataaaatggtgtggtatttgtatataacctgtgcttatcctctcatatgatttaaatcatctctagattactttaaatcatccctaatacagtgttaatgctatgtaagcagttgttaaacggtacttttttttttactgtttttttattgttgtactgttgtcttttattggttttgttttctgaatattttcaatccaaggttggttgaatctgtggttgcagaaccctgggatatgaagggtctatggtagtatttttatttcattcttaaaaagccttaattactgatgagatgtgtgaagctattgagtactgcatagcttcccaaatcttggaaaccagcaccctcatttccatttctacattgatttgtttgggtagtacttgtgttttatcccagcaattactagtccctccctctcttcaccaaagataaagatacgatgtcacacaaaaaaatgtagcatgagcaaatattgaaactgtggactaccttgaactaacggttttcagagtgttggacagatgtcactttatttccttcaaaaacttagatattctgtgatagctctgtcagtttgctttggtgtcttggggtgcctcagtgcagtttgggagccagagctttaacttgggttcctagtgttggcagtacctgggttagcatgcagcctaacaatgaaagtatactgtgtgggcatataataatttgtgccttggtattcattcagccagctggcttagagtttttggtgtctgctttgtgccaggtactgcttggacactgagggttacagtgaactcggatgtgtttgctctcaaggatctgacggtctgtagggagaattataagattaggaagtgaagcagtagagcagaagtcagcaaactctttctgtaaagggccaggcagtaaatattttaggctttgtggaccattcaatctctatcctagccactcagctctaacattgtcatgggaaagtagtcataggttatacttaaactagtgggcgtggctgtgttctaggaagatttacaaaatcaagaggcgggtaagatttggcctatggaacatgaattgtgcaaccccatgacataaatataattaaagtgttgtggaagcagcagcagatggcatctaacctgtggactctcagaggcaatgacaaacatacctcctgctaggagcatcactgctgacttgaggagggtgcagatgaaattagcaagaagggaaaaagggtgctggcctaaggagtcctgaagggtctggcagctgtggaatggcagccattttagtgtggcccggacacacagcagaggcagtgtgcaaggcctctttctaggttctgactccagttgtatggattgtatattttctctcttgttcttttttgttttgtacctcattttggtcagtcatgtcctgcagtagcttccagagaatgggtacacggaaggtgatacatcttttgacattttgcatgtctttgtaaaatatatgttatccactcaacagtttgagtatagaattcaagtgtgacaataattttcacttgtattttggaaggtgttctttttagcttttattgctaaaaagtctggtgtgttcctccccttctcaagaatatttatgggtcacacacccagtgtctcatgtacacccgtaacctgctctggaggtggtgctgtcaccatccctgtgttacaatgggggtttgtccacactcacaccgcaagtcacagaggcctgacttgactaatttattctgatgttgttcttattcctgagcccttgtgtatggcctccactccctggaaacttgtaacatctttgatacagatattttgatattctcagtgatgcatcttggtatcagtcttttcagattccttgtgctgggttatgtgggctctttgaggactagatttttgctaggactagacctatatactgataaattttgcatacatctttgttactgcagctatgtcctagttaatctccttgaaacatcactttgttccagcttccctctttctgaaaagctattcatgccttcctgtgcagtctagtcttcccagatagaacttctcagtctggccaagtgtatgtttttcgtaagtatttctttcttttaacttgaagagcccctacacttcacttcaataacacaatggagtctaccaaactgcagagtttatgatcctgaaaagccttcttcactgggagctaatgctggaggaatttaagatcttgtgggagggaaatgggataaggaaaatagttgctggtcaaagtttttaaacaatgttgatgtttcctcctaggaaacagtaaagaaagggacactaggaagaatacaaatgagcagtgcgggtactgtttactgcctgtgtgattgcacttgttttgctcaactcccagcatctccactcctgtggatgggtgacccactcgtaggcttatttacctttacagtagttcagagtcttttctccctcgagtgttccagcttagtatttaatttcttttgagaattaatgacaagggagtcatcttattgtatggcaaaaagatagattcttgagataaaagatgctttgggctgtcttgattcctttcaccctgactgtgcaggtgttgcctgaggcctccttctgcacacaaggctggaggcctcagtgccaccaggctaggttcgtgccagcaggacatgctaactcactctctgtcacgtttcctgatctgtctctacctacctgtccccaccaccgccaccatatttatgtatatagagaggggttgggggacaggggaacagagacaaaataagcaacaaaatgtgttgggactagtttctggtatttagctttacttttctcaactctttttttctaattttcttcggcagaaaagccctaaacctcatgtacactggaaccagaattctcaaggttgagaaaaatacaagtcaaagtacatgtgtgaacactcatcttcacaaacaaggcctttaaaagctcaggggcccgtgttgacaggactgaactttgccatgtggggccccaggctcaagttctgcctgtgctttatgatggtctaagattgaagtcagcatatgtgtaaagaaatagaaccagatatttttctttccattcaacagtcttacagatttattctgcatgattacttttctttagcagaagggtttattgactttttaagtcctttaaaataattagtataggaaacaaactggtcacccttgggcaggaaggatactgcccatgagcatattttgtctggcctttagaatgtgtaaaacatatgcattattttctcacatttacaaactttggtgtttcatttaaaatgccagatttctacctcatctggaaaaatcagcatatttggcaaaatgaggctggtggctgccacttttatgctaggcagaggggctgcagtttgcacctgctgtgaacacgtttgttacttgctttgcccctgcatatttgcatttgcaccctgttgctgcatcctaattttgaaagttagctcctgaaatcgtataaaaatttgtgctcctctaaggaataaggcattgacaggggaaaaaagtgaattctgacaatgtttctatcaggagtgagcagagaaaagcttcacaagcatcactttttttctgaaagtacttcggaaggctctgttcatgtattgttctggcccacagtaagtccatttgaaagttttgcttggtggggaagtctgatgtgttataagcacaatattgtattgcccaaatagacttgcccagaattctctgtgtaaatgtatcacaccagaaagtcttctttattatcctgcttaagttaagcaggcttcagtgacactgccgttgatccttctgtccctgggcatcgccttcctcctgcttactgacctcctcagcagagtctttgatccgtggctgttgctggcataggctttgtgcgagctcgctactgtctgcgtgcctgttccctgccagcaggaatggaatattacagcttcgctttgggaagtctcttatgtggatcctgaatagagagcatgcctctctgctccaatggttgaggctgaagcagggagggattaagtgatttaccctcagccataccactaattagtaatggagccaagattagcatctaaatctggaagcacctggtccagagctctttctcagctgcctccctccgccccttcttgcacttcttcctggcatggctgtagggcctgtgtctctttttagaataatcgaaacttgtagtgagggactgtttcatttcaagataatgtttagccagtcagtgaatatggtttatgattattttagtcagagtttgagttttagggtcatgtttggctccattactcagttattcttgtacagttgtataattctataaattcagcaactggcattttagatattttgtgaatacattttcattctactaagtaaactcaatgaccctggaattgactaggaagttattcattcatccagaaaataatagaacacttttgaaatgtgtgctcacgccttttgcatgttatggttataattaagctatttgggattcatttcctgggtttttgacagtacttgacagtagccgagaagagatcttgccatctgctttcactaagaaaaatattttttcgaattctctcaatgggctccagttatttaggtgttggatctcctttcctttatcaagtcttcatttcttatctcttttcccacattttcaatttttttttgtattttgttctgaaagattactcaatctttttcttattttaattttaatatcagacaatatgtttaacttctaagagctatttttatttcctgttattcctttttcattgcatcctctagttttttatagttatgccatgtttgctcagaggacactatttagagttttttaggttctttttttttcttttaagttttcttgtttcctatatcatccccattttctctggaagtactttttattttccttttggttatcctaaatttctctttaatattttagcctttgcttatatgttttgtgatctttggtgccctgtgccaatgttgtaataaatgaggcaattttaggtctgacacaagagttttcagtgtatcataaggatcttgttggctggtggtgtccctctaggaagaaaggatgaagggtggatgggaatttcattactctgggggatccctaaatgtccaatgtgcaacatctccatactgttaccctagttttttctttttaaattattaaatttgtatgaaatagaaactttccaacaccatgtaaatgggagacaaaactaatataacttgtcataaatgactaaacacaagttaacgtactaataaaatacataaaaatatcaatccaggtatcacttaaaattgtcaaaaattcagtctcatgcactgcttttctacattttagtagagttggagtagagttgatagccatgtgcttataattttgttgtaattttataattatagttatgatctttaacttgaagcccatcatttgaaaattggcctcgtagtagatacctaaagcaacagctgtgtccaattattgatgtctccacaagccagggaagcttgagtttgagtatctccaaagtctctaaatgtacagtgtttcagaatctgtcagaatctatttgagtgtttgtgtgcacagtataaggtgagccttcagaacaatctgaacaccatctggaattcctctcctaacctaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggtaagtgcatcagccttccagagaatgaacagattgcagttttatttccattttgatgacgaagcaattttgttgctttattgacccctttaggattttgttggttaaaattcatttttttgtcatcttttttctatgtacttttagtttcttttaaaaagatccttaatgatagatcaaaatattattttaccatgaaaaattaaaatataatttacatacaataaaatttgcctttttaagattcagttctgtgagttttgacaatgaatgtagttatgtaaccaccagcacaatcaagatagggaacagccccggcactgcaaaagcttcctggctcctctgtagtcagccctcccaggcccatcccctgccagcactgccttgtctccatagacactgttttctgtctctataatgttacctttttagaatgtcatatcaatgaaatccaaatatttttaaatgtattatgttacatcttaaatatattaagaatgtttatgtagatattttatagcttatttatataaagaaattatcatcctcctgcccgttggtttagtttttatattatttccatatttaaatagatctcttttctccaaggtcattcattaaattactttattattatgattagtgctgctttataatgtgagtacttttaatgtaatatttgtttttctgtcatataaatagccgtataatttattgctacagtgaatatcgtaccaaccatgtacaaaaacaaaaacatttttcataaacatttatagaatctgagatggactaccttttttattctatagttgccttttccccttgtttccctcctttcttccctctttccctctctcttataccccccttctttttactcattttcttttcggggtgacttttttcattgcatagtgcttacatattccatggtgtaatgttattttatagatgtgagtaagtactagtaggattgtaatcttctgaattgttactttcaattgtttaggcccacaccaaaaatatatttctcaaatgaactcatgagtttattactgtttaaatttaatatacttcataataacctaaagattagttatgggagttctaccaagggggcagtctggtagcaagcaatgaggtgggggtgactaggagtttcaaagttttgtttaaaaacttggaaggcacatcatttttacttaagacttctttgtttttgttttttgttttttccttaagtggggctattgaagattcaagaggtgctagaatcccctcaagccctctcttggtcccattattgaatctacatgactagccactcactcccttaatttgtcttagttgcttggaagtggaatttttgatagcagcctaaccccaaaatggtctagtagctggcccactttcatcagtttaccctttagttgtttttttttaaccaaagctgcaaaaagaaatagaaaaccagtccactcccatgacttgcaggatcatctctttgaaaaaaaaaaaaacatgggctctctgcagacacacatgcttgtgcttacaactgaaaatggttgactttttagagtgcagttgacttattcagcatattctgtgtttatgtgtgtctgtgtgtgtgtgtgtgtgtgtgtgtgtgtctcctccaggggctcctcatgatttgaagtgtgtaactaacaatttgcaagtgtggaactgttcttggaaagcaccctctggaacaggccgtggtactgattatgaagtttgcattgaaaacaggtaattttaatttactttaattcacaatgagctaggttgaattgcagaaacgaccctcagttcttaccttattgcttgtgaaactaaagggttatttcctgcttgtgttctgtgtccagcagagtctgccgtgacctctgcctcatttttctcctgtagggcaccaagcattatgaggtgtgatggcaaggtgagaagaggggacagagtctgcagtggctttcagtgcagatctggtagataagactgtcactcagatttctgccaccaaataaagccacatggccataccttgcttcagagaggcagggaaggacggtcttagtgtgagtccagaagggggagcctgaaaagtttgctgaagagcacacatgcccaccacaggccaaacagagaggaagttagttctggccccctgctcccctgggaggtcacaataaacaaatagtagcaaggctgtggtttttgtgcaagggagtggacactaggagtatgaatgtctagaaaggctgtcagaggaggtgtaattctggagtaggcacagtcagttttctcagcagaaaaggaataggaggacattctaccctgaaagaatattgagtacaatggcttgaatgtatgagatggcgtgatttggagaattcaggtgtttttgcattgctgatgcctaaagaagcctcaccatgtgagaggtttagaaggagatgagctggacccattcaagtccagagtcctaagcacccagccctaaggctggggctgggtagttggtgggggcaggaatgcaagaggcatggaaagtcctttcagtaaagtaaacatttgtataagaagtttgaaacatatatgaacaacagtataaggaatataagcatgctctggagagatatcaagggctgtggaacaagagaggaaaatatcattttgcctaagagataccaggggaactggaagcattttgaaaacagaactgaagaggaagttctgttaagaagaaaccatgagccaaggcagaggagcaggggagttgccagtttcatttccttcatcagcatccgttgaacatcatcctagcatgaggagcgctgtgatgcactggtccctcagtgaaggggtggagtgtgagtagtggaagtcagcctacaaagggaaggttgaggtgggattttgaaaggcatgcaaaaactccagctgtttggagtcatctatgcttattctacttttggtacaatgaggttgtttttcctacccccacattggtaaagttactatcaatctgttttttcagtcttaaaatgcggtacaacctatcatgtttttgcaacaaagagggcataaagtattttccattgtattttgtgttaaccaaatttttatgaaaattatactattaattttatttgctaattaaaattcaatttcttattacaggtcccgttcttgttatcagttggagaaaaccagtattaaaattccagctctttcacatggtgattatgaaataacaataaattctctacatgattttggaagttctacaagtaaattcacactaaatgaacaaaacgtttgtaagtatttgaaaacaaactcaattttaaagtaagtcaagtgtcacttgttagtattgtggtgctttctagttttttgaatttcatgtgttatgctattacttttaattcactcagcaacctccctatgaattgtagatggtagccaagatcagaaggaagcaaacttttcttctggccagtcaaaatagcccagaattcaggctccttccctcagttccatactctttctttagcccccttgactcctgcgtaccttccagaatttctcagatgccccttgctctagggtgtagtcttatctgggaagctactgaaaaatgacagtattagaatcagaaaggcaaatcaagacagactgtaggagactcagtcgattaatagttcattgtgttttacatatcatgtaatgtattggtagcattataaataataatggtcctgatcatgattagaataacagtattgggataagaaaattgaaaagcaaattaggtgagtgtaaggaacggaggagatggatacatcagcaaatctttgagcacctactgtgtgcaagagaagctctgcaatgcatgtatagctgtcctttagaggatctggatctcttgacaatttgctactaaataaaagtatgaaaattaagtgtctgtggatctaaagatgctttctaaattatataaagcaaacaagattttatatatatatatatacacacacacacacacacacacacacagtaaagtttgtacttaccatgtgtaagcatgaaaaattcttcataagatttttaatttctgcatttcttaaaatcacctgaaaatttgggtcattctgaagcagaatgtgggtcctgtaaaaaaaagctgggaatactcttatcttcttatgtcctaaggaagcaggagcacgtagattatgggtaaagctgaattagcattagaagaaaataaaaaagattttcattaaatttcttccctatctgagtttctagaaagcaagttaacattgtcctcacatgtctgtttagcacaaagaaatgcagatggcagttaatgggagcttaggggaaacttccctatatgctataaagaaaagaaagggagcagtggctttttaaaatccttgtacttgtaattatggccattactgtctttagcttgaaatgttggatattacttgtatttttaagagtagcccactgctatttaaataaaatgtaaattatgtggacttttcagggagggaagcattttaaagatgagcgttgtcttagtaaaatactcccgtgtttcataaattgtaagttactacatcatgtgacatcctgaatcatttgaaagaatagctgtgttcttggaagcctcttgctcttttctggtcacactggcaccctgagctttccctgtcctggcactaaatcaacttcttgcctctcgtttgtctgcatttttccttttccacaaggagctgcccacttaaaacttctttttaaagcatcctccactgtccttatacagctgtgtaactgttgactttgctctgtagtttagactgtaaatccacatgttctgtgtcctgtacagccctaaacactttacataaatccagtgttgaacactgtattggccaaattttagttaaacctatttttaataactatttttaagttccgagattaatgtgtattggtttgttctgccctttttgttatttagcatattcagctaccctagccctgcactgtcctgcagttttgggcttaccatgactatatgtaattggtccttgagcttctaggatagaaatgaggcaagaaagggtgagtctatggatttcttctaactcacctttactttactgttatttgaggaggaaacatggaagaaaatccaagtctctctgattctcaaaccagaaagtctacatttcatagaatggaacatgctcataccttctttgttttccattggtccaaaattttccatgatttatccgcccttagggagagttaatgattttcaaggatacattactcttcctgctaccttttttagtgtcctggattctccctaggagatgcccaaacctttgagcatggatttttttctcttttaccttttgtaatgcagcttcagagcccactgttctcctaaacttctttctcagatattaacagtagcctcgccagtggtttttccacagtcttcctctataaactgttttatttggcacaggtaacaactatttgtttttatttcgatgatcctggattttctctggtttccttctgcttctaggattccctctctggattcatgttggtgtttttggctccttgaagatgtaattgtctattggcagcccctaaaaggagctttggctggtttatgtctttgtgttcatgctcttttctaccactacactcaatgagttccttttaagtctgcatccacgttctgactccatggtgtcttcttcccctgacccttactcatccatagccaggcttctgtgtctcttcacagtgattcccgattccttttgctcctcttgctgctttctgagctagaaacttgagagaatattggttgtttccctttttcattagaaccaaccgtttatttctttgatgtagtcatttctttgaaatatccatgacatcttttccatagatggcatcttagtttatatccttgtcactctagccaggattgctccagtggtctcctaattggtcaccttatcccctgtctcaatcccccgcagtctgtgttgcatactactgataaaggaacctttctgacacacttcttatatcctgctacttctgcacagtaaccactggcttcttaactcaatgccttagtcactgagacaatcctgctactgtttaatggtattgaaaatcagtaatgcccatagcatttctcaagtgggtgacatcccccagcacgagagactcttgacaccaggagatgcctgagacagctgcagagaaaacagagagaagcctttaccaaaggaagctttctatattttgttattttcttagggctgccctacagccatacagaggaaactcgttttcttctctctgatgttgcctacctgtaggttcctgactaaatgacactagagtactgtggaaacctagttgctgtttgtattagaaaatgtgctgtggatttgaaacagccagctaataaataattttcttaaatttggctgatgaagcattgggagctgcctctacaaataaataatatatatgttcccctttttcagaaatttgagagaatattagtcgtttccctttctcattagaaccaacccttcatttctttgatccagtcatttctttgaaatatccatgacattttatcttttccatatatggcatctcagtccatgtccttattactgggttctagagtttccttttaaatcttgattattgattttttgatcaagaaggaatagagtttataagtagttgattagtggagttacagtatgaaaaatcattacttattttactaagttttctcttttgtttcctctttttaaagccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtaagtttgaacatagattttcttcctatgacattaaagaaactgaataattttttttaagaagccttaaggtggtatcagtgaacttttggattatttaggaagtaaatcagatacctttcagggttcattaaaaacatcatgcatgatttaaaaatcacttgttaattattaaatgatgtgtaaccattacagatagcataggaaattaggggggaaataagccgtgattctaccacttgaaaatagtaagtactgtttttgtgtattcctgtctggacttgtttatatgcatgtttttatgtaaatgaaagtgcacatttaatttagtgtattattttacctttgtctaatgttttgaagcatgtttagccagaacttagccatagagaatttttttttataaatctataagcttgaatttatcagtacatgctttttccctctctcgttttttcattcctgtttatgaatggcctctaaggagtaatgaacaacatttatgaaaagtttgacagctgttacctggaaatgctccctttcagccttttactctttttcttgatagatttggagtttgcttagttacaggtttaagaattagaagaccatctcatgattttacagtttatttgttcaagttgctcaagtacatagataaaatagtaaagataataaaaaagattattctatatttcatactttcttattgtttctctttgacaacccatgtatttcattcctaaaataacaatagtcagctagcacctagcctatatgggacaatagcctattgcttctaggccacatacaaacctgcatggcatgttactgtactgaataatggaggcaattgtaatatattggtaagtatttctgtatctaaatatagaaaagatatgtaaaaatatggtatagaagactttaaatggaggagggacttcaagatggctgactagaggcacctcgtactcaacttctctacaaagaagaaccaagatagggaatagtagatcttcacacttcaaatagatcatcctagagagagcatcgggattcaagagaagtgacaggaagcacctaaagcagggaaggaagaggaaagtgaggcagccagcagaacaccagcagtggctccactgctaaagtgcattccatgtgcccagagtcccctgcctgcaactgctgaagcacaagtggggcgtgatgtgccaccactaaggctgaagcgtgagtgaagcgcagactacagctactgagactagaatgcaaattgtgcgttccccacttgcatgcctatggctaccattgaaagcaatctcttcctcctcagtagcagggccgcagcacagccactgctgctgtccacctgagcattctggagggagcatggggaacaccgcatgcctgcctaccacagctagtgtctacatgtactacgagagggcctgaggacaagcccacccagctttgttcccttgccctggtgccagaacttacagcctatggacctaggaatcacctagcctagtctaccaccatcagcacctgagcacctcttctaggggcctgagattaggcccacacaccctgctgctaccaccacagctggcacctactgcacatgctacctgcgggcctgaagactggcccactcagcacattgtatctactgtcagcaccagagtgcactgctcaagacccagagggttatcctaccactgctactgccatcacccacaccacacctgctggccaggggcctgagaacgtacccagcccaccactctcaataccagcatccaagcaagccacttggacgctcaagaattggcccccttggacccactaacaatggggccagtgaatgccatcctggggtccaaagacaggcatactcggcttaccacttccactgccgggacccaaagactggaccacttacgccactcttattcaacaatagtactggaagtcctagccagagcagtcgggcaagagagaaaataaaagggatccaaattgggaaagagagagtcaaattgtccctctttgctggtgatataatcttgtatctagaaaagtgtaaagactcccccaaaaaacttagatctgtaaataaagttagtaaagttgcaggaggtaaaatcaatatagaaaaatgagaagtgtttctatatgctaataatgaactggctgaaaaatcaagaaagccatcccatttacaatagctacagaaaaataaagtacctaggaataaatttaaccaagtagttggaagatctctataaggaaaactacaaaactgatgaaagaaattgaagaggacacaaagacattccatgcttacagattggaagaattaatatcattaacaggaccaaactgcccaaagcaatctgcacatttagattcaatgcattccctacaaaaatgccaatgtcattttccacagaaatagaaaaaacaatcctaaaatttgtatgaagtcaaaagaaacccaaatagctgaagcagtcctgagtaaaagaacaaacttggagacatcacactactcaacttcaaaatatattaaaaggttatctatagtaatcaaaacagcatgttacttgtataaaaacagatacatagaccagtggaacagagtagagaatccagaaataactatgtttttatagcaaacttatctttgacaaaggtaccaagaacatacatagttggggaaaggatatcatcttcaataaatggtactgggaaaattggatattcatatgcagaagaatgaaactggatctctgtctctcatatacaaaaatcaactcaagatagatgaaagacttaaacataagactgaaactataaaacatggggaaaatactataggacattggtccaggtaaagattttatggctaaaactgcaaaagcacagacagcagaagcaaaaatagattatattaaactaaaaagcttctgcacaacagtggaaacagtggagtgaagagacggttgaatgggagaaaacatttccaaactattcatccaacaaaggacgaatatccagaacctaccgtgaactaaaacaactcaacaattaaaaaattaatactcccattgtaatgtgggcaaaggacatgaatagacatttctcaaaagaagacatatggacaacaggtgtatgaaaaaatgctcaatatcactacttaccagggaaatacaaattaaaaccacaatcaaatcagctcacctctattagaatggctattattaaaaagacaaaaaaaacttatatattggtgaggatgtggagcatgggaagctcttgtacaatgcgactgggaatgtaaattagtacaactactatggaaatcggtatggagatttctcaaaaaactaaaaagagaactcctataggatccagcagtcccacttctgggtatctgtccaaaggaaaataaatcagtgtattaaagggttacctgaattcacatgtttatcatgccactattcacaatagaaaatatgtggaatcaacctaagtgtccagtagatgagtggataaagaaaatgtgatatatacacacaatggaattctgtttggccataaaaaagaatgaaatcatgtcatcttcagcaaccaggatggaactggaggccactacgctaagcgaaataagccaggcacagaaagataaatatagtatgttctcactcactcatggagactaaaaaagctgatctcatggaggtaaagatattattagtaacagaatgatagatactagagactgagaagggtgtgttggtgggacggggcaggaagagaggttggtgaatgggtacaaatgtacagttagatagaagatataagttctgtgttagatagtcaagtagggtgactgtagttagcatccatgtattatatatttcaaggtagctagaagacttgaaatgttcccaacacagaaatgataatactcatgagataatggataccccaaataccctgacttgatcattacacattctgtgcatgtaaccaatactcacatgtatcccataaatactatgtatcaataaaatgtttaaagagataaaaaatggtacacctgtataaggcacttaccgtgaatggagcttgcaggactaaaagtttctctgggtgagtcagtgagtgaattgagggcctaggacatgactattcaccactgtagtctacatggtacaattagaccacactaaacttataaaactttttatctttctttggtaataaattaaccttagcttactgtaacttttttacttcagaacttttaatttttaaaaaatattttgactcttttgtattaacacttagcttaaaacaaacacatagtacagctgtacaaaaatatttttatatccttactctacaagcttttttgtatttttaaaaattatttttctttaactttgtaaacttttttgttaaaaacaaggacaaaaacacacacgttagcctaggcctacgcagggccaggatcatcagtataacagtctgccacctccacatcttgtcccactggaaggtcttcggggcagtaacatgcatggagctgtcatctcctctggtaaccatgccttcttctggaatacctcctgaaggacctgcctgaggctgttttacagttaacttttaaaaacatgtagaaggagtaccctcaaaaataatgatagaaagtgtagtacactaaatacatacaccagtaacatagtcatttattatcattatcaagtattatgtacagagcacaattatatgtgttatactcttataccagcagcacagtatgtttgttattccagcatcaccacagacacatgagtaatacgttgcactatgacattatgttggctatgatgtcacttggtaataggaatttttcagctccattataatcttataggatcaccatggtatatgtggtcccacattgactgaagtattgttatatagcacattactgtataccttgattctttttatcctcacaacagtcccaggagggtgatactattattattcccattttacagatgatacagagtcacaggaagactttaagtggtggagtcaggattccaacccaggcagcttggtttcagagtctgctcttaactgctacaatttatattttataagaaatatatatattttaatttaaaatgtcctccccttctcacgtatcctactcgaacctgcatttcaagacccaggtcaaatcctactccttattttattttattttattcatttgtttttagagatagggttctgctctgtcaacttggctggagtacagtggcatgatcatatagctgactgcagcctcaaactcctaagggatacttttgcctcagtgtcctgagtagctggggctacaggtgcatgctgctgtgcccagctgtttttttttgtttgtttttttttttttcatagagatggggtctcacttttttgccccatctgcctacttcttattttaaagcccatcctttttttttttttttttttttttttgagacagtgtcttgctctgttgcacatgctggagtgcagtggcatgatctcggctcactgcaacctccaaatcccgggttcaagctattctcttgcttcagcctccccagtagctgggactacaggcacatgccaccacgcccgactaactttttgtatttttagtggagatggggtttcaccgtgttagccaggatggtctcgatctcttgaccttgtaatctggccacctcggcctcccaaagtgctgggattacaggcatgagccacctcgcccagccttaaagcccatcttaattcagcctgcagactctcacttttcttgattctaatggcaagtcttgtctgttaatctaatttgcagctagctttgatacagttctgcaggtgctgtcttaaaggtattatttatttaaattatattgcttaacttgtcattatggcctaacattttgcattctgggttaccacttacaggcttaggataactcctcaaacctagtttgtatcttttgtaaagtggcaatatttgctctggggtctgcaaagtaaatagtatatctgtaaagctgctaaacaaatattatttgtcactactccctttagggacaaggctttttatttttttatttattaaattttataattttttattacactttaaattctgggatacatgtacaaacctgaaggtttgttacataggtgtatacgtgccatggtggtttgctgcactcatcaatccatcatctacattcggtatttctcctaatgctatcctttccctagccccccatccctgacaggccccgatgtgtgatgtccccctccctgtgtccgtgtgttctcattgttcaactcccacttataagtgagaacatgcggtgtttggttttctgttcctgtgttagtttgctgagaatgatggcttccaacttcattcatgtccctgcaaaggacatgaactcatccttttttatggctgcatagtactccatggtgtgtatgtgccacattttcttcatccagtctatcattgatgggtgtttgggtgggttccaagtctttgctgttgtgaatagtgctgcagtaaacctatgtgtgcatgtgtctttatagtagaatgatttataatcctttgggtatatagccagtaatgggatggctgggtcaaatggtatttctgcttctaaatccttgaggaattgccacactgtcctccacagtggttgaactaattcacactcccaccaacagtgtaaaagcattcctatttctccacatcctctccaacatctgttgtttcctgtctttttaatgatcgccattctaactggcatgagatggtatctcattgtggttttgatttgcatttctctaatgaccagtgatgatgacctttttgttcttggccacataaatgtcttcttttgagaagtgtctgtgcatatcgtttgcccgcttttttgatggggttgtttgatttttttcttgtaaatttgtttaagttccttgtagattctggatattagccctttgtcagatggatagggacgaggcttttttaatttttaatgtaacttgaggaggaactaactagagaatactagaattaaagagggacactctgaaatgtgagtgaaatcaaacttaaatgaagggactgttaggctaaaaccatatagctcattctacaacatgtgtaagtcagccaatgacaaggcagtaattccttacttttgggaaaaaatttgggaaaataatagcaagaagcaatgagaaagaacacatttctttagaactgtaaagtaagggaaaatgcctcagggcatttttattaatagtacgttattaatgtcagtatttaagacaaaattgcttgtgatcagtcattttatgatatcctattattttgcactaatgctattattttataataatttaaaaatcaagaacactttgcattcatgtttcatttgtgaggcacttgtctgtctgtggtctctgtgtccagcagtgggagctgtgtgctgcacacactgggaagagctcaccaggcactgctcccccacacacaaatactcctccttgactttccctggaaacgacctgtttcaactcttttaactgatctctttcattatttatcttcatttctccaaataacatgcttatgttgctatttcttgatagcaaccccctccctttcctcctctccccccaccgcctcatttctctctgctcctccctctccctccttctccccgcagcctgccattttcctagctttttccaatagagtctatgataatttttggtagaacagtattcatcatttgtattatggtctataaaaaaatccacaattttttgtacactccttatattatcttgtttttttgtgtttatttctctgcttcattactttaatcctaaattctttgcaggctgtgtagatctccttggaattttcaaatatactaagtactttatcaattttatctttgcgaataaatctctgagggctttctggctggcttcccaaccttattcacagaaggctcacatagacactgataatatttgtatagcacagagtgtggtaaatagccgagaccgcttgtggccagaggcatcacagaggctccagtagccccaacccctaccaagcagttctaggtttgaatggattaatacctagatatatttataactcactcaagatagacttcagtgtctttcagcacatttcttaggaagctgtggtccaagggatctccatcatctagggtatttcctacaactttgtcttatgatggatcttctttttgccaaatctccagtcgttctcttatttcctcatttttgtggaagcatttgcacttgtcccttggtatcttttgggggattgcttccaggacctcccttagataccagaattcaaagatgctcggtagcgttagcatacaacctacgggcatcctcctgtatattttaaaccctctttagattatttgtaacacctaatacaatgtaagtgttgtgtaaatagtagttatactgtattgtctaaggaataaggacaagaagtgtctgcacatgtttagcacagatgcaaatttttttccaagtatttttgatccatagttggttgacctcacagatgtggagcgatgaatagagggagccaactgtcagtagttatttgctattgtagatattctctgctatctataatagctagcttgcaaatataatttgttcttttaatttaattatttaaaaatttaaaagcttgtcaattactattactgagaagttgtagaggaactggaactttcatacgttactgggcagagtgtaaaatgcttaccaaaggaatacatggagataccacatttatgaaaatgtctattctgcactcgtgcgtgattactagtttaactgggtgtagaattacaggttgggaaattttgtcaagattttgaaggtatgattccattgtttcttagtgtggatcaatctttatctgttcttctggacactcattgggcccctgtcagtctaaaaacacatgtgtgtcagcttgggaatttcttgttttatttctttgatttgtccttctctgtcttctccttttttcttagaacttctgttcttcatgaaccttccacaacaatcctctaattgtttttatctttcttgttttctatgtattttctattttctcagaaattttttctaaactggattttgcatcctgctattgaatttctattcatatgtttattaatttatagaagatcctttctttgaaaggatttatgttatttttttaatgtatccagtttttgtttcatgatgcaatgtcttatctctgaggatagtaatgatttaaagtttttttctacatgccctgtttcctcacattttttctttttcttttcttttcaattattgactttcgtattagaatttcttgtacactttctggtcatcctggttgctgctcacagttaagcgaggggctgttaaaaatttttttttaatctaattggaactttggtttctctggataggacttgttgatgggggccttccctctagagtgatgaggatgggctatgcaggtggcaaacgccaaatattattttaggtatttcattttgacatgtttatgtgactcagaaaagttcatttagactattacctggtgaggattagtctggcaaaccagtatcctgggagctgagcagaggaagaaggcataggttagcaatccccctgtttttggaatgatagtccccattctcatctcttcctaaaattcttcaatccaaagatattctgttttacttttccagaacataaatctttattcttctgccaaggtaaacgaaggtagtccttcggtagtgtggagtgtgggaagggatctgggtagccaacatatcttcaaacaactttcaagcagtcctgctgttttgagctctttatttccaggggagcctgggatagccactcactgagccctttggcatttctgtgatagaaacaagctgttttcctgtatttcccattggatgcttaagattttgttttctcaggtcttctacatcagttaccattatccatctgctttccagcttccagattttagtgatgttgctttatttctatattttgtctttgtccattcacacctttaaaaaaaatctgtttactctttggagtgatttcaggaggtaagggagaaggaaatagttgtttaatctattgtgtttacctagaagtcccaagttatcttttatagcacctcaatattttattgaaatcttgctcatttctcacaattaataataatttgtattagtataacttacatatttaatcttctatttaaaaataaaagcaactatatagaatacttatataaaaaacaaatctagtctaaaactattttattgaaatgctgcccctctccttgacttaagcttttgaaagtgcaaccccattaattacttctactctatgaaaaatttagatcattaggcagtggtatacaggttgagcatccctaatctgaaaatccaaaactcaaaatgttttaaaattcaaaactttttgagcaccaccatgatgctcaaaggaaatgctcactggagcatttcagacttgggatttttgttattttatttatttattttttgttgtttttagacaggatatcattctgccacccaggctggagtgcagttgcatgatctcagctcactgcagccttgactttccaggctcaatagaccctcccacctcagcctcctgagttgctgggactacaggcacaagccagcatgcctggctaattttatttttttattttttatttttttatttttttgtagagatggggtttcgccgtattgtccaggctggtcttgtactcctgggctcaagggatctgcctgtctcagcctcccaaagtgctgggtaaattacaggtgtgagccactgtccaggcagattttagatttttagattagagatgctcatctgagaagtatataatgcaatctgaaaaggtgcaaaatccaacacacttgtggtcccaagggatactcaacctgcattttcttgcataccaaattgaatgtttcaatgaatagcaacatcttatataatacattagggcctaaagttgaagaagtaaacaaatgaatcatgattattgttactctgctattataccttacacaaaactgagttgtattaaaggacaaaacataaacttagctgatgattgtgtggaatctattgtgtcttttaattctaaaggaaagcaaaacatattgctacttggaaatacagttttgtgtttgtgttcatttttaggtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttgtaagcttatatttaaagaatgtttgtttcagatgaattaaattagtctcacttaagagtaagatttagtttgagctttcacttctcataacctcattcagctgcatgaggattacctgggagcgtctaagcccaccatccctggagattttgatcaaaaagtctgagataggcttcaggaatctgtattttgaaagaactttctgagtggttggataaacatccaggtttgaaaatcactgtcataggaattgaagagcattaaaaattgtgtgtagatgatactgagatgaaatctatgtttaaaaaaaaaaaacaaaacagttcccaatttctggctcacagagcagacccctagaggctgcatagttattgccaggaacacggggatctgcaagcataccaaaaagcatccgtacattaagtaaaactcatatacagggagaatgttggcagtttcgaatagggggcctggaaaattgttgaccataaaatgaaatcctgaaaggctggtagtcattgtagagatagatcactctatggataaaaggattagaggaaggaaggggactagattaaagtaagttgttttttagggtgtggagtacttgggcatatatttaggccgatggaaagtaagacatatgccctaaatacattgaataaaaggaatggaattatttaattagtgatttttggggggtgtggattgttcacatgtatatataaacccactgaatttcaacccttagacttcttagacataaacctgtggcattaactttagacactgacctgtaatctgcttctgcttcctcaccattatcccttcataagtaaataaaaccacatacacttttaaaaaatttatcgtatatatcttgctcctacaaaacctgtggaacacaccttatctttggaccattatcattacaaagcacctaacagtttgtagtgtatatactgggctattttaaaagtcatcttatgaaaagaaagtcttaaaatgcagaaaagtttatgtaaaatacttctatataaaatgtttataattcctctttttctttctagggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatgtaagtatatgattttaaagagagaattcctattaacctgttttggtcttccttgaaagccttaattcttctggagtgggggggtgggaggagtgattctgtttctttctcatttctttgttctttaatataaaggctatacaaaggcactagaatatttgcttgttttaaaatgaattgcaagcttgttttccacataacctgtatctgtgtaatttgttggttttgtaatcagatttgaaacatctagcttctaatgtttagtttaaattcttagttaacagctttgttaaggataggatataatatttcttaaccctgcattgtttagaaattatgtgaattcattttccagttaaagtataccttttttaaagtatctaaattaaagaaattatagcaattttacacaaaatctttcagtagcataacatatcttctccatcttttaactattatatttgaggagaacaggctggcaggaggacatgggtgaggggaaacatactctcccactgcgttctatatatgttgtatgctctgtcattcaaggtgtctattaacatgatcaccccacagtctaaaattccatggtatttccaaaagtagtttgttgtgggctgccctgcccatgtggcttgtgttgaatgtccacagataaatatgtagaatttttaggtctcaattttagtttttctgcctcccttccttgtagcaactgtaatgttttggtgtcactgacagcttcatctttatcagtgagtcccttcctccctttatgctgaattagaagtctgggattttggtctaaaggtcgcctgaataatgtgtataagatagattgactagattttatgatatttcttttgattccttagtgctttttctttctttctttttatgattctcagctgtggtctagatcagcagctctctcgtttactcatacagtacttcgtgatgaatttcattcagatactgatgtattcccaaaggaatagccgggtttaggtgctcgtctcagcttgatggctgtaatctgactctctttttgtctgctcagtaatgcatttggaattcaagtgaaagtgaggttatgttcaaatttaaatcctggaaatcatattatccttcttaatggaatgttaggaaattacttgcaacatttctcacaaatagtcctggagtctaagttgagacccagtggtatatgtagtgaagttgcttcgtgagcagtaccaaaagtgagctattacttaaaagtatgaaagaagaaattaaaacttaaaaaatgagactgtgcactgtttccatttgtgttatttcagacagtgttgtaatcttttatcatagtaatagaacaagctaatttatagtttaaccttcatttataacgtttggaggttgaaatattgtacaatatttgttgagcagcagtaacatctcccttcagagagaacttttaggaaatttataagagcaggttatttcgtgagttaggtatcaggattcatttatttcctttctttatggatatcctgttaagccaccatttacggaaaagactgaaaagaaatttaggccgggtgtggtggcttacgcctgtaatcccagcgctttgggaggctgaggcgggcggatcacgaggtcaggagatcgagaccatcctggctaacacggtgaaaccctgtctctattaaaaaaaaaaatacaaaaaaattagctgggcatggtggcaggcgcctgtggtctcagctactcgggaagctgaggcaggagagtggcatgaacccaggaggcggagcttgcagtgagctgagatcgcaccactgcactccagcctgggtgacagagcgagactccgtctcaaaaaaaaaaaagaaaaagaaatttataatcggcttgttagtttttccctacacacacgtctgcgtgcacacacacctacccaatcaaaacctgctggcgttttgattgggattacattaaatccgtggatcaatttaggagaattttcattcttacaatatttgtatctcccaaactatgaacatggtatatccctacatttacttgagtcttctttaattcatcttaatatgaggtctttatgtcttttggtaaattttttcctagtgctaggtgttttctgatattattaaaaatgactttgttttttaaattgcattttctattgactggtatataaaaatgtagttgatgtatacctagcttttaacctagtagcttcagttgattattttataagttaatttctttgaaaagaaaattagtacatttcaaatactgtcctctcaaatttttccccttctgtctgtccttctatttatctcttatttgctcttgttatttagattttaatatttcaacttaatatctaccaaatcctaaaataaccagcattttaaatatattccatatttttggtatgtggttttaatagagtgactgaatatttggccttagatttaaaacaattttcagaataaatatgtcaatgtttgtttacttatctaattgttaaactctcatataaacactcattaatcctcttaatgttacctgaaatatcattgaaggatgttatccttatctctggggaaggtatgaaattttccaagttttggttgataaactaaggagtattttttttttaattcagatttgtgaaaaaaaaattttacagaatttttaaacaagtagtttttttaaaaaagaacttttacctaaagtgaaagatagtttggataaatatgagagaggaaataccagtttctatatgtgtatggttaaacatgattacagaaatatgaatttctacaataagcagtgtcagactgcagacttttaatttatcacttttttttttttttttttttgagacggagtatcgctctgtcgcccagaccagattccagtggcacaatctgggttcagtgcagcctccacctcccaggttcaagcggttctcctgcctcagcctcccgaatagctgagacttcaggcaccctccaccacacccggctaatttttgtatttttagtggagacggggtttcaccatgttggccaggctggtctcaaactcctgacttcaggtgatttgcccaccttggcctcccagagtgctgggattacagatgtgagccactgcacctgggctcatttatcactttgaaggtctcgtcttaaaaaaaaaaaaaaaatttcttttaatttttctagtcctgccttaaagctggggagagcagttttgataaagagaaaaacaacaaaagagccgcagtcagtttgtatatactgagatgcagaattttaccaagagttttctaaacaacagtacttataatgtattttagaactctgaaacatgtaacatgacttactgattttcaatatgatttggtatttcttttcgaatcacagtatattgatgatagatgataatacttttaacctgtagatttctctgacaacatattagactcaggtttctttgagagatttggtagcctctgaaataggattaagggaaaaaaagtgacaactgatatttcaagttgctacagggagtttccagatgagctaagagtcatttttcagtatattttaatctgtcaattctaatgtaatatgaactctgacaagacatgctacagagagaataattcctgcattattcaaaagtaaaatgtaaatagtaaattatttcattttttaggaaattgtggaaaacattgacgtttataaaatattatgttttcagggaaaatatatgtaatcataagtacctgcattttttttctgttagatccaccagatactcctcaacaactgaattgtgagacacatgatttaaaagaaattatatgtagttggaatccaggaagggtgacagcgttggtgggcccacgtgctacaagctacactttagttgaaaggtaatgataactgggaaaagatgtcagatggcaaggagtacgttggaagtgcatgttaaatgacatagggaactgcactagatcatttatgttacaaacaagatataaaaccaaatatgctgtataaaattacacttataagcactgcagttcagccacatgtacactcaattttatgtctcctcttttaagaagcttagaatgaagaacacttgaacatgaacagagactgtttctcggtagtaaacttatggctgattaatttcttctattttctgtatcacatacattttcttctctgagtatgtaatatgcttctaattagaaatttaaactttttatacaaattaagtattacgaatttgcccgttttttcctgcaatatttatctcttgccattttgaaattatttttctgttaattaacagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaaggtaagctgtacataaactaatgtcttaaaaataactttaaaagtggtgaaatgctttaatgaaaaatgcttatagggattactttttgctgattattttctttatagttacttaatattaatttcataaattttatttataaaaactttaaatgtataatttcaagttttactattttattgaatttaaatacttgaattagtaatttactctttctgataatttttgatttctgaaatatcttctgcccaatttttaaaaacttttattttgaagtaattgttgactcactggtagttacaataataagagccttgtgaacccatcccctggctattcccagtggtgtcatcttatataattctagtacaatatcagaaccagggaattgacactcttaaaacactgttaactagactactgaccttgctcagtttttatgtgcattcatttgtactcgtgtgtgtgtgtgtgtgtgtgtgtgtgtgtgtgtgtgtgtgtgtagttctatgcaatttataggtatagattcaggtaaccaccaccacatgcaagatacagaactgccctgtcactacaaaggaacttgctcatgttgcccttccagcatcccctgtacatacagtcacatccctgtgccttgacaacaacgaatctattcttcatctctgttttatcagtttgagattgttacataagtaaaatcatacagtatgcagtttggcattttttttttaaggatgtcctggagagccatccatgttgttgtatgtattaatagttcgtcccttttattactgattgcatttttaccaatcgtattaatatatagctccaaataaaaataaaatgtgcttggtctttttggtattcattcccatggtccatgtgcattaacactccatgtcaggctcacagcacactgagcaacggcctagaccttctcttagagactcaggcaggggagaaagggcctaaaccgaaggcatgtctcatacagtctcacagctgattagtagatgatcctgttgccttatttgtaagcataagtcacttttatcagttgttctttcctgtcgtctttgcgatttctggatttttcctagtgtcaccatggctacattttatccttgcatggtagtatttgtatgtatttgtctgccctctgccatttcagccttatttcccatgtgattctttcccgccactcaactgggcatacacactatcaccagtgtaatatgcagtttgcctcgctgtaccttcattattggcatctctgcctaaaatgcttttctgcattttttttggctaatttttgtctgattcttcctgcatagctcatcttaagttccatcttcactgtaagacttaccttaccatgcttacatttacatagtggttaatatctgtatcattcatttagaacttggcatttatattcttattaattacctttctttcttttttcttttctttttttttttttttttttggtcattccctaagtaaattagaagttccttaaaggtagatactgtgatcttaactacctttgagtattcctgacactaatttaagagctttgagcatgatcgattgtttaaaaatgttggcaagatgtcagtagtagaaattaggtttgtcaattccacaaatactgggtaggatgttgttggtcagcactaatgatgcctcgttgttttttatgttttcttctcatttgtcatattagaagatagtttttccctttaaataagtgtttaatctttaaaaattatatttgcagtttatccccatactcctacttcattcaaagtgaaggatattaattcaacagctgttaaactttcttggcatttaccaggcaactttgcaaagattaattttttatgtgaaattgaaattaagaaatctaattcagtacaagagcaggtaagattctcttaaagacttcctttgtgattattttggataaaatagttctcaaaaagaattaagcaaattgatatgcttaagctctcagattatttattatagagatttactaagaaccaagaaagacattactatccatgtaataacagcattgtatcatttgaaaaacaattgtaaatatgacttttactcctcagaatgttcccagatgcactatagtacctggcacatagctggtgctccgtaaatttgtgaatgaatgagtagtttttgctgtaacttttagcatcattaatggatgaattggcactagacagcagaagtgattttttaaaactgtgaagtgtggcagtgggaacaagctgtaattggtacttaaaagtcacaacatgactttttaatacattttaaatatttaggttgacttttatattatactatcttgtaatttgtggtaagtctgaaataaatgaggtgtacttaactattcatttggaaatttactgatgtctagaaaatcagtcacaactgtaaaatataacctgaaaaccttctttgtaatgttttggggagctcagaggcttttgtgaaacaggcagatattcaaatttgtttagaaatgtttcattttaactatatttacttagtttaaggaagtatttgttgaatatttgctacatgtttagcatcatactagaagttctaagtgtcatattaacaaagatgcacaaaaggtaatgcctgcctccaagaaacttccaaatatcatccaaataatacatttattcctcacagtcatctcaaattataaatcacattaaggtttattgcatcaccattagccctttgattatcaaaattatataatcctttagataatttaattgaccattattacttagagccagtatttggattaaaaagataacccaattttttattactattacagggcataatttcattggcttggcaggtatataagaattaaaatattacagtggataaactgctttgggtgttacatatacaaactcattgacattccgttggtttgtgttacaaatgtgaaggctttcttaccaaaaaaaagtgtatgtatgtgtatgtatatatatatgtattcatacacataatatatacatatatatatatttatttgttttccaatagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtaagttaactaagtgatgtatggctaataattactgtgtattctgaagttttacaacttctttaaaaagaagatgttggccgggtgcagtgggtcacacctgtaatcccagcactttgggaggccgaggtgggcagattacctgaggttgggagtttgagaccagcctgaccaatatggagaaaccccatctctactaaaaatacaaaattagctgggcatggtggtgcatgcctgtaaccccagctatttgggaggctgaggcaggagtgaatcgtttgaatctgggaggcggaggttgcagtgagccaagattgcgccattgcactccagcctgggcaacaagagtgaaactccgtctctaaataagaaaaaaaaaatgctattagagtccttaaaggtgggggaatgtttagataaattatgtaatacctgctaataaaatatcacagatattttaaatgatagttttgaagttttgtcatagtatagaaaaatgattggcataaattatgagaaagccagggctcctctatctatactatgattgccaccatattacgataatgcatagaatgatttttctcccattcttttctgcttggaattttaattatgcttttaactcattggccttttttttaaaaaaaaaaaacaattactaaaaaagagaatttgttagtttttatttgtgacctagacctgagaaatgtggctaaaaggtcttgaacttcagtttctgtagtatacccaggtcaagttaggtataaaatcaggtaactggttttctaaatatgataatttccaaagacagaatgatattctatcttcgaataaccagatgtcaggtgtaaaaaaaaaaaaactcagaaataggtttaattttttatttttttgagacagagtctcactttgtcacctaggctggagtgcaatggcgcgatctcggctcactgcaatgtccgcctcccgggttcaagtgattctcctgcctcagcctcccaagtaggggccccaccaccacgcccggctaatttttgtatttttagtagagatggggtttcaccgtgttggtcaggctggtctcgaactcctgaccttgtgatgtgcctgccttggcctcccaaagtactgggattacaggcgtgagccactgtgcccggccgaaataggtttaatttttaggaatcatttaacaaaagatagcaaaagctttatttatattatgcagtataatacttcctccaaaaatttaagaaatagcaaagcaaataaatgatagatgttaatctagatttttgcctctccacatgaagacatgtgaagaatagagatgagggcattttgcgacatgtgtaagaattacttgtatcatcaaaagtgaaagctatgcatgagtacagagagggaggatatgagttatctattgctgtgcaacaaattaccctaaaattcagtggcttaacacagcagatgtttatgatcttcccatttctatgggttaaaaatccaggagcagcttagctggatctctctgacttggagtctttcatgaggctgcagtcaggaatgtgggtggggactgcaggcttcactggggctagaggatccactttcaagatggttcactcatgtggctaaaggcaggaggcctcagttcctcaccttgtgggcctctctctaggcctgcttaagtgtgctcatgacatggcagccagttcctcccagagccggtgactgaacagtatcttttatgctctaaaatcggaagtaacataccattatgtctactgcacactgttggtcacacaggccaaccctgatgcaatgtgggagggcaccacgcacatggggattattggtcattttggagactagccactgtagtttttgccttcagttaatgagctgttgtctccaagaggaaacatcttatttgcacctcattaagatgaaggcatcaatttactcaacaaatatttactgagtatgcattacagattgaacatacgtaatctgaaaacctgaaatgctccaagatccaaaactttttgagcaccaccaggatgccacaaatggaaaattccacacttaagtacttaacacaaatttgtttcatgcacagaattatttaaaatattgtatgaaattaccttcaggctgtgtgtataaggtgtatgtgaaacataaatgaattttatgtgttcttggatcccatcctccaagatatttcattatgtatatgcagatattctacaattagaaaaaatccaaaatctgaaacacttttgctcccaagcatttcggatgagggatactcaacctgtatgtgtctggaattgttctagttagcagtgatatagcagcagataaaacagagatctcggcctatggagtttgtaggatccaggactagaaataaatttatatatatacacatctatatgtatgtatgtacacacacaaacacaaagacacagacacatcagtttatcagctggtgacaaatgccacagaggagaggaagtgataggaatagaggctgagggataaggagggggtgaagggaatggcagttttaaatagggtagttagaaaagacctcactaataaggtaatactcaagctgagatacaaagatcaggaagcatgccatattgtttttatctaggagaagagagttgtaggcagaggaagagagggcacagaagatgcagagagcctgaggcagttgtgtctttggcatatctgagggacagccaggaagccagtgtgtggccaagaaaggagggagtgagaggatgtgaggcagaggggaacccagggaatcagtacagctggcctgcaggtagattttcacccattcgagggggccgtgtgttttgcaaaagttgttgagagcttagattttccattgcttcattttctaagtggaagccactgaactgcttcacgttttattgagaattccaaacatcctagaaaaaaaatgccaagcaccatatacatatagtatgtgtcttcagatattaactttaaaatctcctttttaggtccttcaaaggggcctgatacttggagagagtggagttctgatggaaaaaatttaataatctattggaaggtaaatatctaatttttctgtgaacatttacattactttgctaaactgcttaacttacgcatggtacttgggttatcaaggagctgaaacttcccagactggcttttgttgcaatattggtgagaatctaacctggttcctaaaccccccaaattcctcgtcactcctaactccccacagtcatttgaggatctcctgtgtcagatctgagccttctcgagtttgatcttataaggcctgtaaaggacctgaagatttcatgaattccatctccctcacttcagtcaaaatctgtaggttagaatcctaagtgtttgttatatttttttctattaataggaaagtaaatttttatatacttcatgtgtaatttatttcccttcaataaattgcattataacatgccagttataaagttttgtatgattttgtaaagtatttagatgaaatatgaattgcatattttactaatttttctctgctggaacattttttgttgccatatttttaagtattttatgaatatcaaaaacatgaacaattgttttctatattagattttacacaagcagtcataataggattcctttaaatagtgaattttgttatggaaagtaaaacataattttatttaaaaaaacttttgacgtcgatacagctttgagtaaagtgaagtgtacatgcaggttcaatgtgagttccattgctttgagattgtatttgactgttacatccactcttgattagaaaatcccccagctactctcagttgcctgtcagatttcatgataatatagcaacgattatacaatttacttcaatatacgaaagtttgaaatattgttcaaactagacgaaaacttaagactaaaaacattgaaatgatttagattctagcttcattatctatgctgatggtgccgccatttgccaagtcagagtgtgttcgggtagaaattatgtagttttggtcatagtgagttttcagaaggtatgccactgggatatcatgagtagagttcagtaggcggtttgatatatgtaaggctctggagctcaggggagaggttggcactgaaaacagctttgagtagcatataaatgggatcacttggagatgcaaggtgaaaagtgggccagggatggagcccaggtgacagcagcatgcatagaaccagcagaggaggaggaaccagcagaggagatggggaaggtttagaggggcaggaacaacgaagaaaatagaattagagaagctgggggaggaggacatttcaaacagtgtgtggtctggagtatcccaagaagcccataagtcttaggactaaagcctgccccttagagcaggccatttggagcatcacagagacctctgctggagcagagtgtttcgcagtgttagatcatcctcagtcttgaccagagagccccatacattggtgtataaattaaggcagttgttatgaaaagcagttcagtataaatgaagaggtttgaatgttcatttgtttttatacagtaagttcacttttagaaattcatattaaaaatttctatgaaaaagaaaaaaagtggcacaaaaaagttcaccaaaatatttgttttagtattgtgaaaaattagaaacaacttaaatttcatttatttaagggatattcaagtacactggtaaaaatgctacataagacataaaaccatgaaaatgtatataactgtattatggacaagcgtatattagcatatattatggaaaagtaaaaagtaaaatggtgtaatatgattaaaacaatgttagtaaaaaaatctatacctagaaaaacaacttgaaagaaatatcaaaatgaaagaatacttaagaggtgggaatatgggagatttttacttgtttcaacttctatatattttccaaattttctgtagtgggcatgtaatactttaaaatgagaaaacaaatgtttagaaaaaaacccatgatgctattttttaaaatgttttgtttgttgctaagtagagcagtgcttctggatagttttaaaagttttgctcctgaaaaatgtggagataaatattgttttttattcacttaatttttaaatttttgtgtactcttactgcttatagcaagtatagtttttcttcagtgtctctttcctgatttaccctgctcccagtggattttaaatctgtgttttacactgttgagagattcatttttgctgttgttgttgttgagacagagtctcgctctttgaaccagtctggagtgcagtggcacaaactcagctcactgtgacctccacctgccaggttcaagtgattctcccgcctcagcctcctgaggtgccaccatgcctggctaatttttgtatttttagtagagacagggtttcatgtttgtcatgtttggcaggctggtctcgaactgctgacctcatgatccgcctgcctcggcctcccaaagtgctgggattataggcgcacttggccagcttcatcttttctgatactaccttgtaactggttgttttttgtttttgagatggagtctcgctctgttgctcagactggagtacagtggcatgatcttggctcactgcaaccttcacctcctggcttcaagtgattgtcctgcctcagcctcccaagtagctgggattacaggcgctcaccaccacacctggttaattttagtatttttgggagagactgggtttcaccatgttggccaggctggtctcgaactcctgacttcaagtgatccacctgcctcggcctaagtgctggaattataagcgtgagtcaccacgcctggccaaccttgttattgttaatatagtgtccagtttaaacccaattaccttgcctagtcacagtcacgttttgcagggttttataacaatttgtctgtttttcatagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatggtgagtgcttgagatgatttagtatataagaacgggaaactaaagtgagaaatgtctgatgttacttgctcttttgtcatgtcagccttcttctcgtataccttgttgctgctgacctagaaggcagaatgagcagattgatgtctacagttcattgagaaagaagtcattagtattgacttgaagcatgtgcactgatggatacaatcattactgtactcagtaactatagtggataatattggagagttacagtggtggatagtacttttaggaagaaatattttaagagtttattcaaatgatattcagacgcttctccaagacacttccccaagactaggaaagtttattttaggtcagctaggctgttttgcaaattgttgggcaggaaaaaaaaaaaacgcttattttaattagcaccttttttgataagaaattccttattaatagaaattctttattgattaaaaaaagtcttcttaaggtataaattagatcttcaatataggccttagaaaaacaactgtggtgtagtttttaaaatttagtgcctttctttaaattttacagatgtccagtgattaatacattcttcccagcttctgccttgacaactttgagagttatgagctttaaacggccacttccacctcttcttccacagacctctgtgctccagtcattttctgcctacccacctttgctctcttgccccgatatgggagcacctttctgtaaccacagctcctagaggaagaaaaattggtccagttagggtcctctaagtagctttccaactccagtttgaggctgtttcttattgttacttgactgcatctttgttctctttgagtcagtcataggagaattaggaggaaggaagggggaaaacaaagtgcatttcagagatacaaaccccaggcagcagtgctgctggagatgcacaggggttgtggcaggtgctgggaggaggggcttaataatggcttcttcattttggcctggcaaaaataacaaaataaaaaatgaaggagacagagatgtgaacatccataagaagataacatactgatttagattatatgtttcattgcactcacaatgctaggcaatagctatgttgtcttttaattcaggaaacataatcctaccttttctgtgtatcccttagaaaatggtaatttacagaactagcaattctgtcatcagcttccagacactttctgaaaccccagaacaaatcctcattccttgaggatttcccgagtggagggaggctctgcagcctcaactcaggtttacactgtggctttttaatcacgttgagcaaaaaaagctgttatgtccgaagtgttctctattctcagccaaattgttgtcttgcgtttagtagtagttgctttatgaatgtacattttgttcaaaaaacttgtctgtgtttatttttactgaacccttaaatataaatcagttatagctattagttactttctcctgttacagtgggtaatgtctgtgttggttttactgaacgctctctgtagcctgtgggtgattaagtactctcccatggctgcatcccgtcaagggccgctcacctgcagtttgcaggctcctgagcatctggctcctgcgacaattactcgtctaaaaatttattcttagaaacctttctatgtttgtttttactgaacccttaaatacaaatcagttataaaatctacctcttttctcctgttacggtgggaaattttcttctcccttttgaccacactgccctatcttctaccccaattcttcacccccagcctggggttccacttcttacctaggccaagatctggcaagacagggaaacaaaaccttgccagggcctctgcgcctgtcttctgccctcagcctttgccccttgccccttgccccttgccccttggtgtctcctaggacgctgtgcagacttctccttctcagtgtccacactggccatcccacctcatcgcctctgggtgtctccacagctttctcccttgcccccaccctacccctggtcagccagacaaccccttcagcccagctcttgggctgcagtcttcgttgaaagaaagagggggctagttcttctgctgtttccacaagtttgttgtgtgcctactctgcacattgtactgggccccgcttgttctctgcacgcattcatagtgagtgatgagaggagggcttcagactgtccactgtcccctccccagtctccctctcccaccctgtcccagccagtgtccttagctgcgtccttcctgtgccttgatcttgatgtcctagtcccagtatgtcactacctgatcctaggcgctttttaaaaacgactttctttgagctgctgtgttaatctatgtatacaggtaagtgctacagttgttaaaatgaaaataacagagcaacacttctaatctttgctctaggtttatctagtttgagcactattttataatttcttcacaatgaagtgatttttctaactcatgtccatttttatgagatttgccttatattattgtttttaatgccagtaaaatatcctcctttcttattgaagatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctggtaagatgaattagtgtctctcaattaagttctacaaaatatttttaaaaggcaacacgtaagactgggtgcagtgaagtgattctctttactgctggatgggtataaataggtttgactttcctgggagggtagttgtggcagcacatggaaggatccaaaccctttgatctggtaattactggtctagaaatttattcttagaaataatcagagaacaacacagatttaatctaagaatgttcatgacagtattattgataattgtgaaaaattaaaaacccaaatagcaaataagggaatgagtaaatgatggtacacctataaaatggaatggtaagtaacattaaaaattatgtggaaaattaaataaatgttcatgaaaaaaaaaaactacggaactgtagcctggtctcacacaagggcctttgccttgtttgcccagggtccaggttaccaaggttagggagagactgagcacaaagaccgtgaaccccttaccacttaaccctgatgcagggcaagggggcatcggctggactgagcgcagtgtgggtgggaggccttgcgttccatgagcctgatgctcaggagcttgtgagctgccggtgagtgtccctctatgggatgcagcctgagaagtttttccacagaggagtgtttaataacctacaggctaatccagccttgtccttaggaattagagccctctctgcaatatcatcgttgttttcctggcacaatgggagtgtatcctgcctgtccccatgggatttctggaccctgtagcttgtcagtagtgatgcttcgtgatcattcctgtctcctgcctccctcgcgtgttagggaagtgcagaagagcaagcagcctgctccttacctctctctcagggaacactttctacttgcttactgtttctctctcagatgatgaggatgggtcccattcattggattatcatgtatgagttcagattattttccagttctacttggaatacagccaaactcctccacatgtataattggctgaagtggtaatgatcttcctgagttgttccctttatccttccttacagtgcactgtacttatcaaggacccagccacatgctacccttcttttcctgcaccttcccttccatcccctcccatgttgctgaatgagccttacacgattccagtctgtcctttctcacctgagcttttagaataatcaggatggactgggataggctggagtggatataaatggagtatctacccatttaagttttagctgagacctgcaggatatggggaagctgccccgcgatgattgtgggaagagaactttctgtgccaactcaattgaacaaagacacaaagcttgagaaaacaaaaactcagagaagttaggtgccttttccaaggtcacaaaattagtatgtgatagaacccaggttcaaattcagagttattcagagcttcaagaggctgggaatattgtcttttatttactgctgagcttctggaacagcaagtggcacatagtaggcacaccttttattcctctctcatcctgttctctactcattaagctgtccactctcttttttgaccttagcacattcctaatgctctaaccttctcagcctctttttttaaagtgtcagagccctataaaatattgttaataaataattttaacataaaaagaggtacagatttacagatgtacatgcagtataaaatgataacctcaagcatacctttctccaaagaaaaatgttgcaaaactaaacacagttggctgagcttgagttgcattactgcatacttaggacgtgccagcacataacaaacgtttaaggaaagtgattacaagaagaaaagttaatattttagacaagttgattcagtttttcttgggttgtatgatgttagaagttgactactgtctcaaattggagcctgtaggccactggtgttttataggcacttgattggagaactaatgctttaaccacaccagaataattgcattctgcaaattaaatgcaatgccatatgctgccaatcccccctgcgtgtcccccggcattatcttctttctcgaccaccactgatgagcatctaattgcccttcaaggccttattcagatggcccttattgtagctgtttctgatctttttagactcatttggcccctcacttaagattccatggcatctgatacatacctctaatataacacactgttatggttacccttgttcgtctgtcttccccaccactctgcaagtgtctccatgcttgacgttttgtgcatgtctgtgttgctcacattgtacacattgcattgtattcaggagacatttaaaagcagccttttgaatttaagttaaggtacttcaattggaagtacctctatgtcctgtggagttaattcaaagtatttctatatcttgtggagttaactcacccaaggacacttaatggtgatgttataaagaggaataaactctaagacctaattcctttaacactgaagcttcaaggcagagtgcaacttttaattctgcttcttggaacaagaggagagagcagtgggtttgtttgctttttccaactcagaaataacactaggtaaggaagggatttatagaggcatgatgtggacctcgaatgaatggcttagtgaactgacccaggaagttgatgtagacttacattttgttcattaaaatcaagcagttgccagcactttgggaggccaaggtgggtgggtcacgaggtcaggagtttgagaccaacctggccaagatggtgaaaccctttctctactaaaaatacaaaaattagccaggtgcggtggcgggcacctgtaatcccagctacttgggaggctgaggcaggagaatcacttgaacccgggaggcggaagttgcagtgagctaagatcatgaccctgcactccagcctgggcgacaaagcaagactccgtcaaagaaaaaaaaaaaaaaatcaagcaatgatgatttcttcctggaaaaaggaacaaaatgtaagccttaaatcatcgttgttctcttcaatgcaatcccatcttatattactaaactttttgttaaaatagaagtaaatttaatttttgtttagtcaattttcttttgaatatttactagtctttaaaatatatatgtattttttaataagaaaacatctttaaaattagctttggaaattttagagtatgttatgaacttgatgtttctaaaatagatattcatagtaatatatttatgaaagtttgctgatatgttcatcctatagatgagtttcgaccaggtataagatataattttttcctgtatggatgcagaaatcaaggatatcaattattacgctccatgattggatatatagaagaattgggtaagttaaatgggtacttatttataagagctcaaggcaacatgagaaattataaattggcaacaatggtatgattgaattctaaaaataagatgtataattgaaggaaggtaaaataatttgataaattaaaaagtatttgattactacttttttctcctcctcctctttttttttttttttttttttttttttgagagagggtcttactctgtcacccaggctggagtgcagtggtgagatcatggctctcttcagcctcaacctcctgggctcaggtgatcctcccacctcagcctcctgggtagctgggactacaggtgcatgccaccatgctcagctaatttttttttttttttgtagagatgaggtttcattatgttgcccaggctggtctcaaaattcctgggctcaaatgatcctcccacctcagcctcctaaagtgctgggattacaggcatcagccactgcactgggcctgcttactctgaaatcatttgttgaatgtttacatttcacaattttactcgtcctcaggaaaattaaatctgaacttggatgtcaaaaatatttaattagtacttttacaagtttaaaaaactattaacttcttcaggactatcaataaagatgtgaaatacaaatgaagtctatctgaatagccactgaaagattttgcatagattgcttccctagatatgtgtttgtctaaaagggatattgtaagttctacctttgttcctaaaaatatttttgtctatggttattagtatgtaagcttcacaaaaaaagcgtttgtgatcatctctctctgaaagtttatgattaaataaagttttaattccaagttgaattatttttgaggctagaaagctcaggaaacattactgtattactctgtattcatacactcccctttagcaattgactttttccttttacagctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtgagtaaattgatagcacaaggaaagtgtttcttagaagtttctcattaaccacaacagaaaaaaaaggaaagtcctgctcagtagtttagtactggttttcaaaactatctgaaagatagagaaatgaaaaggcagtaattctatgaatataagagttttaagattttagtgtgcaataatgacatgtatagtctttcagaaatcatttaaatcatttattctgaagccgttgattataagcctcataggacagaaaccatctcttattagagctgtacataatccataacaaggcatctcatgaagtttacttccaaaaagaaatcttttacttacagcagtggaggagaaaaactcaggaatccaaagagttagcttcagatcctcagttgtaatttgacaaaaaaccattggcctattagcgtcttagccatgcccttgataagctggaaaacttaattgacttgattggggatgtattaaaaagtacagacaatccttggaaatcggcaagtgtacatccaaagactttagagaattctcagatttacaaatacaaaattgtacagatttctggcttttcctttcattatgtttctgctgagaatcagatatttcttattcatagctgcataacacaagcatatcatcttttcagtttgagagctttcatgtccctggatgacctcgcctcagaaagaaatcattttaattatttaatgcctgtctgagaaatagagaactccaccacggtatggcagtgctggccgagcactgtctcagtcactccctagaacacctgcagaaagtgtgtgcctccccttcggtccccaagttctgcatttcctgaaccttcatgattgctggtgaatgagggacatcctgaatatcaaattccacaaacatccagagcctagtgtgacttgcctcacatgcttggaaattttacacttgaaccagttaaaattctagcatctggatttccagtgagacatggtagatgggtcactaaagttagcataaagaaggggaaacacccccaaactctaataaagccacaaggagagaacagaagaggcaaaacaacactgaaaaagaagattcagaaatttgtgggtggaagtggggcaaatgacttaaatgagtggaagattgtgaaatctgtgtgggcagtcaggcattgttgagaaggaacttctccagtacctgccagaccaggccttggaggctgagtggtgaggatcaatctggtctgaacggaggggtcgattgaagaacgttccttagaactgaagggcctaactacaagcagatccccttctccgctgtttcacttaccatggtttcgctttctgccatttcagttacccctggcaaaaagcagtctgaaaatagatgagttcagtacaataagatactttaagaaagagagagaccatatttacgtaatttttattacagtatattgttataattattctctgaggaaaatgggcggactactgtatatagagccaaagaattcattaaatacacagcaaaataaatagaaaaaagatctatgccaaggtatgtcattatgaattttccaagcagctaatgtgaaagaaatgatcagagacaagcaggtcatgtgcaagcaatcaggaataataatggcaatagacagcccagcaacactccagatactagaagtctcttcaaaatactgaatgaaaattattttcaacctaaaattcgatactccaccagtctgtcaaccaacgtgagagagaaatgcagatattttgtacatgcgaggctgcaaacatttactttccccatgttgcttttctcaagaagctactagaagagtgcatcctaatgaggaaatgaagtgaggccggtccaggaagccacaggggagagagagcagggagctccaggagggcctcagccctgaaggcatccagtctagtgcaggaggcaagggatgggtggaggggagggcagagaagatgtggacctgggattttgttgtgtttgaccacgtggaaaatctgagtgtacattggaggatatgggaagaattattgactggtatgtagaaaatcaagcaaatgagggaaaaagcagttataacaatgggaaaacaagataggaaacatgatgacaccaagcaatgtgtcttagcagtaactcatatttatataatcatagtaatccaaacactgaattcatcaaaagttccgatgtttctatacgaatgatgtggtgggggaaagggtgatggtagcgtaaaagagctctatctttatctgcccttataaagtatgtgtagataaggtctaatagttaaaagtcacatctctctaagtttgctactttggaatatagagataaatacccaaagaaacttgattacatggcttttacagtggttgtagggggcgaggggaggagctggtagagaactgtcactttttgttagtaaccatttagtactatttaattttttaacctgttatcctgcattattctggttaaatttttaaaaataaaatagtagttcaaatgattcctcactcttccttttgaagttataacccaaaggatttctcattagtcttatttgagagtccccatcacactgatcctttttctaagtggtttggagtcatctctattgatctgcaggtttgcttcatcccatctttcactctcactcatgggaaggctcagcctaagtggcttttggttgtggtggttttcatgcttttagtagcagaaatgggactattattgattgcctgctgtgtgccaggcattatgctacagaatgtgtgtgaaaacttcaaacagcttaagtcatgatattctatttcatcagtagaaaaactccacttgagagtggtttaaataaggggcccatacgacacagctaatgactggcgtgggggtagagcttgaacaaggtagtggcagctccagagtccttggctgggatggcctcagctagacccacttagaagggcagttggtgagacaggtgtgggtaaccatgcatttgaaacgggttagagattagtgctaacatacttcattttaaaaataggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattgtaagtttcaggttgctgttgaggtgctttccatcctgcatgcgtagtgttctagtgattcttggtttatgtaggaacccctccccgccctttctaaaaaacattcacattttgttgcagtttttggctggtagagggaagggttaaaaagctgtaagattacttcatgtttattcttgtcagttatttgaagttatttccaaatgagtacctaagaaattaatgaatttgggatacatctgaagtctagaggtctaaagtcatattgaatttatctaacggtcaacatttaaaaatattttgctccagctgttatgtgatttctaacatatctagggaaaagtgaaggagatattcttaaaaaaattttttgtaaagcacaacactcaaatttgagagaagagtgatggccttgactatctttctgcggtaaagaacttcacttcgatcataggcttatcctctacccctgagttggagttcacacacagctcttatataaagagccatgaggatatggttctataaagcagtgattctcaacggagagtgattttgtcacctaagagatacttggcactgtctcgtgtcatttttggttgtcataactgggggatactgctggtatctagcggtgagaggccatggatgctgttaaacttccagtagtgcaaggactgtctcccctgatcctctagtgaagatctgtctggcctaaaatgtcacaagtatcaagattgagaaaccctacttggaagagtttaagtatttgtataaaaattatcacaatacctgaaagtttgattttaatagtttttcagtgtccctgcagcagttaattttgtttttttcctaaataatttaccaacctaaataccttctaacatacatctattctgtacttcacactaaaaatggcgattttaatatttgcaatactctcgtttcagctgtgggattaattattgccattctcatcccagtggcagtggctgtcattgttggagtggtgacaagtatcctttgctatcggaaacgagaatggtaatagttctgcatttactcttgctgttttcttcttaaaggcatgattataagatttgtaagattagtttatgtattaaataagtgtatcttttttgttgtaataagttagttaaaaaatgttttaattagaattaatgttggatttaatattaagaacatgacatattatttaaaggtcttaatagagtcaatgtgtaaattttttctactatttttcctaataatttaaagtcatagcagttactattataaaaaatatttataggctgaaatatggcaatagctatctacaagattaagcataatttaatgattaagatctcacttgccctggtgacctatttagaaaatctggtcattttaatcatttgctcatttattcaacaaatatgaatgacctcttccatgtgaagggggatatcatatcgtggtgcacaaaacaagccatggctcttatagacttggagcacagtgtgggaagagggacagtaaaccataggcatccagcaagtgtgtgcttgcagagtgtgagtgggtgctaggaagactgaaccaggtaccctgaggagaccagcagggggctacgtcctgcgagctggtcggccatggcccgtcacggctggtctgcggtacagttccaaagggtaaggagagggaaaagaatgttacagacagataattatttctttgagggccctgaaattggaaagagtcaaaccttcagagaaagtgggaggagctgtgtgcctggtgaaacaggaatgagtgacatgaggtgaggtcagcgggagctccgtgggagagagggccatgtgcatggtcacctggcaagagctgtcctggctgggtatggagccagtggctgcattcatgcttagaccagtcctcaccgaccttaaaaatgccatcatttatgacaagagaacatattttagcaatcctggcttataaatcaaaatagtaatagttgtagaactatagaatagtctattttggtaaccatattctcattaccaaaattcacatttttaaaacaactattaggccgggtgcagtggctcacgcctgtaatcccaacactctgggaggccaaggcaggcagatcacaaggtcaggagatcgagaccatcctggccaacatggtgaaaccctgtctctactaaaaatacaaaaaattagctgagcatagtggcacgtgcctgtaatcccagctacttaggaggctaggaggctgaggcaggagaatcacttgaaccagggagttggaggttgcagtgagtcaagattgcaccactgcaccccaccctagcaacagtgcaagactctgtctcaaaaaaaccaaaaaaacaaaaaaaacccaactattaaagtaccaaaaaaagaaaaaaaagacaaaataagaagggagtttagaagttacagcgtttcaaactcacattaacaaagttattttttctgtaggaatttcaagtaatacagttctttttagtagctataaatataaaaatatgataggacactgagcaaatctcatttttggttgcgtttagttttcggtcaagattaatagcctttttcttagcacagcctgcagtgtactcgtgacacgtggctatcacttttatgaccacctcggtaaaggcaaatctcatttttggctgcatttagtttttggtcaagattaatagcctttttcttagcacagcctgcagtgtactcatgacatgtagttatcacctttatgaccacctttttaaccacctcagtaaagcagtgccatgggatcacagctgttcttacatagtccagatcctttggactagatggcacagccacaattttaattacttgctttccattttcatgagatacatgggtattatagttccagaaatggaattctgtttatggttttcaagttggaacctctcagtgcattgtatagacagctgtagtgaatgatcacactaaagatcttccattttaatctcagatgtgcattaaaggattcataaatacttcaaaataagcctaatgatttattaatttattatctaataatcttaaaactattaaatttactgtaataattttttatttaaaggattaaagaaaccttctaccctgatattccaaatccagaaaactgtaaagcattacagtttcaaaagagtgtctgtgaggtaatcttttattttcttatatttatctttgatgtgctggcttctttttttaatcttttgtgaaaagtttttaacatgcaaatgtcattttaattaaaaagtattgggaaaattatatactttaaaacatctcagtttctaaaattattaattttaaattatacagtgctcttttttctcccacaagtattaataacaaggaaaatactgatacggaagaaaaaagtggctgtgctgttgtgtgaaatacagagtagtagagacacctgtttacaagcagattggggaaaaatgtgtccctttttataggaggagcattgcaatggcatttagtgctatttttaatcactgtgtttaaatttatttctagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatgtgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcaagccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagctgtccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctgaatccatgggcatacctgtgttgcaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttgtttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggttctctgtgtatgaatcctgattttaactgctaggattcagctaaatttctgagctttatgatctgtggaaatttggaatgaaatgcaattcattttgtacatacatagtatattaaaactatataatagttcatagaaatgttcagtaatgaaaaatatatccaatcagagccatccctaaagagtgttctcttgtcttcctttgtatcctctttggctccttcccttagcttccaccccagacatcagacctggggctgccttctctccctgccaaagcttgctgttagcattgtctgcttgccctcaactcctgccttgttccctgttgaaatgtatcaatcccgtactttatctctccaggacaaggataagtgtggctacagtaaaagtttattgctctaaacggcgctaacctgagataatgagaaaaggccagaagagattgtttgatctctgtctgtcaatatatatgcatttcaactgtgaccatctggatccagggccctttctaacctatataacgactcatttgtttggttaatgatgaatatcactggggctcttaagtcctttcgttctatccaagacttcattgtttttttctgtatgaaaaaagtgcagaatatcactcacctttcccctacttttggatcccctacacgaggatcactagcttaatgagaagcagagtaacgctattaagtctgggcaagctccttataagttgctgtgtgcttaaaagaatgtgatttatgtctggggccaaagcagttttccttcttttccctcattgaattcaagacagctagacccttgtgtagatcccaggatattacctctactccccccaacctgtgtgtgtagggagagtaacaacacgggaagaggggagggaagttggaaggagattggtcacatgttcagttgtctgagatactggtaaatgtgcgctgtttgtcaatgaaggttgcatgcctgcatttacaaggtggtctcatactgattgtgctctgtccagttagattcgtggcttctcccttggaagctacaattaaggactagttagaagcagaggctagatgtgttctctccagcccttactaactgggaaaataattgagaaatccctcttttcctcagtgaaagcccagtcattggttagaaaaatctaattgtcaaactagcattatgttccatcatatctgtgggatagtaattcatgtaagacacatttttacctctcttacaagtcaattcacttacaagccagtttcaaatcaagcttcccttgcgaggaatggagatcattatggggcttattatgactacatttcttttatgagtgaccattttaaataattaatattttatttaatattaaattattaaagacttagctagacttttaacattagatgaaccttgtgaatcatatattgcatagattagcacatgtatgcaatctaggtcatcaatttgttgaatttatacagccctagatttgagattgtggccctgagtatctggatagttgagttgtgtgtttatgtgcttatatgatagaggtgctttgttcctgcagcttagaaacagaagcagccattcactgagaagcttaagagaggaagtatcaacctcattttccaaaccagcattactttcaccgctcgtggatctgaaagattacatttagaacatttagtactattacactctcagaaactgtggtaaaaagtcacattttcaaaacttcatgcatattgtattcttgttggaaataagtcctatagtttcttaattgtcttcatgccgtccatatttaacaaacattgcaagtcctttttatatttgggtaattatttgtaatttagtgaaggagactaggggatgttttcttccaaagggaatttaaaatcaattttatggtattttgaaagtaaaatactccttaacgtgtcaatatttttaaaatgttatctcgaagttttctattgctcaggtatataatctaataaaattttttgtttgctctaaggttatttttgctattctctattttgaattatgttaaaatttgtgtgcattttatgaaatgccttttttcttattttgaaagtgtaaaattgggcatctcagagtaaaatgtgggattattagctacaaagactaggcaca

SEQ ID NO: 12081 - DNA, 146438 bp, Human
  misc_feature (1)...(146438): n = A,T,C or G
cttggacccaggagttggaggttgcagtgagctgattgcgctatgatcgtgccactgcactctagcatgggtgacagagatcccgtctcaaaaaaaaaaaaaaaaaagacaagagttgttacagaaatctttccatcatcctaagaaagagtacattaaaagggctgtgccatcactggagaaacttccagttcctcctctctgttcacatgcatagagagcctgcagcttcccctcagtcactggctcacctgagatttctgcagggatggtttcgttgaaaatgaggctgtgtgtataaaatgcctgcaacatagccagtagctagccagtaattttctgctacaattaaaaacacacaatacaaaatgtaccaaaaatatgaatcaagaaagcttgataagaggttttccaatcatatttgtctcagacagtactgcagaataatatggaaattctgaagtaacaaaagggaataaaaagttgaactcagttttgttatacttttgcataaggggttccttacatgtacctcaaaagcagggacttgcgaggaggctgcaggctgtgtgatggctgtgctcagctaggcacctttccatcatctcaaatccgagaaagaaactcaaaaagcctaagaatctcgtttcagtacaagcttatgcctcagggacaatcactgtcggtttcacatgcagacaatagtgagtgaatgcaaagaaatggtactttcctacctgcatttaaaaaaagaaagaaagtaaatctactccccctccttttttgggaacatggactggcccattgtggttgctggtgtgttgaactagtaagtaaagcgaggagaggaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggtaaagcggacattgcacaaggtgacctatgtcctttgctttgcgtggcagatgtgagatttctggcttccttcgtgaggtcggaggccgctcggatcctccaaatgtggtggctggatgctggcgacagaagtcacttttattgccctgacatacatttatgtaaactttttgttttcctgatgatacaaaagaaacgacaggagcttttgttcatcgatacagaactagactgaagggcaggaaaggctggttatttatttcactgagaagtgtagtgcgttgaccttttaaacaaggcttatgtttttttaggctgctacccgcaagattgaaaggagactgtggttttcagactttggggttgttttgttttgtctgtggtttgtagagctctgtgaaatttacatttgagtcctgtttgggggatttggtggtggaagtggcacgtgggaatgagtagatttagctattactgtaaattatgagatttttttttctttaagaaatacccaataaatgaaaataaggaaacaaaatgtttagatgttattcatgttttattgcggctctaggttgaaagagcttgacaattgcctctctttccacctttgaaatgcagtaaaagaaatctagagattctggcctttatattgaaaatagttttcctaaaaacccagttattaatcgaatcatactgtaaagactttttttggggggaaagtgttttaaaatgtgctatactagcatgaaagaagaaatgggaccagaaagttatttcatctgtgaaaaaaatagatttatgatgttggaaaagaaaaaaagaaaacgtgagtttggccataagccagcaggagtgtggtcgctatagcagcttcatttgtcacttagctgagattggagacttaaaagaaaactgagcctgtttttctctcagacagcctcataaggaatgttaagaggatgtgaagttatttagattaccaaaacaggttctgacaagtaagtgaaaataactcattaaaatataattgttgccattctataaatggatcaaaaggcttgttgagtcactgcatacttatagaataggtgaatttgccacggctcattggtataaattacttttgagaaggctttttaagactaagcgtgaggccttgccaagcatcccttataacacttagaatgttttgaccaatgttttcgaggcggttgcctaagcattttcatgtgtcagtgagtctaatcctcgcatcagtggcttatccagtaagctcagggaatattatatcctgacaacagaagcctgcagatttttctcttcaactaaacaatagctcacctaaaaggacagaaagtgaactactcagttcttgtaacctgactttctggagggatggtcatgattttggctcctgtagaacagggtttctcaacctcagcattattgacattttggatgggattatagtttgttgcaggggactgtctatgggatgtctagtagcatccttgatctctacacaccaggcgacagtagcactccctccccagctgtgagaaccagagatatcttcagacactgttaaatattccctgtgggcaaaatgcccctggttgggaatcactgctagagggaaacctgtcttggggcctactgctgccaacgagggggaagggtctatgagaggaggctggagtcccagggaggcctggcggggtccaaggaacagtggcaggacaggtgtttttgcctgaccatttggtttttattttgtttgggttttgtctgaaatcacatcttgggaatggggtatcagattcaaggacttgctgcggatatacattcttctgcccccttttccttctgtgcccttgtgggacttattttatacagtgctatgattggtatagtagtcaaacttctttcaattgaattctaaagtgcattctggggatatactattttgtctttttttaaaaagaagcttatacagtgatccattttataaagcaaatagttacccatacttttcccttctgtaaatatagatttttttgttgttgttgttgtttgtttgtttgtaatgtgggtttttagtaaatctggccatgcctgttagtttttttttcttctagaatctgcaagtgaatgctttcatttcttttttcttttcgccgtctgtaccagtgggtctcaaactgctttgatttttttaggaattgggccttgttttgtgagtgcaattgaagaatcacagcttttttccaatttacagataacgatgaagtcaatggctgggattttttccgtttaaaatttttcttacacctttagcattaatgctactgcttgtttgctctcaaaggtttacagattacaaaatgcatgaagctgcgagtgctgctttttcttggtgtttctccaagaatatagtacattgcactgagcaccgtgacttccaggagctaccaccaccacccaaaccagatgagatgtaccactgcatagtgcttagtggtgcttagcattggctgaacagatagggaaacaccttgacttattgaagtctattcttggtgacagacctggactggcccataatgttatcagagagctgtggtttctgcttttgattgcaaagcaaatcttgcatttatctccacctggaggtaccaatgtgacacacaccatgtgctctctaagtaacagttcttcgtaattaaaattcaccctctccccccattcagtagaccaaagatccctgagtgcagcaaatgtgagcattttaggtctatttgcccccaggatatagcacagtgcctgctcatactatttgctcagtcattgatgaacagacaaatgaatgtcaatgatttctatggaaagaccacccaggagcttggtcagcaagccacatgtctgcagcctgtgtccatatttctgtaattttttaaagaggacaaatccagtcaccatctaagcaggttttaatgtctgaggggctaccagaaaactctttgaaggatgcaggaagagtgggtctgtgggttgtagaatttgggccttcataaggcccagaaattaaatttctgctcttattataaaccccacaggttaatgcttcttcatggtttcaataagataaagagcacactaaccatagggtctgacccaaaggcaaggtatttaccacctctttaagaaaactcgccagttgaaagagcttatgatcagaggtgaaaaaacggcccttgttgatctatgtgtcctgtggggagtcaggtggtgctgcccagagaacctacctggttctctgaaccaggttatcagggcaaggggggtgcagatggggcagatgtcttgaaattggaagtttccagactgtgcagaatgtaaagatgccgtagtgagagacagagaagccaaagatcctctcaatctcttgctttggttcacaaaccaaccccagctccatggatttttttgttttgttttgttttttgagatggagtcttgctctgtcacccaggctggagtgcagtggtgcaatcttggctcactgcaacctccacctcctgggttcaagcgattctcctgcctcaccctccgagtaactgggattacaggtgtgtgccaccatgcccggctaattttttgtgtttttagtagagatggggtttcaccatgttggctaggctggtcttcaactcctgacctcaagtgatccacccgcttcagcctcccaaagtgctgggattacaggcgtgagccaccgcacctggcctagctacatgcttctaagcagagccctgggaatgagcaagcgtgagcctttcttgtaccttaagctgcagaggcttaaggtgcagcctttgacgggaggggaccttcatcaaagaggaaacaaaccctgctgctttattattcgccaagcctggaatgtttttagcaaatacgtgtttgtgtccttctcagcattgctggttcacactgaggccatttgttgctcataaacactagatgaagcaaaaatacttgtttacacttaagactgcttttatctttccttactgctgaatagtaattttttactagattgtcttggttctgtgcagctggttccttatgtctgtgctcatatccgtataccttgtccaaataaacatacttgaaaacatagagaattgtgttttgtgaagtttagaacatcctctaacagagtttaagctgagctttctgctttgttttggcaacttgtttaggatgccaaatgtatctggtctggcaacagatgaaagaagatgttggcccttatataacgaagtttagggaataagtggggggtggggtggattgccaggtttcctttgtggtttgaaaagagttctaaagcatgaggaaaacatgtgttcgactgggtttttgttttgcctttaaaccttggaattttgaaaatctgttgaaatatcttctcctggcttatgcagccctctgagattaagtttctgattacctacatcttccctcctctttcattccagccctgctagccttctttctgcccctcaagcacagacactgtccatctctgggctttcactgctccctgagcctggcacattcttcctccagatcttggcttccttctcattattcaacctgcctcttttgacttggagaggtatcctctaatcacctagctaaagttgcttccacctgcccaacccctaggccatcttctctcccctggttctgttttaggttcttcatggcactgttccccgactatctggaattcttatctgcttgtatccatgtctagtatctgtcactcattgcaagaatgtatgcttatgacaggtactatcatatccccgaaactaaaacatcatctgatagaaggttggtgcccaataagaggatgagtggatggatagaaggatggatgaatgggagggaaaaggagagggaaggaaggaaagaaggagcggggaaaggaggggggttgactaccgagtaaatttctactctcttttaagtctaagagcttctctcctgtgattcctctttgactccccaagacagtagccttggagaattttctccccacacccacctcactttgtacattacactaaccatcttatccagttacagtcacctgtttgctaagctctgcatactaagctcttgaggacaggaatgtgtaataaaggtggttatggttgtaattattgtttgttcttattgccttagcactttataagcatacttcatcaaagtcctttcatcaactctatggcttgagtatgactctcatctttgttttgcaagtaagtaaactgaggcccagagcagttgccgaaaggcgtacagatgattactgcagggccaggaattgaatacagatttcttcttggtagcgcagattatacagcctttctttcctcctcatcaggtgtccagtgcctgacccacaggttcatcacaggcttttgccaaatgaatgaaacctaagacctcacctcctcccttctcatccctattatttgagcttatacatattatttatactatttataaacataaacatgagcctatcagttcataatccagtgacatctctaaggataactagctgctgtatcttaagtcacttatttttattgtttttttagaaacagggtctcactctgttgtccagactggagcacagtggcacagtcataacttactgcagcctcaaactcctgggctccagagattccctgcctcagtctcctgagtcccgggactacaggtgcatgccatcatgcccagctaatttttttttattattattttttagagacagggtctcactgtgttgcccaggctgctctcttaactcctggcctcaagtggtcctcctgccttggcctcctgaagtgctgggattacaggcatgaagcaccacacccagcctacgtcatttttctttctttcttttttttctttttttaaccgataggacgtcattgattgcttaaaccctctcattcttcttatgtaaacaaatctattagtcaaaagttaagcagctgctgagtcacatggcactttaatccagggttacaattggcagccctgggaatgagttctcctttttttagctcccacgatggcactgatttcccctagaatatgaaacttacaccaaggaaaccaccatgacaactgtaggtagcaatttcaagcagaaaagactaggaaaatgcctaagaattttaaacctgacagagttcttctacatttttaatataaccaagtgctgttcatcacctgccttgacaccggtgtttgtgaggttgattggccccaggatgttccactgcagaacagaaggccaagatcagaagcccttgtcgacatataaatgtaatgctgtaagctggcttggagctgtgactccatggagccaattctaaaatgattaagacttctgtctatagagagttgaggtggagactgtttactatggccctgcccagaggcttcagcagctgagggtgtaccctctgcagtgggagtcttcaggcatgagcctgaagcctgtgctggcctctagggatggagtcccttgttgtcttacagcttgaattttccagcacaggacaactccagatgacagctccaacagggcagaggctgcagccttgccagactggtccgtcaaagctttccttggcacataatccagtttcacccaggtttgggggtaacccagctggttccttttttcctgggttggtggtgagctaagcagggaggtagtacccacaggttatttatggatgtcaaaaactcaaaaggccctcagcactgggggtaggaccagtgagaagtgctcaaccatggcatgtatgagggatctgtgggcgaaccctgatgtgtcatttggctcctctatccatcacaaagagcagggacccctgaaccctttaaccatccctgagcaagattggagggatttttgcccttttaatacaacttcttaaatggcctgatggccttggatgtactcattaataaatatgtcttgtggtttgcaatttaactgtctgtgtgatgaggatattggaaaggagtttctgactgattcattgttcacacttgcctctcccagccgagggataattggggccttgcctaatctgcactcgctcacacccaacatgtgctgggcggggaaaaaaggctgcaacctggccggctggttcccggacctggccttgcaccaaccaggaagatctcttctctacctccttttctgtgttcaaggtgatacctgcttaggactcccagaaatatcattagcaggaaagttccacagatttaatctagtctaaccctctgagagttgaggacactgagacccagaaaacctgagtgattttcctaggaacacacagcccattggttagtaaggcaaaagtagacctcagagcagctcagtgcttctctatcccctctgcacctcccccaggctgcctcttgaactacttctctgcttgctgtacaaaccaaagctatctttcaaagtcttttggaatattaaagccattacagggaggcagggtgtgtggggattgagtagatattcaaaagatttttgctcaaacctttatttcactttgtttttaaacaacttccctttcccatgcctatggagcttttcttgtctcatcctaaaaactcccaagttcccacctgcttctaggaagattgttgatgattgtccaggcatcccctgccactgtctgagcagacaacttctaaaagtttttttttttaagtagtgtgagctcatcgtaaataaataaatgaataactgagtaagtacacttgtttgtacttctctgaatcacatgtaatgggccagatagtacatattttcagccttgtggactatgctgtctctgtctcagctacgtatgggctaaagcagacctagagactatgtaaatgaacagacatggttctgttccaataaagccttatttacaaaaaacaggtagtgggccaggtttnnnnnnnnnnnnnnnnnnnnaagtgtacttattcagttatttatttacaataagctcacattactttaaaaaaacccactcccagaggtagctattgttgagagttgggtctatagtgtcactggcatgcagatacttacaaatacggggttggatcatgtaaattttttcatataggatgtagagttctgtatcttgctttgctcctgtttcttgcacatagatacctgtgggagggcatgtattcttttatacaaataggaccgttttatgcatgttgttctacaatttccttcacttggcagtaactcagtgttgatgcttataggatgatgacattctttttaatgaccacatagtggtaaaatcctttaccatacactaagaaaacatgacaaataccaaaaaaaaaaagtatgtgtgtaaataactaccagcagacacagatgatgtcttgttcgtctcacatggtcccatgtgtctggtgggcacatccacggggatccatgtcagcccgtgcagcgttactatgtttccaaagggggttttgtttcagcctaactttctgccagcacagcaccacatacaggtgacgagctaataaaagatttgcatgacgaggaaggtttcagacaaactttagcttcaacattgtggttgattatgaggcaatttctgtgaaatcctaaaaatcccaagttttttgtcctgctgtgaacacagtttatcgcaaaaaagtacagacccacattgtactgtggcccccctccccgccctttaaagtatgcgctgtcgttgatgccttgaattcgttcctaaggatatcatagatcaccacaaacttggcagctcaaacatgacagaaatgtattctgtcacatttctggaggcctgaagtttgaaatcaaagtgttgtcggtgtggagtgggggttcttctgggggctctgctggagggtctgcttcatcctgtcccctggcttccagtgctgcagcatccttggtgctgcgtggcttggagctgcatcgctccagtctctgccttcatcttcatgtgggtccagcttgccctcttggtcagtttccttgtcttgtctggtcccgtcctgtcctgtattttgtaaagacttgtcattggattcagggcccacctgaatccaggatggccttctctcaacacccttaccttaattacatctgcaaagcaggttggacatatctttgggggaccacagttcaactcagcccatgccctcccatctaaaaatcggagtgcttgctcttccctctcaggtttttcctcctggaggtgaggaaaggggcaaaagccttgttcttgtcgtaatcaacagccctgctctttgaggataaaaagcaacaacaaaaaaaaacggagtcccaaggaatggcatctactattagttaatcgcaggtcccagaaaagcaccagccagaactgcaagtcttctaggaaatttcttactgaattcagcaaaataagaggctaatgagaagagtgtttgcatatctgatagtctaactgaaaggaaacagaggaagaaaaatgtgcttttgtaagccctgagagttttagctgaatggcagcctttccctgtgattaactggcattaattattgtttcaaagagtttccaaggttgactgaatccagtgtgaagctcacaaaaccaacaccatctatttgttttatttctcaggagaaagttatattaatgcaaaaataaagaattgtggctgggtttgtgatctgttttcaatagtttctttaaggaagcagctgttttttgtgttgcacagggtacttggatgcgaaacagtttttgttgttttggctttttttggagacagagtcttgctctgtcacccaggctggagtgcagtgatgcgatctcggctcactgcaacctctgtctccccagttcaagctgttctcctgcctcagcctccctagtagctgtgattacagccacacactaccatggttggctaatttttgtatttttagtagagacagggttttgccacgttgaccaggcttgtcttaaactcctggcctcaagtgatctgcctgccttggcctcccaaagtgctgggattacaggtgtgagccaccacacctggccgcaaaacattttttatgtttaaaattgatacctgctcacctcactcccttagacaatgtttaaaattgatacctgctcacctcactcccttagacaatgtttaaaattgataccttgctcacctcactcccttagacaatgtttaaaattgatacctgctcacctcactcccttagacaatggctttggtcgcaagggacagaaactcacctcaaaccagctgtattttggagccagcataacaaagcaccactacttggatgttttaaaaaagacaaatttaatttccaacagctctggaggctggtgaaatcaaggtgtgggtagagccatgtcctctctgagccggtagaggaagatttaccctggcctcttccagcttctggcctcttccagcttccttgcttatggcaacaaaacaccaacctctgcctctgtttttgcttagagttctccttgtctgtctccctccctcttctgttcttataaggacatcagtcatagtggattaacagcccaacctattccagtatgagctcattccaactaattaacatctgcaacaaccctatttccaaataaggtcacacgctgaggtattgggagttagggcttgaacatatctttttgggggacacaagtcaaccagtaacatcagctgaagcagaaaagaggctcacatagccaagccgctggaggggacagggccttagatgtcattagcatcccgtcagctctgtctgcttatctgtgtgtgtcattcacactcacgaactcactctgcatgaaaagcataaggctgcagctcagggattctcaaccatggtggaaagggctcttgtacccccagctcacatcctgaagtcccaggaagagattccatcggaatgtcacctctccagctctagaccattcactgtggccagggagagggtcacgggagggaatggcagcttccacatctggatttggggaaagatcccactgccgcacaccaaaagcagggtagccttgacatggccgctgcgggaattgtgagctcagggtagctggcccaatttgtgtgaatctcagaactaacctaattcgaatgcagcattgcagtcacgtgtcacttaaatgacccttgtcatgacttacctttaatgtgattttatgcacgcgctccttctcacccatcccctgctgcattgacctggactaaactgctttcaggttctgggagatctcctcagaagttgtgttagatttttcatttctctggaaggtcagtgcatttgcatttgggcagaaactcatggtgactatactaataatttaatctttagtctcaaaggacaccatggtgggtaggtctcaatgacaggcgcttttcctctcttttttagttttcaatctgaagcttttaaacttccaaaaagaatcacagtagtgtagaaatagtcttaacttctgctaaatggcctgtgggaggcctgcttcctgtactttgaataccttttcataggttttcatgcagtctgcaagaaaagacagttttatttcaactataaaaattaattcaggttgagagtggtggccacgcctgtaatcccaacactttgggagatcaaggcaggaggatcacttgagccgaggagcttgagaccagcctgggaaacatagggagaccctgtctctacaaaaaaaatttttttaaattagttgggtatggtggcacatgcatctgtagacccaactacttgggaggctgaggtgggaggatcactgagcccgggtggtcgagtctgcagtgagctgtgatcacgccactgcattccagcctgggcaacatagtgagaccctgtctcacaaaagcaataattcaaaggaatgactgcagaaattacaaaaacagctgataattcagaatgctcatttcactttattttttttttttttttgagacagagtctcgctctgtcacccagctggagtgcagtggtgcgatcttggctcaccgcaatctccggctcccctttccccctcccattcaagtgatccgcccaccttggccttccaaagtgttaggattacaggcgtgagccactgcacccggcctcatttcacttaattatgtttgcttccagctagtatcggaaagcaacttttttattctgtgagtcttaggtgagcagcagtagagaaacttacctgagataactaatctgtagatcctaaaagtgatgcttgtggagcctgtaggacagatgcagttattccttgagtatagtcattgagtgatggtgtcatgtgaaaactttgcaggcttggatgatattttcaggagtatatgtatcttggaaatttgcagtatgacccaaacttggcacatcttaatagtcaataagaatttgcaggggcactaaatccttgctatctctctggcaaaagatagatttcttggtagtgttggcatcgacacctttcatggaaaaatcgattgcttgtatctactagctctgtgctagacaggaagcactaagaattcatttggtggttctttcattcctggcttatgagggataccctttgctcctacccgccaccaaggtgaattcaccttgaccctgagcataccagcacacagaccaagttgggctttgattgctggtcatttacaataggttagaaaggggtgagctgaagcatgtcgactagatgaaattgccacagtgtggtattaacctgctcaggataaattgagtgtgaaattgttactgccggatgttgcttgccagtggggtttctttttttttattttcttttatgtgataaatgtttttgcttgatttaagaggtggtagaatactggctgttactgaaatgaagctaatttcttcctgttctgagccattatagcatatcttgcggacatttgaaacacatttttctcctaagatagctgcatttctgaatgaagaactgatatgctttctttctaaattcatcacatttctttctaaattcatcacgtttatcagttaaatgtacaaggggtaagaaatgaattttcagcagattgttgtacctgaaaaattacacagaaaagtaactttaggtgagaaagtatctggtaagtttctcaaaggtttaggttttctgggtctggtttggtttggtttgctggggaaagggaggatggatggaggaggatggatggagagtacaggtgactgtcttcttgactatagtgtaagtgataggaaaaaactctcgagttttggtatataagtaataaaagcaaaattcggcttgcttgcttgctttctctctttctttctctctttctttccttccttccttccttccttccttccttccttccttccttccttccttccttctttccttccttccttccttccttccttctatctgatggagtctcactctgtcacccaggctggaatgcagtggcacgatctcggctcaccgcaacctccacttcctgggttcaagcgattctcctgcctcagcctcctgagtagctgggattctgggtgcacaccaccacacccagctaatttttgtatttgtaatagagacagggtttcatcatgttgcccaggctggtcttgaactcctgacctcaagtgatccgtcctcctcgggcctcctaaagtgctgggattacaggcgtgagccaccacacctggcctggattctgctatccttctaatcccaatttacaagttatatcttccgtgaagtcctgcctgaccccttgaattatagttagacattgtcccttcctctggattcagaagcaggatctttcactcaatgaatgtctattgtccacttactatttgcacacttcgagaatgcaaagatgaataaggttcctacgtaaagccttttggcttctctgcagactggtccccagaggaatcagcatgtcacgagtgaataagaggtactccgtgagtgcacattgcattggattgtaacacattttctttccccagttcgctaatttcagccctttttacgcacaggaaaaaaacatccttttgtttgggctcctgtctttaatagacccattacttttggaataagcagcttccccccaggaaagttcacctgagtcatcttgtgctcagcacgactggcctgcagcaaggaagtggtaccaagcagctttactgtcctaattggacagaaggaaattgacttgtcttggatggggattatccaggtctttctgctccaggaagacactgagagagcatctgtccacctgagattgtttgttgatgagaaagtgatgccaccgtgttcaagtttgagggaactgcagagcaagaccttctgggtccacaggaaagagaggtctttaaacttaatgatgctccgaacagctggaaggggaaactggagaatatggacagttggcttttctgctgagagttgagactagtctctacagatgacctgtttgatgcaaactgaaagaattagaacaagtctttgccaaaatatacactgggaacaaaatgataggaaatgggacttttctagaaagacatgagaaggggccaggtgtggtggctcacgcctgtaatcccagcacttagggaggctgaggcgggtggatcacttgaggtcaggagtttgagacagcctggccaacatgatgaaactctgtctctactgaaaatacaaaaattagctgggtgtggtggtgcatgcctgtagtcccagctactcaggaggctgaggcatgagaatcacttgaacctaggaggtggaggttgcagtgagccgacactgcaccactgcactccagcctgggtgacagagcaagactctgtctcaaaaaaaaatttttttaaagaggtgagaagggtataaaaaaaattaaaatgaaaaacattgcttagaatagaataaaatctcgtggattcagcaatacatcttgctcttaaatatttgttctgccattgttctgtgacgttagaattttcctcagtgataaacttacattttttgtatactagtttgaggtataattgattctataaacaagaatttaacatttcattcttgtactatgttaactgattatataattatacttataatgtgcgattataaaaagacaacccctaccttaatggaacttaaactttagtggaagacttcaaagatattgataagttcaaggcactaccttaacagaataaataaatgctgtaggagcacagaggagggagggaacacactcagctaagactgaaaagaccctgtggcagggcacaatggctcaggcctgtaatcccagcactttgggagactgaggcgggtgatcccttgagcccaggagtttgagaccagcctgggcaacatggtgaaaccccatctctaataaaaatacaaaaagttagctgggaatggtggtgcatgcctatagtcccagctactcaagagactaagatgggaggatcacctgagcccaggaagtcaaggctacagtgaaccaagatcgcatcactgcattccaccctgggtaatgggagtgagaccttgtctcaaaaaaaaaaataataaaataaaataaaaataaaatccctagagaaggtagcagtagaagcttggagcattggtattttgttatatgaaatagactattttatacaaaaaaatacctaatatgtgttcaacgcccattagactctggaaatacaaaaaatgaatgagacaatgtccttgttcccaagaaattaaagtctagtggggaaaaatctgctaggtagccagcagttataattcattgcattatataaatggcatgtgctttatatgaatatataaatgtatattcaagtcaagaaatacatgcaaatcaaagaaaatgcctaagtccaggggagctggagaaggctcatttcagtctagaagttttcaacctgggctacaccttgcaatcactttctctagaggggccccaggcaactatacttttttaaaactaccctgttgattctaatgcacagagaagtttgagagtagcttctctcaggaaatttaagatgtgggaaggtataggcagtgatatggtttggctgtgtccccacccaaatctcatcttgaattgtagctcccataattcccacatgtcatgggagggacctggtggaaggtagttgaatcatgggggtgggtcttttccatgctgttctcgtggtagtgaataagtctcacaaaatctgatggttttataaatgggagttcccctgcacaagttctcttgctggccgccatgtaagacgtccctttgctctttcttcatcttccgccatgattgtgaggcctccccgtgtcagccatgtggaactgtgagtccattcaacctctttcctttataaatgacctagtctcagctatgtctttattggcagtgtgagaacggactaatacaggcaggttaacatatttgaggctgacgcagagcccacatggccaaggcatggatgagggtgtggataccaggtaggcaatgaaactggacaggtagattgagaccagactgcagagggtattgaatgccaaggttagaaaacttaacttttttcagtaggcaatgggaagacattcaggtctttttatccagagtattgtgatctacatcatatttaataaaaattagcctggtgttcagaatgcacatctttgggagggagggagaggaagaggttgtggcttgtggtccaagtgaggccccgaggcagaggaacctcaaaggattgggaagaacagcacgggaggaaggataataagagcctggagaccgactggtgggacaaggggagcaaagagctccttggttgcctcaacaaataccgcctgagccctgactgcttgaagacacgaatggccacaaagaccagggtccagtaccttggaggctgctggcgcctcaccctgactcgtcctgggagtcctttctcacaccgcactctccatgctgcttcctcaccagcacttgactgtatcaagcagtttgccctccttatgtgaccctggttgtcatagcctgggtagctccagggtgtgcggtttagagttgtcttttcctcctgctctcctgagctgctctccgcattctccatacgaatttattctcattctaaatttcccagtcattaaagacaactatgtgcctctctttgctcatctgtaacatggggatagtaatggtaacttgatgttcctatctcatgatctgttgtgagtatccagtgaggagagatatgtgaaagtactttataaactgaaaagcatagcacagatactgactgttgctatcttcatctgtttgtagaactttcaattaaatacaacagtttagggctcagggacaaagtttaatcactgtgtggtgaccactctgtcaatgcagtattttcctatataaggcttgtttaattcacagtaactgccaatgaagatgtcctaaaccattcccattttactctttcttatttttaaaaatatttttgtgggaacgtaaagtcaaggtctcactttgttgcccaggctggaatgcagtggagagatcatggctcattgcagccttgaactcctgggctcaagcaatcctcctgagtagccaggactgcaagtgcgcaaccacacatggctaatattttgaaattactttttatagtgacagggctttgctgtgttgcccaggctggtgtccagctcctggcctcaagcaatcatcctgcctcgacctcccaagttgttgggattacaggcatgagccattgcatctggccaatattttttatcttttttcaggaaaatagaattttggagctagaatgtatcttaaaggtcctttaatgtaaccatctcctcctgcaaataaggcgcctgagaaatggagatattaacccagcccaaggtttcacaagttaggacccaggtttcctgacttcatcctagggctctttgacctggaaagttcttcctttatcactggggccatctcctaaacagggtaaatttgtgatacgtttgtcccactcaggtagaaaaaaaattttgtaatgtcatgaaatgcaacaaagcctggtatttcaattgaatgcccttaaggctcagtaaagggtttctgagtccagactgctgagcaacggggatggaagcctggcccaagaggtaccccagcatttctttgcagagcagctgctttggctgggaagctgggcttttctttctttctgttgtcagaggaaccagctaacttagactaaggtcagcagactttgccttggagtacctggatgcctttactccagaactcaggggggtctgctgccttgagggacaacacagacttttcatcagcctaggttgcacagcctaacacttggagggtcaccccaacagccatgtgactgtacacagtggaacccacagttcacaaatcacctgttgatataagtgggttgggctgtctcccttgagtctcagtgtccagccatggcacggtccctagatctcctctaacaggccctcctgtcacctgactgtgactggcgcctggtacagcaggtgtggctggcagggtgcccgtttgcacagcactccctgcttatcctggctcaggtctctgaggcctgccctttcagaagaatccagacgacttggggcagggcaggcacccacccagcatgtagaggtctggaatgtgaattgtgtgtctctttctttgtgggatacagaaattctttggttgtcatccaaaggtgtaagccttgccttaaaaatattctcatttggggcattgccaagcctgggggtcctgaattctttcatatgtcttcgttccttcttcagatttatttttcagtcggttttttgcttccttttcatgattggaaccactactcaatgattgttagatacaccactcctcactgttcccagtgaaatcacagaatttgtgctaggtaaattccaggctggaaggcatagttgtttattaaaggagatgaagtccagccacaataggagaggaaatcagacaaggatgtttttaaaagcaagctgtgtttttctgactgctccaatattcattcccaccctgaaggctcctctaaccctggggaagaaaaaatatttttagtctgatagtgtactatagagctgaaccatctgtaaaacagtcttgataactcagaggaatggttttagtggaaataacttgtaaaggatcacccaagactccaaagctaaggcatcaactacccacagagcaccggttcctacccagctcccatgaagtcctttaagatttattttagaaccattgcagccaaaccagaaattgacaagtgggacttaattaaattaaagagcttctgcacagcaaaagaaactatcgacagagtaaacagacaagctacacaatgggagaaaatattcacaaattgtatatctggcaaaggtctaatatccagaatctgtaagaaacttaaacaattaaaaaataaataaccctatttaaaactgggcagatacttctcaaaagaagccaatttgcagccaacaaatatatgaaaaaatgctcatcatcactaatcattagagaaatgcaaatggaaaccacactgagataccgtctcacactagtcagaatggctattattaaaaagccagaaaacagatgttggtgaagttgaggagaaaagggaacgcttatacactgctggtgggagtataaattagctcagccactgtagaaagcagcatgtagattccttaaagaacttaaaacagagctaccatttgacccagcaatcccactactgggtatatacccaaagaaaaataaatcattctatcaaaaagacacatgcacttgtatgttctttgcagcactgttcacaatagcaaagacatgcagtcaacctaggtgcccattcatggtggactggataaagaaaatgtggtatctatacaccatggaatactacacagccaaaaacggaacaaaatcatgtccttcgcaacaacatggatgctgctggaggctgttatcctaggtgaactaatacaggaacagaaaaatacctcgtgttctcacttatgagcaggagctaaacattgaatacacatggacacaaaggtgggaacagtagacattagggactactggaggggagatggtgacaggggaagtgggttgaaaaactacccatcagttactatgcttactacctgggtgatgggatcattcatacaccagacctcagcaacatgcaatttacctatgtgacaaacctgcacatgtaccccttggacctaaaataaaagtcaagagaaaacaagacctttttaagaatagaaatactgaggaaggaaataagagcagggtgggatgggaaaatatttataattcatgggggaaggagagctatcacagagctggaatgtactttagagatagcaatatggtgacgaaaagcagttgacaaactagaatcccactgaattgggatcagccatttgctgcatactgtaaaacaagtttaaacatttttaacttaaaaagcctggcttctgaatgcttattgcaacttacaaagtcatgactaagatattaaataaagggcacttgttatgttatctgatactgccctattccttcccaccaaatgcacttaattgtactatttggcaactaggagatgtgtattgagaactgattccctcagagcagctggcatgggagcgattctttggattgctgttattgtgcattcctgactccaacatgctattgtgttggaaaggaggccaggaatgaggtcatgagtaagaagaaaccttaagtttttgcccttgcacaagagacaaaaattatccaattggagttagatttcaagagtgttgaacttgaaggcaaatatttatcttctggtgttaagaaaggaaaggatgtgaaacctttgaccttgagtgttagggcagtgtctgagtttggaaagcagttgtctgaagccagaagcatgatgaatttctcattgttccttccctggaactatgctaatattttttaccacacgctgagcagcaccagccgacttaatagcctgctcaatgtcacattccattggatttggggtctctccctctggggtccaacttcctgaagatacccctttagaattctaggtaagtgtttggaaagaaaatggcttagagtcatctggtgttttgcaacctacttcatcctctctccatgtcatatgactcaaagtgaatttataaagaattaacatttctcttatctacacagcaaccttgcaagctaggcagaaccactactttatacccttttaacattatggaacatgtagcttttcatggtctgaggatttttcagaaagtacatagcattggggcatataaacagctaagtccaggtatatccagtcatcctgaaagttcagtccagcctaacagattgatcagacctccccctttttatcattcttgatgtacatgcagaaactggggtagcccttataacacgtcaaaaatcaaacaaaccattgtttctggtcccagggaccagaatcgttttcctggccacattttcaaattatcatcacttaaagtgacttgctatttttcaagggatggccttaggaagatccactggatcttaccaggcggttagcttctgtattccctcatgataatttatggaaggaaaaaaagaatacttactttaaactgtccaaacgactaaagtaatttctagttcttctgagccttaacatgtagcaggatgttgggggagtggggaatggacttaggagaaaaccttagatttgaactctagctctgtaactttggagacttttcttagcccacagacaggcataagaataacaggcgcccaccaagtgttggatggattaaatgtgaacatactttctaaacattcaactacagaacaagtacaaagggtattgttaacaaaagtaattgataagggaagaaatatttaagctcaatcaggagaggaaaaagttgatcgtttggtaaccaccgccaaagtcctcaaacttctaaacccaatttttttgtgttttcagtgagccttggtcctgactagaagaagccaattttgaggcttcatgacaaacacttacagaaagttatccaactattgcaatgtcaacccttgcttgctaatatcaggtcaatttaggaattaaatatggaggttattcgcatgccatccatgtctctccatcagttcaaaggataccagcaacagaaggatgaagatgaaaggaggattgaaaattgttcagtggcactctggaggtcctagaataatggatacctgatgagattaaactgcacagcttttacttagagaccattttataaagatcattcacttcacagaggttagaaaaacactttgagaatccatttggcaaagtgctgttaatatgattcttcttacttaattcctttaaattcctcttggattaaaattgtaatacaaagcaaaaaccactttggaccatggtttggcagtagctactgaagcgaaacataaacatatcctatgaccttgccacatactctctattcccatgcatatatatgtatatatatacaactgaaatatgtatataatttaccaaaagacatgggcaggaattttcatagcaacactattcagtacagccaaaaccaattttttttcttttttttcggagacatctctttctgttccaggctggagggcggtggcatgatcacggctcactgcagccttgacctcccaggctcaagcaatcctctcacttcagcctaccaattagctgggactacaggcatgtaccattatgcctggctaatttttgtattttttatagagatggggttttaccgtgttacccaggccagtcttgaacttctgggctcaagcgatccacctgcctcggcctcccaaattgctgccaaggcatgaggcaccatgcccagaaaagcagccaaaatttttaagttacccaaatgcccatcaatagtagaatggataaataaaatctagtatatttccacaaaggaattgagatttagtgaagtatgactacacacactaacatggataattctcacaaagtgttgagtgaaagaagtcagacatatttgcttctattgatggaaactgaaaacaggcaaagctagcatgtggggttagaagtcaacatagtgattggaaggcatagtcatcattggaagaggacacaagggggtttcttagtgcagataatgttcttttcttttttaatttgggtgctggttatagagtatgttgcatttatgaaaacttatgaagctgtgcacttagaatttgtgcatttttctcaatgctatactgcaataaataattttacttaaaaatttggccaggtgggtggatcacttgaggccaggagctcgagaccagtctggcctacatggcaaagccccgtctctactaaaaatacaaaaattagacaggcatggtggcgcatacctgtaatcccagctgctcaggtggctgaggcactagaatcacttgaacctgggaggaggaggttgcagtgagccaagatcgcaccactgcactccaacctgggcaacagagtgaatctctgtctcaaaaaataaataaaataaaataaaataattaaaaaggcatacctctttccccctacaaagaaggtggggggaggtgtattgcagactttctacctaccttgtaagagagagttgatataacatgtaaaatttatggcttttttttgctggtgaagaaaagaaaaaactctatagaacaggatgtagcaagtgcaaaggaaatgcctggtcagggaacatcagattcagctaactcccaaggaaattcaacaccacatcctcaggtccctggttaccctccagactgtgttgtattcctgaataacttaccagaagagactaatgagaggatgatgtttcatgctatcatatcagttcccgctttcaacaaagtatgtttggtacctgggagacatgacattgctgttgttgaatttgaaaatgatggacaggccaaagctgtcagggatgctttgcaagaattcaggatcacagcatcccataccatgggggtcacctatgtcaataaataatactgagggatgaataggtggagcacagaggatttttagggcagtgaaactattccatatgatactataatgatggatacatgtcactataaatttgtctaaacccatagaatgtgcaataccaagagtgaacaccagtgtcaactatggacttggatgataatgatgtatcaatgtagattcataatttgtggcaaatgcaccactctgttgggggacgttcttagtgggggagactgtgtgtatgggagaagggatatatgagaactctctgcaggttccacccaatttttcagtgaacctaaaactgctctaacaaagtctgctaaattttaaaaaatacatttggaatagttgtctttaaagcacttggtgttgtttatagtggtactttgcttcgttttttgtaacttttgattaggccattttaatagttgggaatgggaagggtaaaattttcgttaaggacttacaacatgatctagtcgttagccttgccaaactgtgaaatatgaaggctcgattttatataataaacttttatttgtatcctttaaaaaagttgaaagaggatatataaagtcatgggagatctgctttgccagtgcagatcttgactagagccttcccaatattaactgagctcctgaggcctgggaaaacaacattggctctgttggacagtctctagagttggacagacctggattcagatcatagctccatcccttgctaactgagtagccttgggtgatttcctgatctctctaagttttgatttcctcatctgtgaaatgggcatattacctacctcacattgtggctgggagagtcaggtggggtaaagtttgtgaggtgcctatcatggtgtctggaaacaagcaaatactgaaactatagctgaggcacagaagaagttgatcttttactcatcttttggccaaagtaattgtatagggaatggttgcaaatctatttagaggtttctgttggcatattaattcactggacacttctagaacaccttcttgtgggaagcatggaggtgtagagttatgaagatacaggtgtggcccaattctttaagggaatttataacctagtgggaaagagaggaagaaagctcacctgctttgattggcaccagttactttgctaccaacttgcctttgtttatttaactttcataacaatcctacgtagtaggctcccttcccttcccttcccttcccttcccttcccttcccttcccttcccttcccttcctttcccttcctttcccttcccttctcttcctctttctcttttctccttctttcccccccctccttcctctctnnnnnnnnnnnnnnnnnnnnttcccttcccttcccttcctttcccttcctttcccttcccttctctttcttttttttttttttttttctttcgacacaaggtcttcctctgtcacctgggctggagtgcagtggtgcaatcatgtctcactgcagcctcaacctctgggctcaagtgatcctcccaccgcagcctccccagctgctgagactataggcaagtaccaccatgcccagctaatgtttgtgttgtttgtagagatggggtttctccatgttgcccaggctggtctcaaactcctgggctcaagtgatctgctggggttacaggcacaaaccatcgcactttggccatagtaggttttcttatactagtttttacaggtgaagaaatgagtccagaaaagtgcccaaagtccaattttcagtctagaatttaggccctgggttctcttgctcccaaagcccatgtctttctactctatgatgaaagttagagtataatggtttatttctccctaaactagtttatgcacccttactcagaaggataagctgctgacccttcctctgacatagcacacgtgtttaaagcagtgtttgtgagctcagaagcctcgcagttagtaaggctgtagggctacaggatgttctcatttgtgcagattggctttgcacagacttgtatagagccctctaggctttgtgaaagctgcctgggcagactgatttattcacctttgcccaggatacatatttacggccaaggcacgccctcattatcctgcctgttcatgatgctgcatcaggagaaaagcctcctggaacaggtgagtgtttagcttagagatcaagccagtccagttgcattggaagcctctcccagttgagggtgaaaaaaccagtagacgcaaaaaagctgagtcagcctctgcactgcctttctgcaggagcataacagggaacttgcgtgattctgcctctcccttccgcccatgcacctgccacgtaagcagcacatctctgttactccctttggcttcctcatctcttcatccaccctcaggtttgtggttttggtaccacccagaccagtgttttcccatctcatggtgatctgcatagactcatttcagtgcttataaaataaagacactcatatctgggtcccaccttaaggccatcgaacccatttttaaaaggcttcttgggtgttgcttatgcgcaataatgttagaaaactcctgatctaaagcaacccaccagcctctaggtgtttgtatatccttagtctgaaatcaccatccaccagagctgtgtttgggagagtcttagggactggaaaacaatttgcttattcctttggggattctaagcaccatctctgaatcaagttagatcttttaagataaaacaagaaacaaaactacacacatagtcctcgatagtttaacttcctctatggaagtgacttcatttagtgatctttcagtgctacgtctttggtatttctcaagggtctatatgagaaacaactacttaaatacttcctatcatcagtgaaattcctgtggaagatgtttttctgtcccataactgagggtccctgtatgagaattcctttggtgcttttaggaggtagtttaacagggttaacgtgtggaccttgagtcagctacctgggttctacccctagctctgtcttctggaagcactggtgggtttgggtaaaacaatttagtttccttgcttgtagaacaagactggaaaatagcaccgacctacctcatagggttgttgtgaatcatttaaagtcttgatacaaagccttacacaaagcaagaccttatagaacttcagcccacaatgactgttattaacttagaatcaggaaacctaccttctgtagtgacaagtgtgtgtggccattttttcaaacagtgagactttggcagcctatcagttcctcttttgccctcatctgctaagaagctcacatcacaacaaacatgtttgcctgagcttgggtcttttgaattttaaggttcttgatcaattgttttaaaatcatgtccttctctgataagaatcagccagtcctttttgaaagtaggcagaacataagttataagtggattaaggttgaccttcagggccatcttcccatctcctgggctcatgccacaagtagagcactcctagagaaatggaggcggtaaaggaaagaaactaaaagggactgtcagcagtccaggagctaagcaggttatcagatgagcagattttctgtccaaggatgggttctagaattacaattctctttttctgttcccaggagcatattacatgggctcagggcttagggcattagaatttctcctgggtaacagacacggaggaatcattggttaaactccatttttctgccatcaagaatgttctttctctaccaaaattgctcttctgttagcactactatgtgagcttgtagagggtatgggatttcacaccgaaacatagaattttacagctgaagaggacttgaaattgtctagcccggccctttgcatttttgagatgtgtgtcctgaggcttggagatgttaaatagtgacatatttgaggccctatggatggtaaattgaggtatgattctcagacttcctgattccaaagcttgtagccctttccctgtacctcatgtccacaaagaattcggaactcttttctgctcttccagacaaagggtttcataaaaaatgttgtgacttacactaaattttgcattagagtagatgttatttccccagaatcctggtttgtatgctaaagttcatacttcaatttagagattaactaaatagcaataataactacagatgtctgatttaaccagcactattaaaggcaaacaattttttgcacttcaaatgtgtaggcaggtactttgtaaaactcacctaaataagcaaattgtcagttgttcatagagtttcatgctagccacaatgtagtctttttataaaagcattttgaatatgtgaaaatgcagaaatggggacgtgatttttttttttttttttttttttttgagacagaatccggctctgttgcccaggctggagtgcagtggtgcgatctcggcttactgcaagctccgcctcccgggttcgcgccattctcctgcctcagcctcccaagtagctgggactataggcgcccgccaccaagcctggctaatatttaatattttttttagtagaaacggggtttcaccgtgttgaccaggatggtctcgatctcctgacctcgtgatctgcccgcctcggcctcccaaagtgttgggattacaggcatgagccaccgcgcccggccagaaatggggacgtgattttttttaaggagcagggtacaaagatagatggggaagagcagtgatggcgctctggtgagctctctagcagcaccgctggccactcaggctcaggcaggacggctgccagttatgtgcctggggccaggtatctggtaaaccaaccttcatgccgttgtctgccacaacaaagctcctgctgggctttaaaagtttatagtcaacagcatcctctctgcagtgaattgcaagcttattatctgtttcttatatgagcgctatttagtctttcattttgctcatgatctgaaatacttctccttctcctaaaaataactccaatttaaatgattttgattcagcaacatctgatttttggtaaatttgcatatgcactgccgtctgtgttcagctctgttacttttcctggccttgtgcacatggcttctctgtgaaccatcatgggtgcctatgtaaggagaaatgaaacagaagggtgtctcacacatgcgaaggagggcctcctttgtcttgagcatctgaccctggagcctctcaagcctgcactgctgcaaaaacagaacgactcctcaatgccttttgactctggctcaccgaatgtcttgacatgttcagcatcttgggatgaaggaaatacataggtcaagacatccctggcattacaatgggctagggttaggttttttagcagtgttttctttttatataattattttattttatttttaagttccatagtacatgtgcaggatgtgcaggtttgttacataggtaagcatgtgccatggtggtttgctgcacctggcaacccatcacctaggtattaagcccagcatgccttagctctttttcttaatgctcttcccccgccaccctcccccaacaggctccagtgtgtgttgttcccctccctgtgtccgtgtgttctcattgttcagctcccacttgtaagtgagaacatgcagtgtttggttttctgttcctgtgttagtttgctgaggataatggcttccagcttcatccatgtccctgcaaaggacatgatctcattcctttttatggctacatagtattccatggtgtatatgtagcagtgtttttactaatgatttatagagcgaagtcctgccacatggggccttgatgtaacttccattcatcttgtgagttgatagaactcttataagttgatgtaatttcccttcatcttgtgagttaatagaacacagtgactctcctatgcctgcccagggcatccagagagccttttactggcatccaaaccacactaatgtgccttctttttgtgaatgaccttgggactgtctctgagcagagagttattacattgttattcgtatcattattgttattactttgtgcaatgtgtcacaccattttcaaaatgtccttttggtcatcacaccagtatcattgtgaggtagttacagcagtgacatactgtatggttattagtggtggtactgggtaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacagcaacacaaaaatatatttttgttataaagggttgagcatgatatagctgcaaaggagaatgtgagggtcccttcctttacttcttcctgactctcacctcttgctccaaaggtaaccacagcaaactagttgtatattctcgctgtcttctctctaagaagggcacacatataagatcaatatacatatacatgtgtgtcctcgttgatgtaaataatcataagagtgtctgccttacaggattgatgagggggttgaagaaaattaggcttttaaagcacttaacatggtgccaggcaatatactaggttcctaatagtgctctcatcaactgcgtggggtaagttctattatttctacccattttattgatgtggaagctgaggattagagagattgtcacctgcacaagatcacacaatactgaaactggatttgaatccaatcagacttaccctagtgtctcaacagctttggccactagcttatgtggttattttataggcatgatttttccacttgattattttctcttggtaatattagcttgaactgtttccatgtgtgtacatatgagtttacatcagtcttgtaatggctacatgtgattcagtattgtaagtacttctttattggggttgttttctggttttgttgttgttgttgttgttgtttggtttggtttgcttttgagatggactcttgctctgtcacccaggctggagtgcagtggcatgatctcagctcactgcagcctcagcctcccaggctcaagcagtcctcccacctcagcctccaagtagctgtgactacaggcgtaagccaccatgcctggctaattttgtttattttatttgtaaagacaaggtcttactgttttgctcaggatggttttgaactcctgggctcaagtgagcctcctgcctacgtctcccaaagtgctgggattagaggcatgagccaccacgcccagactggaattgatttttgtataggttgtgacttaggaatctagatttatctttctctaagtggagaaccagttgtcctctctatttattaatccattctttcggctcatttgaaccattacctttatcataaactgaattctcttgtatgtatggctatgcaactggttcctctcttctctactgttgatttattttctactcccatgcccatactaaagtactttaattattttagacttagaaaaaaattttatgacaggaagggaaaatccttccttattgctgttctctttcacaaaaaagtgtattttttgtgtgtgcatttattctgtcacgtaaacttacagaagcagcctgtcaaggtctatagagaaaattcctgtgggtatttagactgggtgttgcattaataggttcatttttgataaatcagcatctttacaatatttagtttctccatctagaaatatcatacatttttatttaggtcttttatgttcatcagttaagttccataatttgctttgtgtagatcttgcattggagggtttattagttgttattacaaatgggatcccattttcccattacatttacttaatttttattgctagtgaataggaaataatggtttttatatgttaattttttatctagccatatgacttaatttttgtattcgtgatctttatacttatttttcttgacatcacattggccaggaggaaaatgatgtagaatgatattggtaaaagtgtacacctttgtcttgttcctgtctttaatgagaatgcctcgaacgtttcaccactaaatatgataaatacacttgatcagcttgaagacatttctttctatttgtagcttaccaggaggtatgcttttcactgcagacgacaccatggtcttgccaaggggcctttattttttcacttaacattttccttaagagtccagagattgcccggactaacttgggcctcccagcactggcatcctagctgagcgaacctggtttagaactgagcacttaggactgagtaatgtcttctttcttcctcctttctgctcacatttgacttcagatgtcctacaggcaggagctactttgtgttgatatttcccgccttctctcgccactctcctccagccctacccttccttctgcagaaaagtaaaaaattttacaaataaataaaaagtagcatgtggacgaggacaagagcaccacttctggaattttctggcaggcaccactgaaaagatttttattcctaacttctaatttaaataacttcaatttttttttccacctgattatcttaaagggctaaccaccacctcacgtgctggttgctaagtggatcttgtagtttttacaggaaagtatgagaaaggaattaccacgtgacatctgatttcctgttgcagtttcatgcaggttctgatgcaggatacagtcatttttaactctttctcggccactgccttgtacatggttaatgcagaataaatgttttgatggtggattgatggaaatgatttaatcagagtccatctgagagttcttaggtggtgatgattttttgctaggctgtgaacgaaaggatttgttcttgtcaagcatgtatgtggagcatgactctaatgtgatttggcacctgtctagaaaattgtccctgtatccagtgacactttgctttggggaagtcaacacctgctgtgatggcatctgtcatatttaggaatgtgaaatgcacatgaataatgcacagccaccttagtaaaatgccttctccagaaaactcttcatgtaagccactggcaaaagattgttgcaagctgcatagaggagacttagggccccccttgagataaaaacagtggatgatgtattttactatagcttttctcaccttgatgccattggggtagattttattattttcagattgtttagccaagaaagcaagaacctgctaaatataagggtcatttatttttggttggtttgttagaaacagcattagctcccaacaaggtggggttttggggagatggagtgactcatctcaggcatatggtgtgttagtggcagccatccaggtcaagagggagacatagaagccagaaacaccgagaggcaaggcagccccaccaggcagccacgagtagctggccttggagcccctcccgatttcagtgaagttggctttagcttccggggctgttggtgtaggaagtttggtcaattagacaattatttttcctttttcagcatcctctcttttcttctaaatcatcaagtccagaaaagattctggaatccatgacaaggagcagactcaacgttccctaccttttctcttgcaggcaggtgacaaacattaccaccccagctgtgcacgatgcagcagatgcaaccagatgttcacagaaggagaggaaatgtatcttcaaggtgaggtggactcaagaacactagaagttttccttgctgggggaaaggaaatcttgctatgtttgtttgattgtttttagagaaggaggcatgttattagctgtgaggctacccaaatccaagaagattatggccaaaagttacctcatcagttagtattaatcagccaagcagttgacatgctggcagtgagcccctcaggctgttcacgaatgaacttgtgatgctgccttaatcaaatgaatggaactcgacatttgatggctcggatgtgagggaagagtgaaaatcagcaatatctcctctccaactctccccaggaatatgcttaggaaacaaaagattaaaataatttctagaaatttctagaaatgttacttatttgatggctactttttttctccttttactctcctgtgagaagggctttttgaggcctcccaggctgctgttctctgggttttcaaaaagaaaatctcatatttgatgaattacgtcacagacttgtttcaccccattaagttgattagctcttatattgagagagagagagacagagagagaataggagataacaagagagaacccactctctgaaagagaaatttctggtgtcaaagaggtactttttaccagggagccattggaatcccagcactttgggaagctgagttgggaagactgcttgaaccgaggagttcaagaccatcctgggcaacatagggaatcctcaactctattttatatatatatataaaatagaccatatatatatatacacacacacacacacacacacacacacacacacacacatatatatgccgggcgtggtggctcacacctgtaatcccagctctcagggaggcagaggcgggaggatagcttgagctgaggaattcaagacgtgcctgggcaatatagcgagaccccgttctccacaaaaaggaagaaaaaaaacaaaaaagacaaaaaaaataagcatacatatatatataaaggaccatatatatatgatcatagtttttatgaaactgattatatatatatatatatgatcagtttttatgttctctgaaattctggaacttctcagagaggctttgagagaggattctcttctagtcaaacagcaccatctgtgtaagcattttactgtttttagctggaaaagagttattaatcaaacaagggtttattaataaaattagcaaaacccataagagctattgctcgttccgttgtggtaattactgggtctcaactacctgtgcatgtcatttcttgatttctctttgcacatggcactatgtgtacctgtaatgagttgttcactttgctctctcaattttgtttttaggcaacttaggaaagtctacagaaaggattcttgagtattaaagcaaagcctggctactctccccttaaaaaaggctagctacatgagaaattgacaacccaaacttctttttggctttagaatgatcactctgaaaaactgtgattaaaaacatcacggaattttgaaaggccttatgaaggcaagtgacaagcacccgcatctgtggcctcatgcgggatttatatgacacgttttcccaaggacaacaggccttacatctgcagtggcaataggcaggtgtcactttgcatttctcagcacaaagcagatttattctttatttggtctgtgggcttagattttagcatgtcaattctagcactcaaaagcaaagacacaggagtgccaatcaaccctgtctctgctagaaacagactcagaggctccgggtgcagctctgcaattcagagtggttctggaggctggagagagaaggtttcaagcagtgcacaaatgcagcacattcgggctacaaataaatggctatctgttgaggctgcatttggaattccagggattgctctaaaccttctggagttgtgcttccgtagcctttgtgtgccctctcggcacatctttgaagaaagagcagtttcatcttcttcagcatctgatgttctgtccgagtcacattccttgtgtgcctgacctctggagaacaatagtgccattgtgcgcagacccggtgtcctggccagtgactcctgctcagcagaaccttcacggcgaatgcttctcctgagcctgcacctgacccctgggccctctgcattcagaggatttcctgtgctttgtagttagcctttgagccagagttagtgctgaagggacctatacgtctgtctgctttttgtttgatttttttgtttgtttattttggccctgggttaagaagatggaaaaaatgattgttaaataaggattaaagtattatgctgatataaaatgtattttttcttgccattaatttgatattagttaagctcagtggtgtgaaataactcatgagttattttaatttggttacttttcaagtatgcacaggttgttgcttaaaagagataaagattttggccaggtgtggtggctcacgcctgtaatctcaacactttggtaggccgaggtgggtggatcgcttgaggtcaggagttccaaagagcctggccaatatggcgaaaacctgtctttactaaaagtacaaaaatcacccaggcatggtggtgcatgcctgtaaccccagctacttgggaggctgaggcaggagaatcgcttgaacctgagaggcagaggttgcagcaagctgagattgtgccacttgcactccagcctgggagacagagcaagactctgtctcaaaagaaaaaaaaatgaggtaaagatttaagtcatgaaatgtggaaactctgatattcatactgtgaattttatttatgtaatttatgctttcaacatagtaactttattttcttaagtcttcttaagtgctcatttaagttctgtccatccccacacttgaatgtgtccttacatggacatatcagccttactcataatcatataaatgacatatttgatatgtatctagtcatacaaaatcatatgagcaggcattggattcttataagagcttctattggagataagtgttttgtttaattctgtgatgctggtaccacgcattaaagtgcttcataatatgagaaagtgagactgttgactcaggaacagaaaataacacctaaatagttacttcactagtttaaaagcaaagactttttagaaaattacttaaaagattgaaggccaaaggcaatttttggatttataatttaactttcaccctttctactagttggtttctcatttctctgtaggtgactatgtataattgaatcaatgaaaaattcagtaagtcttgcttctggacatagactatctggttgactttattcccgtcaactaaactgcttggttgttttgatgttatataaacaatagctattattttttaaattaaatgcagcttgtagtaagcactcaggcattccttttaaaggatgataataaggtttaaaaataacaagacacgattaagaactaaatatctcttgcatcaaaagactcatgcccagttggtggtctctgtggtctagaattatgacctttatcaaacaagcttgggctagatcaggaaaactcacttaggctttggacatgtctgatttttgtgttatgattcacttggacataaagcaataacaccttcctatgatggggaaagagggataggagccattctcagaagtgctgtctcagaggactttgtatctttccattttcctggctccttagtagtgcattctgtcttctcaggctccaccgtttggcatcccgactgtaagcaatctacgaagaccgaggaaaagctgcgggtaaggacacaattaaaacatgatgccagctgcatttgtaggccatacgctcgtggtcactaattcttggggctagggtttaggtgaaattactttttactgactttttcccttatagcaaactaagttcaaaggccatttggctagggaaagggttcccctcttaccttaaacgtactgtggtttttattccaaatgcttgtgttagacaaagtaagccttggccttactagtcagcttcttagaaaagcattcaagagaaaagtcaaatcatgcagatgggaaaacaacgactcatcaggttccaggtgcagcatctgctgacctcaccagactgttttggtgcttagtctataatgcactactctgaccccagctctacattggcacattttactggtctctcatttactggatccaaattcaccagaatagactctaaaagctgatggcttgtcagataaaacctttggggaaaataataaccaaccaagacaggtaaattagtcaattctcggaacacctccagatggcagtattttatgtttcagaagcaaagcgctgtacacagttgtaaaactgtgatcataattctctgtcctgttcagatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacaggcgtagtcacctggttgtgggctctagactctgggatttttgagaaactatggatgctttggaaatgagttacctttataaaatatgagaacataaatgatcatccttattgtgacttttatcgtaagaatgtaaagttcacagcatagcttgaggatgctgcccagaaaccaccccagtagctatagtagtttgtactctctctccagtgttgcttttaggttttctaataatcattttaacttcatctctgatgaagtcgtttgggagatgaagagaggaatgctaatgaggccagactgagtggaatgtgggtcttttctgtatcaggattgcttgagtttgcaaatcatgtgactaaaatgatttttaaaaaccaacaacactctgataacatcttgatggaaaactctctggataagcttatgaaaacaactagtgaaatacttccacccattctggccaagaggagctattgttttcttcctttagtaagacttccagagaattctaaagctcttctcctaaacccagcattcactacgtgggaggtcaggacagtgctctgggtcactgtctttggaaagctcagaagtgaggaagaggctcccacgtacccagagccggggttcacactgatgttggtagggtttaaagggaatacgttttgaacagagaaatacatcttgtgctctcttgagggtgtgtctacacatcacaaatcttgagccaagatttccaggcctttcactgcatgtcacattagtgcagtttccatagcaaaatgaaaatgttttaagaatctttcagcaacccactgggtagtccacattttttatatttaagaactcatggggcatttgtaacaacagattctcaaggatggctctcagttggcttcactggctttcttaccctttatatattgtaagaatgtctaagccaaaataaatggagaggaattgaaggaggttggagcttagataaatttactgtaacttgaagaccagttaatatgcttttaaacatgggcccaaaaatccacatgtacatcaatgaaagaatcccacttgatgtttactctcaagttagttttacctaaggtggttgttgttttgttttattttttaaaataattcttctgatttgaggctatttctgtgttcgttcttcccttttctcatgtttcatggcagctgccaaacattcggcgttcttcatccgatttcttttattccaaaagtctgattcgacgcacaggacggtctccgtctctgcaggttggcattgtgtctaggctggggctcgaagccactgtcctgggcccaggcttctgttgcttttcccctgggctgcttttctcacataacttcttcggctcctgcagaaagcagatgcttttctcacaccacaagcgcctctcacactgactctggctgttgtcttcttggatggatgttttcattcagagcagcagctaaagctttgtgtctgttcaagcaagcacatcagaagctatcttttggtcccgtgttgccacgtttgttcactgcacaagtatctgctcagcacccaggtatagagctgggctggatgtggcagatccagcctcataggcaagaaaagatgataaataattataagagtggtacagaaacccatcccaggctatggctcatgtaggccatgctccttggaatgtcagatgaggaaaaggtttccagggtcgcttcctgggagaagtggtcttggagttgatttttggaggctggctgagatttgcccatgaggggatgaggagaaagtggtggacctgatgaggagatgtgaagtgtgcagccgggaaaggcagtgcttgggtagggagtggtttcactcaagaaaggaagagtgagaccaggcacagtggctcacgcctgtaatcccagcactttgggagaccgaggcaggcagatcacttgagatcaggagttcaagaccaccctggccaacatggtgaaaccccgtctccactaaaaatataaaaattagccaggcatggttgtgggcgcctgtaatcccagctacttaggaggctgaggcaggagaattgtttgaaccctggagacagaggttgcagtgagccaagattgcgccactgcactccagccgggatgacagagcaagactctgtctcaagaaaaaaaacaaaagaacagtgaagtgggaaaggaagaaactgagaacaggcacctactctatggagactgggggatttacgtataatctcatttcctctccctaagaattcctgcgaggtagctaatcttattcccattttacagatggggagactgagacccatcatagttaggtaacttctccagagttactctactggtaagtggaagagctaggattgaaaaccatgtttccgtgagcccttcactcatattcatcctgctatactgcaaggggacagtgagagaaaaacccgaaagaagcagaagaaggagaacattaaatactggctaaggctgttgtcagggggccactgatggagtgtaaggaagagagacgcaccacctgcccggggcatcctgcaggggaagggagaggactcaaccagcccggcagaggaacagccaggctggagattatgctgcatgcacagtgtacctgaccgtctttaggggtctctgagaatcagtggaaaccttggcctgttaaactagaagcgactttctacaatctcatctcagcccagatgaaacctgttctgtagctctgctaacaattcagggttgcactgcagcactttggctgggctgtgtgcctgtacattctgtgcctgtcagaactgcgctaaggataagaagagtttgagtttctatttttgttaaaccttcaccttctttctttgcacgatggaaaagacagaagtatagaagcttagagtagaagagaaccttttagaggtcaaccccctgagtttcctcattgatagaatgaagtcggatgggctggacatggtggctcatgcctgtaatcccagcacgtcgggaggccaatgtgggcagatcactagagcccaggagtttgagaccagcctgggcaatatggcaaaaccccatatgtacccttccaaaaatacaaaaattagtgagggatggtggtgcgtgcctgtattcttagccactcaggaggcttagatgggaagatcacctgagcctggggaggttgaggctgcagtgagccaagatcatgccactgcactccagcctgggcaacagagtgagaccctgtctcaaaaaaaaaccaaaaatggacagatacagcagcatgtctgagactgcacaggctgtcataaacagcaagccaactgcacacttcagttcttgaccccaggcctcagtgccttgcgttgtcccgtgatactgggttcctatgatatgatgtatttttcatacaatcttcattctgtgttaaagtttcagctccagtggcagagtttccacacacggtgaagtcaaagtcacatgaatccagaggaacagccaaagattgtccccactttaaatgagtgttgctcagaattaagtgcttccacttggcaagaagccactttttcaatagtttttttttcttattttttccagtagtatactgttaaatagtattacattttgttagcctgtgtctacaatcaagtaatacattttcatgacttgaagaaaaatgccatcatcaagtgtgaaattttttagtttgccccagacctttaagcttaagagatttggagcatcttgagagacagagagggagcgagagaggtctgttttcaataacttctctcctcctatcttgttgttcaaaagggacatctgattcctattatccagctgtaactatcaatgaagtcaactttagctccatcacagaaagttgtaaacagctggggacctggcagagaaaatgggctgtgtggcaaggtctcccttcacccgttggcgattgaagaatggctcaccagtacctttaagattccagaaaactccaaagcaatgcagttctcaagtcacagatatgttatcttttaagtacttttggctacacagcagctcattttccaccacttaaaattcagtacccttagttattagataaactgtcttccttgcagggacattcagtactctgtgctgcagaaataaatcctggttttgttgtagaggaaagtaaaatctatagcaggaaagtcatttttgttatctatattgagaatgagctccatcttttccttttgcctgaattacaggtaaaagaaaatgatgaaaatagaattacctaagaaaaacgtattctggttccactcacttggaagttttctatgaatagcaaattttgtctacaggtaaaactcagtactgagcatgtgtaattcattatacacaaagcacatggtattcccaggaccaagtctgtaataatctggggggtgtcacttgctttcattctaaaagggagtttttctcagccatgcctttggaggttaaagcatgaattgactgacctacaaaatgggtgtgacttttttctttgaaactaatattcaccaattataacatatgcacttgtcaatctataatataccgaacaaataccatgtgtatatttttaaaggagctaatttgaggctttatgtctgtcaagaacaagcaagtaatgttagtggtgtttgatttttgttttgttcatgtcactacaatacatactgttttactcccagctttcacttcgtccaagtatttcatccttttgagtgtgtctttacagttcatcagacagctgaatgtagaggtgtaaagatttatactggaaagatttcatgtaataacggctgatggcatttgtgaaactgtccccagagaagtggtgtgtgcgcacagcaccctcctgcctcctctccaaacacaaaattcttttttccaaaggagttgatttcactctttctttgcttagcagtgggcattcagtatgtgcaggttttaaaatattcctttttctgcagctgttatccccaccttgtctagtgaacttcaacaaaaacccaaggcaggtactgtccacatcaacaggacttagtataaggtgtcagtcaccttatatcagtagttgtcccatcagtgttcataagatcattctgatctagttgccagatgcctgtagtttctctccttagagcatggctttggataaatgcaaattagatgaatatagttgttgcatccctgctcctgctgaatggggggagggcaggggctacaaagtgcttcccagcactgtccttctaggcgacccatgtgcatggtggatcataatggaaagtaaatggaaaatgtcatttatctacttactcaaccggcagagctctggtaagtgtttttaatggttagtatttgaagaataataagacctgtaatggaaacggaagaggatgtcttcaattaatttttgttctgtgactgtgccttctgaatggtaggacagatggacaaaatcaaggcataggggaaaaatagctgaaaggtatttagagggcttttcaaagagatttcatgaagaaaacaaaaagatgtgctttttaaagcatttggctacttatttgtaattaaatgccatgttttatctctcctgttgaactgctagtcttctaatgaggcatctctttgttatttgtgtgtgtgtgtgtggaaagtaaaaatcgttgttgaaatcaaacgtaaagacatgaaagtgtgctggggagataactatagagtaaatggaccccttcatcatgacagactgaatgagaacagccatatcaacaagaaggttcttaccgaaggctcctttcttccttttgccaaaataaggtttcacctacttgcctcatcttactggcaaaatactctgagcgatcactaccatatataattctgtatctatctaccttgcctgctttcttcatctcacctcaccccacctccatgccaaagatggcatcagaagatgccaaagatagcatcaaaaggaagaactgaatttctccaactgcactttcgagttggtttttctgcaaggaaaaggtgcttaaatgaaagtaaataaattgtacctgcttttagtatgttagccataagtccttgctgtttcctttattctgtagaagtgagcttacctttggtgataaatatttgaaattgtatgcatttataacatagaccagagagtaatttttttttactgtaactctcataaagaattccagaaacaaggcttctgacccattgggttattgagttcagttcataattattgggtcactgttgttaccctggacatctgaatgggtggaaatggtaatttagattaaataactacaggtaaggatcatcagttacatgtcacgatcacctgtaaaattctgtgatgaccaaagaggtgatgatagggttgggttaatggtaaagaagaaactgtcagtgggatttgaaagtgggacagcatgtcagtaagttaagtgctttcaagattgagatggtttctgtctgagtggatatatgttaatgtgttggagaacagctctgagccttttgaagatatcttagccataacagcaaattatggattcattaggaaaagaaaaataacagctggaagaataaaaatggttcttttaataaacaagatgttaatttgaaattcaacatgtttggaattctagatgtttcaaattgaaatgtaaaattctaagtatctaggattaaaagtccaaaaataatcattcaatttttaaaaagtaattttatgaccttcataagggagagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgcaaggtcatcgtcatcggcatgggaagggcattaattaccaaagtggagacacagtcactgtctccaagagcatttggaatcacttcacagagttctcaaggaggggaaggctatctgtcagctcctggcgggactgctgccccatatactgtgatgaattgcttcacatatctgagttctgatgggaaggagtccaagtgcggtagctgtagagaacgctggggaagcccagttctgtgtagctcacgtatgaaaggaatattcatgaagagcaaaacagaggcattatttgagattaactgcctgagaaacctagtctaatcccaagtgtctagaaaatgttgactacttgccatgtgcccagtaaggtgcttggagctttatatgcatcctctcatttaaccctgtgacatagttatgctggtacaccttgctgcgttctgtacatgaagaagttgaagctcaaggaagttaaaagaaaaagagaatggaaaagaaaaaagaaaaactcatgtaacatcaaacaactagtagagcccaggtttgaactgttatttggcaccaaagccagccttttaagtccactgtattacactgtcttacataaaatacatagatgtgttttatcccattatttcaatatagacaggtaaacagaattgggccattgtaagaaaataagcaagcaagaatgcaactcaacctgcaaacaagatgcccatggaagtaaattttaccataaacttaggaggtcagaatgaagcaaaaacaaacagtggtaaattcagtgaaagaaaaagcagtttccgaatctccaagtgtattagtccattttcacgctgctataaagaactgcccaagacggggtaatttataaagaaaagaggtttaattgacccacagttctgcatggctgggaaggcctcaggaatcttaacaatcatggcagaaggcaaaggggaagcaaagaccttcttcacatggtgtcaggaaagagagagcatgtgaatgcagtaaaaactaccatttataaaaccaccaggtctcgtgagacttctctcactatcatgagaacagcatggggaaaaccacccccacaatccaatcacctctctccctggacacatggatattacaaatcaagatgagatttgggtgggggcacagagccaaaccatatctccaagatacatcagggcatttctcaacactaaagtttgaagatgcgagtagcagagggatggctctaagacaagccagaacatcagcaaatttgatgaccagttcacctgactttgaaaactgcctattaaaacctaaaatatttatttctgaatcagagaacttgggggtaagtgtattcaaattggaggtaatttggatctgaaaacttttaaaaaccaaatgggtcttgaaaaaattcaaattgttgaataacttttaaaatctttagctcaacagtattaatagtgtaaataaaaaaagataaatgtttccaagaaagcctgcataactcacaggatcccctaatccagtcaagaaggaagggagaggccaggcgttatggctcacgtctgtaatcccagcactttgggaggccgaggcaggcaaatcatgaggtcaggagttcaagaccatcctggccaatggggtgaaaccccatctctactaaaaatacaaaaattagctgggtgggtggcaagtccccgtagtcccagctacttgggaggctgaggcagtagaatcgcttgaacctgggaggcagaggttgcagtgaagccaagatcatgccactgcactccaggctgggcgacagagtgagactctgtctcagagaaggaagggagagagaaactgaagtgaaataggctagttctgccaagagaactgcctttactgcccacgaagctcttcatccctggaaggtgctgttaaagacccttccctacatgtgcgtgcgttgttcttcagctctgtttctaccagtacatgcagtacaagagcaaataaaaccattcagagccatccccaggtgcatcattacagcaaaggctgaaagtatccttgccccacacttggcaaaaataaggatgagtaacatacgagtgaccccaaagccccagtgtacactttggctgttcacacaatgtcctggatgcttgttaatgaaaacaggcctttgtcatagcaaccccagtaaccgaagacatctgatgctcctgccgcacaccctctccccaccccaacccagtgagctattgcagtgttcttacagagctagcgcaacaaaaatattttcagttagcaagcattcttttctgctacttgatctcaatatttctcttttagtttcaccccatttgtcccatagttatgttgataggaaataaatgatcacatttgccctgcaatacagcaaaattttagtgcagggcttaaatgcttgggctgtggacctagagtgtctgagttcaaatcctgactcttcatccctttcctacctgtgtggcttggagcactgatactttttccttatctgtaaaataggaataataatggaagctacctcctagggttaccgagaagattacatgagattaagcctgggaagtgcttggcacagggcttccacgtagtaagtgggcagtagacattcgttgccatcgatattcttgggttgctacttaagaggtttcattttgacattaagtttggaaaatgtgagatcctggccacttgaaactgaaggactacctgtggttaataattatctcacagagatggatacaggttcagctttttcagggggtagcatctccttgtaaaggaggaatacattttgattgtgccacttctatattttgattaggaaatggatctagaaattgcactttattattattattattattattattattattttttgaggcagagtttcactcttgttgcccaggctggagtgcagtggcacaatctcggttcactgcaccctccgcctcccaagttcaagcgattctcctacctcagcctcccaagtagctgggattacaggtgcctgccaccacacccagttaattttattgtatttttagtagagatggggtttcaccatgttggccaggctggtctcaaactcctgacctcaggtgatccacccgcctcggcctcccaaagtgctgggattacaggtgtgagccactgcgcccagcctgcacatttcttgaatagtgttatgtgagtctttcctttttcaacatactcagaggtagaattttctcatattgagatatgcctgtgattggtataactctagcaggaaagcgcttgtgcacggcaggtcctggggaggaggcccagaagtgatgcacctggtgcacctccacctgggtgtggtgtgatttctcccagccacttccaccctagcatctcaaagataccaggggcattggctgaaaaagactgatcacagtcttccagcaatgagtcaaatcactgcctgacctgaattggccagatatgtttgccttcattgcttcaactgtgaacagcatagtgagacaacacccttgtctgaaggagtttctttggctcagtggtgcccacattcaaggtattaaacaccaatagaaactactgagaaggcaaggtcttattcctattgtagaactataagttactctctttaggaaatggctgcaacagaggggaggaagtgttccaaaatgaggccttgagttttctctgcagagctttccagaatatgttaaacagaagcaggaggcagctgatcctagttcataagtttccttcctgctcacataaccacctctcactctccacgttcttcaggtatatactatgaagtccagtttctttcatccttcccaaaggccgacccaccagccttacctcagtgactctctatatagttaggctcaaatcgtgtaattaacataagtcaagtgtctgcaaactaagtatttgtttacaagtaataaattctagctcattccctcaactaggatttgtgccttctgtgtacctgtggaaagcattgggtatagacagtggttaaaaaataaactctatgagggcagagagcatgactaaagttaatgagggagacagacacgatgcaaggaaaacaataaatatataattatacattttactcatgaaggaaaaaagaatgacactatgagagaaaacaacatggggaaccaactctggattgaatcagggaggtcctctctgaggaggtgatatttaagccaagactgaaggaagagaatcatccaagtaaaattgggagctagggcatttcaggcagagggagcagtaagcgaggatgagaactccgaggcagctttgtgcgctgtgttctgtgagtgatgacaggtgagagacgaggtaggaggggaaggcagggatagaatcctgaggccctggttgttgtgattttattctgaatggatgcttctgttaggtctgttctcatgccgctagtagacatatacccaagactgggtaatttataaaggaaagtggcttaatggactccagttccacatggctggggaggcctcacaatcatggcagaaggcaaataagaaacaaagtcatgtcttacgtggtggcaggcaagagagcttgtgcagggaaactcccatttataaaatcatcagtctcgtgagacttattcactatcacaagaatagtatgggggaaactgccccatgattcaattatctccacctggacctatccttgacacgtggggattattacaattcaaggtgaaacgtgggtggagacacagccaaactatatcaatgctggagacaaaagcagagtagtgaccatccaaattatgttcttgaaaggtctctcggctgagtgcggtggctcacgcctgtaatcccagcacttggggaggtggaggcgggcagatcacgaggtcaggagatcaagaccatcctggctaacacggtgaaaccctgtctctactaaaaatacaaaaaattagccgggcatggtggcaggtgcctgtagttctagctactcgggaggctgaggcaggagaaaagtgtgaacctgggaggcggagcttgcagtgagccaagatcgcaccactgcactccagcctgggcgacagagtgagactccgtctcaaaaaaaaaaaaaaaaaaggtctctctatccattgcctgccaggtggatttgatttgaagaagggaggggagaaggcagaaaactcacagggaggccattgcaataatctggatgaatggaggtggtgactggggctgggactacggcagtagagagggagagaaatgggaagctttgaggtgtgctcaaaggtaaaccagaaattctcgtaggggacaaggagcaggaagggccagagaaaggcctccccatgccttttcaaaactggatcgtacaactagtttgcatttacctttccttctaggttgtattttaccttattcaaaaaggtgataagtgtttctttttttcactagctgagtttttagtaaagcttaagggcccaggacagtctagattctgaagccagggtccgaagtcttacaagtcactgtttattttacagcctaccaggacatcctcggaaagtatttattctaggccaggctccagtattcctggctcaccaggtcatactatctatgtaagtatctacttctggaagtgacatttctgggacaggtaaattagtggattgtaatagcagaatgggtaatccaaaacaaaaactgattcaaagtgatttctatttttgttatgagacctgattttcatttttgtagaacagtctcctcaatcacttttacctttaggtaattacatttatgtgaccatcaacagagtgatcagacgacctgtaaaatgtagtaatatgttgcgggacttaaaaaattcttgcacctaagactccgtctcaaaaaaaaaattcttgcacctaaattgcatatagatatttggggattaaatatatattttatgaagctgatactgagtgttcctaaattctaccacaaagatatttaaatatttagtttattaattatgcggttcttgtttttagccatctgagaggattattggaccatctgtttgagctttttcctttactatcataaattcaggaaattatccttaaggtttgcacatttatctatttcatgaattctacacagattttttcctaagcgttcagtgacttttttaaaaaaacatgattaatatatggtataaagggcaacttctgaagagtataactgtgttaggcaagatgttttggtttttgtttattttaaggccttcactttttaaacaacaggaaatgcgccaactacagtttcctaaagcagtcagactacaaggtaattgttctttctggttaactttgccaggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagaggtaatacattcctactggttgtgagttgtacaacaatttaccttcccttttgtcacatttgtaataactaccatttggagttcaggtaaatcaggtggtcttttgtctgcctagtatttgcagatttctagaccaggtgctttgaggtattcagaagcccatcatgagaagtgggagaacagaacaatggcacatcaaacaacagtgaagaccagctaaacattagcatgctgggatggaagctgtcgggaggtggggagggggtggggattgtgtgagctgggcagagcaaataagggagtgagggtctcctgggggtcttagtctagtgataagctttaagtatattcatggcatcatgaggagagagaacacaccccctaaattttggtaattacagttttcagcaacttaagaaagttagcatgtgaaagaaaaaataaagtagagcgcatggggcaacagtctagcacaggagtgtgagccagcattctggaatcaaattacctggtctcaacccagggatcaccacatgccgattgtttgactttgaccatgtgacagccattctgctgctagtttcctggaccaggtacagtgctcatacctgtaatcccaacattttgggaggctgagggccggaggattgcttcaggccaggagttgaagaccaccctggacaacatagttgagacctcatctatatatattaaaaaaataagaaaaatggtcctagtttcttcatctgtaaaacagatagggtgatgatagaatctacctcatagggtgttagtgaggattaagcaagctaatctatgtaaagcaattatcagaggccagacttgggggaaatactgagcatgtggcaatttctaccattgttgctacctgtcctcttggggctcgttaatactcggcctgcagacccatctgctgcgggaccagagcctctcagccccttggggtcctcccctccccggtcccatctcagggttgaaggttctctgtggtcgcttcctacccaagtccgtttcccctggccaatcggctcactctcatttttttctcttttattttttgaattagaatcatctgtagactgattttagtccacaaagatgttaacaaatagctgacaaatcagctattcaacaaaggttaaaacagaatataaacaatctagcatctcacagtgctttgaggtcttggagaagaaaaggcatgaaaatgtgattctgtttaattgttctcaattccagatgtataatattatttgataattatatttatgtttattttttattttatatatattgttccttttatttatttactttctaatctgggttttattccagagcatagctctgcgtggaaaaggtccctgtggcaggaagtgatatccattttcatgtagtgccacctagtggtcacttagctgtagctgcacttgcggccgctctcaagcgcaggtgcattggcccgggttgtcagttgccattgaaccccacagagtttcgtagggcataagaggcgaggggaagttcctgaacaaagtgcatagagattggccttggaccctgtggatgagaatttactaatgtttaacccatacaagcaaggggatgtgagtttttttaatggtgttaaggatttggggttcatggtgtgcagtgtacgtgtctgtgtgcgtttcccagcagctccatcaaggcagtaaaacattaagcactcaagagtttgggctttgaggtgaaaatctctgcatttaaaaccagactctgccagacatggtgactcatgtccgtaataccagcactttaggaggccaaggccaaggtgggtggattgcttgagaccaagagtttgagaccagcctggacaacataccaaaattccatctctacagaaaaaaaatacaaaaattagccaggaatgatggcacacgcctgtagtcccagcaacttgggaggctgagatgggaggatcacttgagcccaggaggttgaggctgcattgagccatgatcatgccattgtactccggcctgggtgatagagtgacaccctgtctcaaaaacaaaacaaagcaaacaaaacaaaaaccaccaccacaaaaaaagaaaaaaagaaaaaccagaccgatgctgactaaccacataactttggggaaattatatacctcaatctccttatctgcaaactcaagatagagaacaagaatacctatgctagaagttttctgtaaagagtaagtgagctatttacattagaacagtactgggcacataataagtgcttaagaaaaatgctggctactctcgtaatcagcatacttactgtcataacctggaattatgtcccatggttttctctatgcatagagggtgcccctgggatcagaaatcagatatattagtgaactctttcccaatacttgcatcttgcaactgagagaaatttacaagctgttctattatttattccattaaagtttaacacacttcttttatagacctcatatacatattgcctttttttttttttttttttgaggtggagtctcactctgtcacccagctggagtgtagtggtgcaatcttggctcactgcaacctctgcctcccaggttcaagcagttctgctgcctcagcttcccaagtagctgagactacgggcatgtgccaccatgctgggctaatttttgtattttcagtagagttggggtttctccatgttggccaggctggtcgtgaactcctgacctcaagtgatccacccgccttggcctcacaaggtgctgggattacagatgtgagccaccgcacctggcctttatacatattgccatttaagaaacactgcaagagtcagattagttctgtgcagccattggtgcctccagggccttgctgtcagtgcaggtgcagacctgggccctgaccttgagaccagccttcacccagctgagaccccctagagacaggctgtagctgcagaggagaccctggagcttgtgaaggcttagaatacagacagtccgcccacttactatagaatgtggggaaaagggcaaattctaaaactgagaagtccacccctggctgtgttctccatagctctgtttgaatttcatttctatttgaaagctttttgcattttaattgtaaacattttattcatctggaaaatacttgagcaactactgtgtcccaggagctgctgtcatcactgggaatatgtagttgtaaacaaacagtccttgccctcatggagcttgtggcatcacgtgggagacagacagtaaagaaacagatatgtaatataattttacagagtggtagggctctgaggagaaatgaagcagagtaaagagaaagcgtaccaggggctgggttgctcctctggacagaatggtcacggagatgctgtgtgacagtgggtttgagcagagacatcagcgctgacagggaatgagccctgcaggtgtctgggtgaaaagcactggcagcagaagagacagcaagtgcaaaggccctgaggtgacagaaagcttggcctgttgatggccccaaggaagcctgtgtgcctaggaggatggaagccagaggtgaatgatagtgagattggcgaggtgaatgatagtgagattggcgatgcagccaaggcaggatgccccatgcctggtcaccaaagtcctattttagttatcaaactattttatggtgattgctgtggttgtaatttagtcaacaaccatgtgaacaagatcctatgtttcagtagatgctgtaactcatcatagtaaaatgagcgtagtttgaatatataagggaaatggttccaacttgtctagcttaatcacctaagtatgtatcacaatcatatctagtcatggttcttttttttttttttttttttttgagacagagtctcgctctgtctcccaggctggagtgcagtggcgtgatctcggctcactgcaagcttcgccttccgggttcacgccattctcctgcctcagcctcccaagtagctgggactacaggcgcccgccaccgcgcctggctaattttttgtagtttttagtagagacggggtttcaccatgttagccaggatggtctcgatctcctgaccttgtggtccgccagcctcagcctcccaaagtgctgggattacagacgtgagccaccgcacccggcctattcatggttcttaggcagagatgtgcaccagaatctccccggaactttgtcagagtctacctgtctgagccccatggcagatgcatttgtacctgatcagaagacagggagatgtggagggatgctggcaggtacatgttggctaatatttacagctgactctgataaacaactctaattaaaactggcaaagaggccaggcgcggtggctcacgcctgtaatcccaaaactttgggaggctaaggggggcggatcatgaggtcagaagatagagaccatcctgactaacgcagtgaaaccccatctctactaaaaatacaaaaaaagtagctgggggtggtggcatacgcctgtagtcccagctacttgggaggctgaggcaggagaatcgcttgaacctgggaggcggagattgcagtaaaccgagattgcgccactgcactccagcctgggcgacagagcgagactccatctcaaacaaacaaacaaacaaacaaaacggcaaagagttaacaaacattgtgactttaaattctcttttatttttctagtctccgaggactttgtctcctactccatcagcagaagtaagtaccatttctttttatcattttaatgggtggaatttgagaattgcttggcccttccctagactgggatttttgaaaaagaacataacatacaaaagaacagaaaaactgcatgtggggttatggtggctttggggattacctccgtgaaagaggagactctaagacacagcaatatatttctcttaaattggagaccagggagtaaaaatggcctcactttaatctgtgtctgtgcctgtaagtggaagcaaagtgtctgcaggaacataagtcacttgtcccaatgtggggctctttgtccgcatctataattaatttttctgaaccctaatatactgaaatggccaacagccatcatggcgtattctataagcagagccatcttgatgggaggttactctgtttagtctgaaatcaatcatctgatcctaaaaccaagcaactttctggatattatgaaactggactacttttagggaatctctgtaattcaaagtagtaaaaataccataatattttcatggtttatgactgctatgaattattaatttctacctatattctaataatttgcattgaatttatgaagaattaatttctattgaccaactgtgcaagcttgaagcacataatctggggactttttgttttgttgttgttttatttaatttattgttatagacaactagtatcaagccaaagtttccccttgccatttgctctcaaattccacaaagctatggttactgaggtgttcatttagtcgttattaatgcattctttcaaactttttacttttattgtgctagtagaaatttcataggacaacagattcctaaaatgtaaaatattctttgtactctttcaactctttagacagttttatattgtgtgtgtgcatgtggttttttgtacttattacctaatatatccttttctagatttggagataggtgacattttagtggtgctatgatattccattgaattcgcatgtcataatttcctttttttttgagacagagtctcactctgttgcccaggctggggtgtagtggcacaatcttggctcactgcaacctctgcctcctgggttctagtgattctcctgtctcagcctcccaagtagctgggattacaggtgcacaccaccatgctcagctaatttatgtatgtttagtagagacagggtttcaccatgttgggcaggctggtcgcaaactcctgacctcaggtgatccacccaccttggcctcccagagtgctgaaattacaggcatgagccactgtgcctggcccgtatgtcataatttcttaattgtgccccaatttgttgaacatgtaacgcaaatttttgcctttatgaatagtagtactatgaaagtatttgaataaattattcctccttttaaagggcattttaaattattttcttgggatatgtttcccaaagtgagaagtaaaataccggctttatggcaaccatcaacttgttattcaggagaatttatttaaaatgccaccagatcaatgtcgtagacagtacagtttggttggtggtcagaacgaaggaagagattagagtcaggagtctggttccgaagcaggctctgcccataccaactacatgcctacacacagggctcttaccagcttggaaccatgtttctacattagtgggggagggaggtgatagtatgtgacctaccttttcttgttatgcagatctggtaggtatgtgaacatacttatgaaacggaaaagtacaatgtcagcatggtcattggaattattatctcttgtcccatagccctatctctattaaggtttatatgttttcatccttaaaattttttttttttaaagaaacagtgtctcactctgtcgtccaggctggagtgcactggcacaatcatagtttactgcagcctcgaactcctgagtagctgggactgcaggcatgtgccatcatccctggctaattttttacagttttttgtaaagacaaggtctcgttgtgttgcccaggctgttctcgaactcctggcttcaagccatcctcccaccttggccccccaaagtgctgagatcacaggtgtgagccaccacacctggctcttaaaattttgtaataagcccaagtactgcagactttgaacaaaatatattagccacagaatgcttatttgcatataaaatacctgcaaaatttgcacataaaaataagtgcatatattaatcaaatatatataaacaagtagacatgatggttccttggcagtgtttgtgaagcgtggttcctactgaggcatggtgatagcctgaatgtgttgaactttgtttccaggggtaccaggatgttcgggatcggatgatccatcggtccacgagccagggctccatcaactcccctgtgtacagccgccacagctacactccaaccacgtcccgctctccccagcatttccacagacctggtaagggtgactgttcctggattcactctatataacaaactatgtttctgtgattttttcccctactattgatagcacattgaaaaatcaacgactaaacatttccatccctctcccagagcaaaatgaaaactggtatccaactatattttatgctctatcttttcttgaaacatcagtcatcctaagcctgtgttcattttgatttattaaataattatattttgacagcgagctactggaagcaaggggtttttttaaaaatttttttacgattaacaaaaatctcttcactttgagacttaaaatggagatctcccaaagaaaatattttgatgtgctttttaggcataccaacatcatctaaaattcagtattagccatttttaacagctggattatgtttcccttatctaggtgttagtaagcatgcttggttaagcactttctagaaagaggactcagggctgttcttgatcacttttaagatcgttccaaccctaagattttcagtcattcttaggaaacataaaatcatttccaaccctaagattttccctcagacttggaaaacaaaatcatttccaaccctaagattttcaatcagacttggaaaacatacaattattaggcatcactacagtagagaatgccacaaagtagcagattttagtggaccttcatctgcagagaatttagtctctgtagctactagtgggtgtctcctgtgtgtagtgggagaagaatggagatcccagtacagatccaagattccctgagaaatggattcacaaggaagattctggcctctaataaaacttaatggtgacagtgcgcgtctgtgaagacttcatgttaagcttcttgcttctggacgcatagatgagagcaaacccatatgctacctttttaaaaataaattgtacaagaaatgaaaccaaaagaattaacaggatgataaaaagctgcaatcttctaagaccctagatttaatgatcgtagagaattcaaactatttgatcctttgataatgtataattttctctacactgataaatgtttgtgctatttattgaattacattaaatgaaagttctcaggaattttttttcctttatttcatgggctattatattcattttattcatgcccaggacgtgagtcccgatttaagcctttgtccatttgggtaataagaaatcctttatgctgggccaggcgtggtggctcatgcctgtaatcccagcactttaggaggctgaggcaggtggatcacctgaggtcaagagttcaagaccagcctgaccaatatggtgaaaccctgtctctactaaaaatacaaaaattagctgggcatggtggcatgcgcctgtagtcccagctacttgggaggctgagacaggagaattgctggaacctgggaggcaaaggttgcagtgagccaagatcgcgccattgcactccaacctggatgacagagcaagactccatctcaaaaaaaaaaaaaaaaaaatcctttatgctgccaccctgctcatgtacatatgctgaggtcactgagaccccagccatggagttgccggagcggcgtggggttataggggcattgttgttccaaagacccctgaacagtgaggggagtggtcagtcaacactccttcccccaaaagctcatgtccttactgagaaagtttccatctgttccaattatggttctgatgccaatagactttagaatcttctccttctctcctttcacaatatattacatgtatgcctgatgccacttgttaggctttaaagttattattttgaaggctgcccttccaaagtgaagctggagggattctgatagcatacttgtgatccatatagaacaccccaaagtgtccactccacaagttctagatgccagatgatgatttaaaaccccctcggtctgggttgaatttgaatggtccattcttcctgagataactgagtttccagcctccagtcctcctgctgaagttctcgggatcatatagacctctttgccacacagggaacacaaacatgttttccttctatgtaggcaaaatcaaattaaatttacagtgggatgtttgcttaagaaaaaaaaaacctgacccttacatataaatacaatgattgtcattttttttaataagcatttcagagggttctgttgtgtcaggtgctttttaaaaacagctgttgttgagtctaaatgacgtgcctgctactggctgaacagagaccatccgggtgaccatttctcctcaccaaagccatttattctcagagagtgactctgtacccacctgaacctctttgcaaactctcccctactttgcctcagccttagcaggtgcactcttaaccctttctccttcctcccttttcagcctcctgattaacgttctttattttgttttcccttggaacgatggcactttccctgctcctgtgttaatttctgttcttcttttctgtttccaccgtgccctgcccctgactccttgctgcacagagcttttgtctcctggtgtgcagaggttgtcgtacctgcgcaccagcagcctcagccccacccacagcgactcccgccccaacccccctttccgacaccacttcattccccatatcaaaggtaaggaggcaggtttctccaggcagcaccctgcatagtggagatttattagcaccctgggaaggctaataaggtgtatctccaagagttagtgccgagcttttgagctctcagcatgcctgcgtgtgtcatgactatacccaacagttgtcttagaacgggcatagcatctctcattgggagaaatatgtcacttctaagggctctagatgaagaagcaggaagtatgtttaagaccataagatttattatccactactttgaaaaaagaaaatatatatatatatattattattttgtttttggatgcatcgaaacaaaatataatatatataattggaatattttcctgggttcaatacgcaacgtgtctcagcaaaacacgacagtgtttagtaacagatatccaaaagttgtcttaccggtgataaaccatgaccatattaacatgtttgggcagcattaaaagatctatggcaacatcaatgtttctctttgagccgactctcagagcagtcatcttttgatttgtcctaactcccacatgatgcagaagagaggctttgccttctgttttctgttcctgcctcacatttctgccccatcccttctttttcatcattgtcggcaatgcttctgcagccgtcctcagttgggactctccacactgggggagccgagaaccctgaagaggctacaaaggggtcataatttaaaattaagtaggagttcccagaatggtgcgaacttgatttgaaccaaataaaccaataataatagctgaaggaggaaggaggaggcaagcacagatgttatcacaggtcttaaaacagtcctaaaggactcttaaccatgtgctgctccatgtgtcatggccctgatgcttccattgaggagcttgttctggtttactgaattttcgttgtcagtctaccgaagctttttctttgtgctcacttggttgttgagcggctgaatcctaaaaggtacatgtactgtacttatcagtatgcagtgattttataaatttgctaatttcagcattctctatgttttgaaaataatattgcttattgaagcaatcatgcttatcaaagacacacatacctggagttaaggtacacgtgccatttgccattagcaaattttttgataggtgcaacactctctaaaactcttgacagattattttactttattttatttttttattttttatttgttttgacacagagtctcactctgtcacccaggctggagtacaatggtgcaaacttggctcactgcaacctccacttcccaggctcaagcgattcttatgcctcagcctcctgagtagctgggattacaggtgtgcaccaccacacccagctaatttttgtgtttctggtagagactgggtttcactatgttggccaggctggtctcaaactcctggcttcaagtgatccacccgccttgacctcctaacgtgctgggattacaggcgtgagctatcatgctcagccgacagattattttaaattataagtgctaattagtattttgggggaaaatttttatttataaannnnnnnnnnnnnnnnnnnnggttcaagcaattctcctgccatagcctcctgagtagctgggattacagatgcctgccaccaacacctggctaatttctgtatttttagaagagacagggtttcaccatgttggccaggctggtctcaaactcctgacctcaaataattcacccgcctcagcctcccaaagtgctgggatttcaggcataagccatcatgctcagccgacagattattttaaattataagtgctaattagtattttgggggaaaatttttatttataaaatgtcaagattatactttagagaatgtttataaaatcataaagaaattatgctgtttttttttcttaaaaaaaaaaaaaaacccttcagttgtgtattttaaagagactttaatataacagccattagccaaattaagattttggttatttctgctgaggtgggcagattgcttgagcccaggagttcaagaccagcttgggcaacatggcgaaaccccatctctaccaaaaatacaaaaaaaaattagccgggcatggtggtgcgtgcctgaagtcccagctactcagaggctgaagcaggaggattgcttgagcccaggaggtggaggttgcagtgagctgagatcgagccactgcactccagcctaggtgacagagcaaaaccctgtctcaaaaaaaaaacaaaagaaagaaaacaaagattttggttatttctgatatttaagaaaaaatgcattattgattcattaaaatgtaaacttcctcacttggctattatatgttttaacttgtagagagatactttttgtagaaagaaaagtgtcacaggccctataaagttacacagtttgtccaaataacacagcacaaagtgtccataaatggtcaatgactaatactgcttcatgtccatgagtggccatgtggagagttgaaaagcccatgggcattggaatctgggttcagatatgatctccgtcacttgctagctgtatcaccttgggttgcttatttatcctgttgagtgtcacttgactcctctataaatcaagaacaatgagactcctacatcacgaggtgaagtgtcttggtgtggggcacacccaccttggtcagcatggtgctcttaaattgcttttttttgtttttttggagacagagtctcactgtgttgcccaggctggcatgcagtggcacaatctcagctcactgcagcctccgcctcccagcttcaagcgattcttctgcctcggcctcctgagtagctgggattacaggcgtgcgccaccacgcctagctaattttcgtatttttagtagagacggggtttcaccatgttgaccaggctggtctcgaactcttgacctcaaatgatctggccgcctggggctcccaaagtgctgggattacaggcgtgagccaccgcgcccgaccttaaatcatttttgatgccatcattctgttcacttttcacagcattcttgggaaatgggctcagtgaggagaccaagtacagaggccctggctaagtaactgtccaggggctcaccactaggacatggcagtgctggactagacccaggccccctcctccccaggaacgctccttcatatgagggccatgcgtttcagtataaatatgtgtgaagataatttttaaagcacacttttatttttcatcccttttagccagaaaattgcattcttattgactcttagaccaagaatgatcctcagtcatttagatcacaaaattaagaaatatttacttttccatagaaatattaaatggttataaaaattataacacccctatgttcctaaatggtgctttattaaaaatgtagatatacattcttttctgttttcagtctgcatttgaagtgtttgacaccgtcaggtgttctggatttaaatgataaaaagcattatccaaaaggaattagtgaccctgaacttaaaaacatctaatagtctctctccctttttctttttactagacgtgtgcctatagtttgttcatatgaaatagtctttatgcttcagatgcaaagtgtaatgtacataacagtatatacttagtttttcaatcatatgagctttttgccaaccttaaagataaatcattggctgctttgggcacactgcctattgggcagtcctgctccacagggagcagtgtaaaaaaaaaaaaagatatgtggtggagattttgtacattaaagatattgctttaaaagcctagtgtatttggctaaatgtggattctccaaggaattacgtcttagttattttgaaaaacatgcatccatttacatggaagacctctccagcacttagaaatttctgaatggggggagcctatggccattgataacacatccaagatatctttgagataagtcaatgtcttccagggttttttgtggcccttcattgacttttatcttggagcttgtcttggaacttgagggagtttttgtttgtttgtttgtttgttttgttttgtttttaatggatgtgagctgggagcttgacctaaggtaggatgtccatctcagaggcagggggcgccctttgccactctggcagccagaagcccagccttccattgcccaagtccacttcctgttccttgtttttgcagcatgtgacccaggcctggggcctcactgagctgaggacgcctgcatggttgtaaagctgagatgcacggcacagactgtttctctccttcactggcttccccattcattttccataacatccattgttggttgggtgtatttttatttctgtcctccaaacttccttgtagcctcattctatcttagtatatctttgggccatttggacaaccttatgcctagagatttggaaaaaccattttcgctttgtttcgggcttcgtttgtaaagtgtctgctaagtttctcttgcttcccctttgaaatactgctagacatgacattctgtgtccatgaagtataaattggatttctgagcaggagggttacatatattaagtttctttgaaaggaatctttcctcttttgctataaatatgagttgccatgatgtaaatatatatttgacacttgctgaaggaaaccgtaactcttattgacgctttagacaagaaccggcaatcttaaaactgtcacaaaattctggatgctgccaacttatcttaaggttccctcaagatgttcatttatatttggggatgtaagcactctgagtccagaaagctaggcagtgctccaacaggtccccacagcagaatcgcacacccccatctctattcgcttgtcttagaattagtcactcgggctctcatggtgccaaaaagaagaatgaaagtggagatgggcatttaaatgtgttaagtacagtgagagtcctgtgagtgaatgctcccctgaggtctaaaaaattagcttactaggctaacaggaaaggaggtaaaaatgaaggccaagaaatagaaatagaaacataaatagaaatatagtagcttgtcactacaatagatgagaacactaacaacttagggtagcccaatctgaggacttaaaggaacaaaatagctatgagtgtgatatatatatatatatgtactattgtattatgtgcgcacacacacacacacacacacagagtagttttgttttttgttttgaggcagaatctcactttgttgccccagctggagtgcagtggtgcaatttcggctcactgcaatctccacctcccgggttcaagcaattctcctgccatagcctcctgagtagctgggattacagatgcctgccaccaacacctggctaatttctgtatttttagaagagacagggtttcaccatgttggccaggctggtctcaaactcctgacctcaaataattcacccgcctcagcctcccaaagtgctgggatttcaggcataagccatcatgctcagccgacagattattttaaattataagtgctaattagtattttgggggaaaatttttatttataaaatgtcannnnnnnnnnnnnnnnnnnnggttgatagagatgacaacgatgatgatgaaaataatgatatcttccaaatatgatatttcatctggtgtgtcacacattactttgtttaagtaaggaactatgcacagatggcctcttagggcccccataagttatttcctgccagggttgggttcaaagttatatcatttaaatagggtattggccaggtgcagtatctcacgcctgtaatcccagcattttgggaggccaaggcgccacagatcacttgaggtcaggagtttgagatcagcctggccaacatgatgaaaccccgtctctactaaaaacacaaaaactagctggatgtggtggcgcatgtctgtaatcccagctacttgggaggctgaggcaggagaatcgcttgaacctgggaggcggaggttacaatgagccgagactgcaccactgcactacagcctgggcaacagagcaagactctgtctcaaaaaaaaataaaaataaaaataaatacagataaggtgtttaatttagaaaagggaaagaggcctcttcctgagaattttcctttttcttttaaaaatgcccaaaatttgtcatgcctttggtatttcaagggctaagaatttggtacctagcaacattatgtattccaagaacttattccccgatgagcggttgtgatatgtgaaaagcacattctgcagaattgctgagatgggtgtgttattgggtctctctttacctgatttttaaaaatgctttgtgggaagttttaaatgattatagttacatctgcttacaaaatttgaacaaagtagtgttttttttttttttttaaaaaaaaaacaactagagaggtgaatgtttgctgaagacatccagcctaatatagaaccacacccaactggtgacagcattcagccagaatccagtccttgggaattcagacagctactccataacctttgagaggctttgaccatattcaagaagtgaggggcttctacaggcactggccaacacagggtcttgttgatagaaatattttaatccctggacaaatgtctaattctaataaccttaaagtttgtgtcctgcatatgcagatatttttgtgtgtgcgtgacactggctaataatgataaaaactgatttaatgggggttcatttgattgtgtattataaccaaaacctacgagaactttcctggaaacatctgattttctgcaaggacagtggaggtctatgtgaaagaacaaaagcatggggcaggggggttcagaagcagtagtaaaagttgagacccattataccttctttcgagaaaagaccgtaagaatgattctgtttttcagttatggattactcttgttaatttctaatgttcataggattaaatcatttttcttcagtgaaacatttatattggagttgtcaaagattagctgtaatgggaaacttataaaaggggtgttgttgtgagcccagtgctgtacacaggtctttacttatcatcatcatttacttggaaactgtgacttaagtgaattgaaatattaaaaaaactagtttttcccctcatcagtgttctaggttgaaataaacgacgttcttcaaggacctgctatatgttgttttgcttaaagttgcagtttccagccgggtgcggtggctcacgcctgtaatcctagcactttgggaggccgaggcgggtggatcacgaggtcaggagattgagaccatcctggctaacatggtgaaaccccgtctctactaaaaaaattcaaaaaattagccgggcgcggtggcgggcgcctgtagtcccagctactcaggagggtgaggcgggagaatggcgtgaacccaggaggcggagcttgcagtgagccaagatcgcgccactgcactccagcctgggcgacagagcgagactccgtctcaaaaaaaaaaaaaaaaaagttgcagtttcctgtaacctgttgatattaagtgaggacttattgcactagcatctggcttcctttaatttagagaaaattgatggtgaatcttgccatggtgcttgctaaattaggccaataaatagctgtggaggtaattaattggcctccttcaatcattcattcacagacatttattaagcacttactcctggccaggcgataccctgagcactgatgatgacaaatgagaccaagttttaattcagcaacaggtttaaaacactatttccttctaaatgcaaattataatcttccttcccctgttttcctctgtgttttttatactcattttttcccgataggaactagttacttctctttaggagagggataaatgagataacatttttataaattagctttttaatagatcaatagtttgggatgatatttcataatttttaggaactaatatatgacttaaataataaagtcaacattataacatatttgggtctggatgctaaaccagctcttgagaagaaaagacaaaagtttcagaacaccaataaccaaaagccagaaatctaaatttgactcagtaatagacacagatcccatatttggaatatcttactgcccatttagtgtagatctgtactctggttacttaaaaatgtacatgctgagacattaaaattctcttaaatgtatattcaaacggtaacaattgacatctttcacacttgactggatagatttagaaaaatttgacctgaagcaactggccagacctctattttctgatgatctatgatttatttaaaattattagtgttaatagataaataaattggactttatcaaaaattttaaacttttgtgcttcaaagaattccaccaaaaaagtgaaaagacaacctacagactgggagaaaatatttgcaagttcatattatttctgacaagagacttgtatccagaatatataaagagctcttacaactcagcagtaaaagtcattacccctactaatttattgagctttaatagtcctgcatcttctggtgtcttcttgagacaagatgtttgcccagacatagggtaggaggacaatttaggccagttacaaatctctttctaattttgcacaagctgaattagtttatcttggccattctcctggtcagaagggagtgatggtggctatggtggcacttaaagcttttgcagccacccctttgctctcttttctgccctggtccctcttctctcctccaagagcaccatgccttccagacaaggtggccagtcctgttgctcctccagtctgcacccttccacaccctcctttctcatgacattccagctgtctggaatatgggcttcccaccctcccattcacctaccctctcacctggtgagcttactctttgatgcccagctcaaacctagcttgaagaattggtgtcaccttcatctgagtctcatagcatttttcttatacctcagagtaaacaattgcatgtcattatatggcatttaagtttgtctccttagatagcctctaagtcccttgagggcagggactatatctcattcatctatttgtcctcagtagtactcagtgcccagccatagtaggtgttcaataaatatttcaatgattgaatcattggcctgggttgagcctcatctttgaagtgaaagatggggagaggtataaatggtcgtgaaatacctggctgacacgcgtctgactctattttatatatttcaaagtgaggaaaacagaaacatatgcaaacacgctgcaattgaaggcactttgtattcctaaggggaaggacttggtgaccacacgggttcccagacttaaccttcagatcggagaaacctctgctaattgccagctgctgccatcatgcttgagagtgatttgtatttgggtttgcctagcccgctcctttacacgcttgggatttaaccacctgacaactgatcctgaatcatgagcaagcagctttccatcgctcccaatctcccctccatctaatcagtttgctgcgagctcacagctttcaatgcatgccattggaatgacgcacctgaccgctagctgcttctaacccagctccacctgagttcaaatctctgcaacggaaaactaaacctgatatcacctttgcaagtcaagttgataaattgagtttgtttcttttgtttctcctttttgatgaacctccttccagtctgttgttttgaatttttattacacttgctttgttttctttgtttctctctcccttctctcattttgttttttccattcttctcattggaggcaatgagccgtccagcggccggaactcccctctcccttaccggccagacagccgccctctaactccaacttacgctcaggcccctaaacatttccatgttccaggtaggagctgacacagtctgtgtcttggtgtcctgtcacagtgtagaatgtagccttgtaacctcgtcttgtctcatctctcatgctcttttaattgggatgcacagttaacaaaccctaaattgcaggatctgacctagggggcctttcaaaagttttatgtgttaaatgccaggattatgttgaaggtttatgttttctaaaataatttttgaagagtgtgggtgatgggtaaaagcagttgggttgttttgttttgttttttactaaaattttaattgtacctttttatcattgccttctgagatatctttctgtggtttgctgtcattgactaattatggcaatggcaatctagttatcttctcatcctaaagactgaaccacagtatcacctgagagaatacttttatatttcctgtttttctctaatgtggagactttctccaaggacttttcagagagatgtagaattgggtgaattggttggtctttctgcagcgcataacagactagccatctccatagcccgtgaagatatcttgcaatttaggcttggtgctgcaagctttgctctagtagtcacaagcatttgctgtcataatgcaaatagtaatttgacatcagaaactgaaataatcagagcccattaatataatatcttaatgtttagaatcagctcactttgtaaggacaggattagccatcagaggtaataatactatatttctaccagcagtatattgttttttgctttgtttagctactgaaagtagtttaataaattacccactatattaatgtaagtgtacatatttagaatctataatcatttttttcttttgcttctaaacttacctaataaaacagaggaaagttcactgagatttatatcacttagttgggactgtcctttctaaaaaagtttaattgaatcttgaaaattaatgttctatatctgggatttttcacataaaaatgccccaccaagatacagtgcccacggttctggggaaacagaaaccttttgaaatttcctgagtatttatagttaaagcaaaatggttccataatccaagggggtcttgtataaatatatacatagtgtttagcatctcttttctttttcattcattctttttttaaaaaatttggcctgtataaattaggatttgttgaacatcccatcagcacaccaggctagccttgcacataaaaagtttctgttttttttaaaaaaacttttgatttttctacattgctttccactgttccactcattagttgaaaagtaaattgagccactggtatctactgggggctcaatttctagacaatagcaatttgggcattttccccaagctggttatgtctttctcaccataagagtacctccactgcttgcgtttcttcctgttttaatcccactttcaatgaagtgtgtatttgaaataaatggctcatgagttaatcacatctttatatatcctaagatgtattacaaaggcttccataacacttgtctatagtaagccactcatttctataatttttctttcaataaactcaatctttgtaatacagaaattaaccttctgggttgtttttgttcaagatcttcagtttgatttgccccttggttgatctgtttttcccatcgctgaactggttcccataatcacacacctttgcttttcatttccacagatcaaggaatcaacatttaccgaaagccacccatctacaaacagcatggtaaaacccgctttcctccgcgtagcttttaaatagcaaagtcagctgaacttctccttgctgtcctctgaaaggcttttcctgctgctgcttttgagagtaaaactggggcatccagcatattatgcctttctggtctactaagatgtaaatattgtaaaattgattctcctggatggagagacttagcttgattagaaagcttctaacctgttgctgagcccatcaaaccatgtatcattctgttcctagagaaggggaagtactggtcacacagcaactcacaaacatcctagcaagtcttttttctttttgccatcaaatatagtcaccctttaaaataattttgatgagactaatttaaactggtgaaaaaccagccacctagaaaaactaatttgactgagcctacatcaacttggctgtccaggtctccagtttcttattgggcatgaagatgtgtgcacagtggagtggacaggatacaggctaacacagaggtcaaggctctgctcccactttctccctaaatggctctgtgacgtcatttctctgtgcttcagttttctcttctgtaaaaaccagttagttagatcagtttgtctctgaacttcctgcaaactaagaatcactaacgtggatgtataattctgttttcctttttttaactcaggaactcacatgactttatgtaaatcacattttcctccaccattattaagtctctgtagatatatcgaccataaatctttgtgaaaagatatctaaagctggtcttcaggcgttttcagaaaattctacacagattgtgcctggaaatttgaaggctgcctttagaattcagctgacattcatgagtccttaagaattaggataacatgaggccaggtgcagtggctcacacctgtaatcccagcactgtgggaggccgaggcaggtggatcatttgaggtcaggagttcaagaccagcccaaccaatgtagcgaaaccctgtctcctctattaaaaataccaaaaaagttagctgggcgtggtggcgcacacctgtaatctcagccacatgggaggctgaggcaggagaatcacttgaattcaggaggcagagattgcagtgagctgagatcacaccactgcactccagcttgggcgacagaatgagactctgtcgccaaaaaaaaaaaaaaaaagaaagaaagaaagaagaattaggacgatgtgaaaatcaaaatcaaataacattgaaaatgcgtaaggaaaaaaattttagaccaaaatcaggaagacaaagagaaatgtatgtatcgtaatggttctagagctatgattttttttctcatcttttttttttgaggttttaaaccatacgcttgctttttaagtttgttaacattgtttttgtttttgtttttttttatggtttattgtctttccacacactcattaacatgtgaatgtttaactactgacttcaccaattctaatgcgtaagtactgtttgaagtcatccttttgttgttaatttaagaataaaattctcagcatttgatttgtcaacttacaggctttaaaaaatactatctttaggtcctcctctctgaacaaaaataatcaaataattaaaatttaaggagattggataatgttagattatttgtttggaaggaattagttgacttcttttcataatatttactttgactgaagtctttcaggcctttgttataattaattaaaaatagcccagccagagcagcgctttccaaaggatgtttttgcaaaacagccattccatgccaaagaaatagttgttatgcccaaaactggtgtctgtgccctgatgcgtttgagaaaggctagatttaaatcaagtcacatttgttcttcataatgcagaacttctgagaacttcttatatgctaacatgttttgtccatctttaagaaggggatttcctatgtagtgttttccaagctgaaatggttttctcatgaggttagagattcagaggaacactgtttcatgcctggccaagactttacctcctaaactgggcacagtggcccacacccatagtctcagctacttgggaggctgaaatgagagacctgcttgagtgcaggagttagaatccagcctgcacaacatagcaagaccctatctccaaggaagggaaaaaagactacccctttgtattgggtgaccttggttgagttatttaagcaaattgagacccagaaggttacccgaaaaatggaggacttagagctgaagattcaaaaggttatttccagattttaaaatatgtaagcccagaagaaaaaagttatttaaggcattataaatacattttgaaatatttagtgacatccctggccgatttgcaaaattagccagaatcagggactgtccatttaacctggtttgttttgctccatctctgtaggttagatctggggctctaagctgtgactcctcctctaagcatagccaataagaactttgtgaactaatattgctgctagtttggcttttgttgttttaaagttggataactcacttgtgtgcacagacctttgaacaaaacaatgagtggaaacggcaaacataagtttcaatgccaaattcctgcaagctgaaagtggattttccaatttccatttctcctaggactcaaggacacatgtatttagtatataaggattagaatgaagtggaccagacagggtgtggtggcccatgcctgtaatcccagcactttgggaggccatggtgggcgaatcacctgaggtcaggagttcgagaccaacctggccaggagaaaccctgtctctactaaaaatgcaaaaatcagctgggcatggtggtgcatgcctttaatcccacctacttgggaggctgaggcaggagaatcccttgaacctgggagacagaggttgcagtgagccaagattgtaccactgcactccagcctgggcgacagagtgagactctgtctcaaataataataataataataataataaaagaatgatctggaccaacatatttgtggcttcttgcccaaagatgcaaagcccgccaaccctctaatgattaacaactacagtcaagtgatagcgtcatgctttcaacttagctctttaattttagattactaattactctaggagagtgttgtccactggaactttctataaggatggaaatgttctatatctgcactggccaggacagtaggcactaatcacatgtgactactgagcagttgaaatatggctagtgaaactgaggagcagaattttaattgtattaattttttttgtttaaatagcctcatctagctagtgctgggcagcactctagaatagggtttttcagatgtagaacacatgtagaatgaagctttgcttctgacgtaaagtaaggaaaatgagttgacttgtcaataggtacctctgagtgactgggccatggataatggtaataaacagaactttctggaactgaaacttttgccagagaacaagaaaactatgtaagtggggttgtaccgccattgtcttacagaccaatagctaagcaacccctgattcccatctagatgcagctgccttggcagcccagagcaagtcctcagaagatatcatcaagttttccaagttcccagcagcccaggcaccagaccccagcgagacaccaaagattgagacggaccactggcctggtcccccctcatttgctgtcgtaggtatgcaactgtcacggctaagtcaaagggacaaactgctaggagagctcaagatgacatgcttaaaaacatgaaagaaaatgtatcctattatgaagattttaaagaaaagtatgaccaagaggtagcatagtgaaaagaactaacgtggtattaacttgttgtacaaaacgcttaaaagttacaaaaacacatccaccagagtcttgttctaaccaaacccactgggatccagaactggtctaaaaccaatggtttgcatggactctcagagttaatactgcagaatcagtaactctgttgaacatagttgagtgaaagccttatggcaagaacattgttctatataattagagtctagtgggtgaatttaccgaatgtttgtagaagcatgacttctttcagttaaatttgttttagactatttctgggttgtagttataattcttaacaaccaatcttaacactgaagcactttcatttttcttgtaagatcatgttgtccatcatgcaaaagggctattgcagagtagtaggtgttctgaaatattacttctgtgaagttatgtgattttacatctaccattttcatgaattctgtgctaaaatgtcatatttcagctgtttcattctttgctccatgctttccaattatgtctgtgtctttactatattatcagtagtgaacctactcggcctaaaaagaagtattagcaaactcagaagctaatactgaaaatttagcgagtcagctttacaaagacacgatcttatcacatttctgttaacaacctaaaaggccttcaattttccaaaatgtcctaatcttcattgtgctatttttaataagttatttttggaatatctttcacaagcaatacaagtggattttaaatcaattgatacttatagaaagagtttaaggaaaaatctacctcctaagttcattattcacaagtgttgtgtacattatattaatgaaatttatctagtccttgcaaacttgtgcctattgattttcattagtgtaaactaaagagagaaacttcacactgacatttataattgtaagaactaagaaccaaccatcagcttttctatgccaatccatgcccttcaggaagttcttgaggccttgaggttgctagtttagtaaattgcttactgggacattaaagcagctacattttggaaagagggagaattaagtttttgttgttgaatttattatcactaagtagtttaaagctcttttagattccaaaaggaggaaaaatttcaggtccattaatcaaaatgctgaaaactaagactattagttaaagtttattttgattagattagcaaactttcctgtttcctcccacagccagattaatccaagcaatttaggaaaacaataattatcttaacctctcaaccattcagacagattcctcctttcctttccctgtctcccctttccagaaagctaaaaaattgaacacaatttactatattgttccaaagtaaaattgtacctgtattaatgcttttgatttacctattagtataaaactcttttgtgaccatttttcaaaggatgagaaaaagaaaaccttagagacccatttctcgaaagaaatagtaaaagtatgctttttattgaatttactaagagtagaagacagagtgatagtattatgaaattctaaatattcagaaaaagagaaaactacaaggtttaaacgcatgtcacaaaacaatgactatcttacctatctgttggtatgtagataaatttgcatttctttctatttgaaaattgaggctgggcgtggtggctcacgcctgtaatcccagcatttttggaggccaaggcaggaggattagttgagccctggagtttgagatcagcctgggcaatatagtgagaccatgtctctataaaaaatatttaaaaatcagtagggtatggtggcatacacctgtggtcgcagctacccaggtgggtgaggtgggaggattgcttgagcctggaggtcgaggctgcactgagccatgattgcatcactgtactccagcctgggcaacagagtgaaaccttgtctcaaaaaagaaaggaaaaaggaaattcacttcaaagacatcaaaataacaactggagatgcccttccatttactaaagtgatctctgaccagtgaacttagactaagttgcaaacccagttctaatggagcagggaggcctaaattcaggccttccttgcattgcacgttgacctggcttgtcacacagggccattttcttgagaaaccagccagtagtgctgagttggtggcaggcatttttgttttctcttgtattgtttacttaaaagtgttaaagaccgttgctgaccttgccagcctaacaaactgaacacagatggactagcccgttaagattcccttgtcttggggctgatgtgagaagttgtctttgctgtggaattaggacctgacatgaaacgcagatctagtggcagagaggaagatgatgaggaacttctgagacgtcggcagcttcaagaagagcaattaatgaaggtttgtccttaaactaccttgctgctgtcttcaatgctagttacataagatctatattttttgaatgactactatgtataaaccatctagataggcaagaggtggtcccagtcttcaaggggcttgaaatctggcaggcaaggcaagacaggtgtctgttaatagtaactagaatatggcagaatacctgctgggctctagaggagatggcattggtgctggaggtcagaggggtgtggaaggtttgggttgttgtgggaaggaaagagagaccacatgggggcatgtgtgcagtgcatgtgttgaaaggctgctggagggccaggcagagcaaggtggtatccacccaggtagtgccacaccttccttccctcatgcagttctgctgaaggaatgactgtgggattgaacatttctccaagtcttttcccaggatgtgggccaggagaaaaggaatgaaaggaacggccaccatgaaggggtcctcttcataccctccttcctgtagcaagggcctgcagcagcccagaaggacagtctgttatcagtcaagaggctgctgaatcctttcaaatgatgttttctaagcatataggaaatgcacgtgatattagtcaaaggatacaaagttgcatttatagtatgatctcagttttatatgtgtgtatacaaaaatactagatagatataaatcaaaagatagtgttatttctgagtgacatattatgggttactcttcttttcttctagattttccaaaatctgtaaaattagcatgtattacctttatttcttgtttttaaacaaatcaaggcaatttctttttaaaggataccagccccagtcttcccttcccacatcaaaaatccacacacactcacacatgccttctgaggtctcctggctctttagggaaagcagaggaaggaaaacgttcttctaacacagagcctgacttagggaaatggagctttgaaactgaaagggctaagagggtttagggtcccaaacttgacctacctcttcaggaactaccaggctctggggccacatgcattcaggccctccagcaagagaaacttcttgtgggatctgctacaaagaaactgcagctccatgaaagtaattgcaagctttgctttcttttttttttttttttccttttttctgtgaatagcttaactcaggcctgggacagttgatcttgaaagaagagatggagaaagagagccgggaaaggtcatctctgttagccagtcgctacgattctcccatcaactcaggtaagcagcaaacccccaaccttccctgattcgagagccagccacctgcttgtaaggcacctgccttgactgttcacttgtggtggaacctacagagtattccacgggaaaggaagtgtgggaaacccactccatgtcaaatgagctcataagcatgtcatgggtcttccataaatgtgtgtttcctttcttctggaaatgggtgaacccttggaggttctcaaaatccatgaaggccaatccccatatactaggtttgtcttctagaacactcatctccaagggaagcagcaaaaggaaatcctctaaaaaacatgatgctttttttcttcttctttttttttttttttttttttagataacatgaataagacattttctaagcattatgattttacattaatatcttcaatagaggccgggtgcggtggctcatgcctgtaatcccagcactttgggaggccaaggcaggcggatcacctgaggtcaggagtttgagaccagcctggtcaacgtggcgaaaccccatctatactaaaaatacagacattagccaggcgtggtggtgggctcctgtaatcccagctactcgggaggctgaggcaggagaatcacttgaacctgggaggtggaggttgcagtgagctgagatcacaccattgcactccagcctgggcgacaagagtgaaactccatctcaaaaaaaaaaagaaaaaaaatcttcaatacaagaactgaggatgaacagtgtttttgatacttttgaagaagatgacttatacactgggctgaaatagcctatcagtgtattttcccctgtatctatttgtcataagccaattctctcttaaaccacaagatttcttctctcatattctgagctagagcataattttctcctctaagagttcctttaaaaatgcatttagtggggagaccaaggcgggcagatcacaaggtcaggagatcgagaccatcctggctaacacagtgaaaccccgtctctactaaaaaatacaaaaatcagccaggtgtggtggcgggctcctgcagtcccggctactcgggaggctgaggcaggagaatggcgtgaacccagaaagctgagcttacattgagccaagattgcgccactgcactccagcctgggtgagagtgagactctgtctcaaaaaaaaaaaatgcatttaatgttcactccatgcaagcatttttgctaaacattttatttaatgttcacaacatgccagtgaagtagatgtggttgttattagcaactgcagcattttcatctctattttagaaatcaggaggctggtatagaaattgagttaacatacccagcgtgatacgccaataactagcaagactaggatttagaagtccacatattataaccccggagcccacacccttacctggaattcccgctacccttcatagatgcctcactggcattgatcttggattcggtggtttacaaatctttagagttccttggaattctgagattctgctctataagaatgtataacattgtacctgcatagatgaagaaatgaggacttcagaaagattaaacaccatgtccggagatacagaggtattaagttgcagaaccagaattcaagcccagggctgctccctctcaagcccagcagcttatcaggcttccatatcattgacagataccctgtatcaggcctcccaggaggccagctgtagatggctggtagatcttgataacatacagggttggcttccagttcagttactgctgccttatcaactggggcatgggctaatgtattcagatatccctgatttacatccttgctcagctgtttagaagcttagtaactgttggcaggatatttttcttagcccctatttctccttctgtaatatggaactaataatcatagtgttattagggttatattgaagattcaaagaaataaagcatgctgaacacttagctccatgccagagctataggaagcacagccagcttcagcccccactcaaccgcgtggacttgactttcccttccctcctcagtcatatcactgtccacccactccttgcaaatatgatggcatatttttgaacatttgagcccaatatgatttgaatttttttggtatttctatcctgtgaggtagaagatactgccaatttcattaaaggattggaccttctgatttcctaacaattggttttttacttttttcttactcagcttcacatattccatcatctaaaactgcatctctccctggctatggaagaaatgggcttcaccgggtaagatttctccccgattcattgtttctgcctttactcccacctcggccctggttgaagtattgacacattgcctgaatacgtctgactcttgatctcagtgttggaacataatgaaaattttaacctccctggttgcctagtaaattaatttgagttacaggcaaaataaaatgtttctattgagagaagaagaaattaactttagataaaagaatggcttgtgtatgattatgggaaaactaaattgcaaaactgtatggcaaatattttttacaatgaaacaaaaagtaattacttgaaccattatctttgctgtaaaaagatataagaatgtgtgttataaccatcctcctcacaaaagatggaacaaatacaattatgtaactatgtaggacaatgcatttttatttatcagcaagagatccctgcttaccaagagcctgctgagtggtggcattagtacactaaaaaagacaaagagatggcatagcagtagaagaatcatagggaaaaaaaaaatgaaggtctgacatttagcttgggaagaattcctaggattttgtaaactctttcttccttttcacctgactccaaaacgatcactatggagatttcctaataattgtttttcctcatttcagcctgtttctaccgacttcgctcagtataacagctatggggatgtcagcgggggagtgcgaggtgaggctcccatggccaggctgagcatggccacgtcttccctcgaggctgaggttcatgagagtcaagtatactggctgtgttcatgctgtattgtatccttagagtaggatcacatctgtcttctgtgagctaatagggcaattatttacaaaatttcaaagaatatctaatgaaatcaaactgtaagaagtgagtttgtgagaatttattcattgctcatactatgtgctgagcactctatcagatacctagaggccaggcatggtggctcatgcctgcaatcccaacactttgggaggctgaggcggaaggattacttgaagccaggagttctagactaggttgggcaacaaagtgggcctgtctctaccaacaacaacaaaaacaacaacaacaaattataataattagctggtggcacatgcctgtagtcccagctacttgggaggctgaggcaggagaattgcttaagcccaggagttcaaggctgcagtgagctatgttcatgccactgcactccagcctgggtgacggagcaagactgtctcttaaaaaaaaaaaaagtaactggaggtacaacaataagtgagacatggcccctgccctcaaaatgcatatggcagaaagaaggtctgtgtgatgaacattgggatcagagatgcagagaaggaagcagtaagtacctttaggttgtcagcgaaagcttccaggggaaaatgttttaactgttaactaacactggaccaggcatttcttggcttcagggaggctgatgggataacatgtgcagagtctgggagcagaaaaagaacatggtttatagggcgaatatgttgggaatttcaatataatatagtctgtgaatggttccttgcttttccatggtctttcccttatgatattttcttttcctttccttttcagattaccaggtatggaacactttgtctttcttgaattggccacaccgatagaacagccatgttccaacccagactgctggctccaaggcaacagtttctgttgagaagatgcttgttgtggttgatctctctagtcattactctatagccgtgaagagcagacatgcctggtgcctgggtcaagctgtccctgcaggccttggggacactgcatgaaccaggccaggtgtagggggtctctcttgctttggccttggagagtcctctctggggtggaagtggaccagcatcaagggtctgctcatatacagtttttcttcttttaattataatctctcagtactttaggccacccttttcctgcgcgttctcaaatgaaaagacactgatgtcttagccaataggagagagcagtttgccctcatgacattcctttctcactagaacctcaatcttgttaaaaaaagaaagaaagaaatgtgatggagaataagaaaagaagaaaaatgcatagaaaatcatgattaaagataagaaactaacaataatagacttgggcatcttttaaatgtactatatgctttcattcatggagcctaattcaggaatttgtccataaccatcaagccaagatctctccccaacttgattgcaaaagagctgtattcctgttcctatacagcaaggatctcattttgaaaaatacatggtcatttagatgacacaaataaaatagtggttaggattggagacccaacagggaattgggagcccaagagtactcccttcagtttcctagactatttcatgcctcacctggaactggcatttctgttgcagacactcccagatggccacatgcctgcaatgagaatggaccgaggagtgtctatgcccaacatgttggaaccaaaggcaagtgcagctgttctttttcctctcatatgggaatggcgtaaccctaaacagatttgatgttctatcttttcatcattctcaaagtgttgtaggctggtgtgttcaggtgagccatgtcatgaatatgcaccttgccattctgctgttttgcccacatcaggtcagcaggttaaacccttactgggcatgatgctgtgtgtttacagtgaggtgccagtccctctctgcctatgaccaaggtattcccttggcctctgccatgtgcattacagagcatatccggtgctgagtggagtggctgcagactcaccatgtaggtgaggcaaccctgtttcaccattgaaagccctgcatttcaagaacctcagtcctgggtacactggggtgactggccaccctagctccagagcaccctgtaccttcagagttgtccaagggctcatgctccctggtgaccataaccagggcttatttcaatatggcagttgccagagcactgcttctgggcctgcctggccccatagattcatgagctagtcatgggacaagattgttaaccccagcacaaatgcaccctgccctataacagcatcctataaaaggtaacacattggctgggcacagtggcttacgcctgtaatccaagcactttggaaggccaaggcgggtagatggcttgagttcaggaatttaagaccagcctgagcaacatggcaaaatcccatctctactaaaacttaaaaaaaattgcttggcatgacgacatgtgcctatagtcccagctactcgggagggtaagataggagggtcacctgggcctgataggttgaggctacagtgagctgtgatcacaccactgcatccagcctgggcaacagagcaagccctgtctacaaacaaaaaaagaaaaacaaaaacaaaaaacacgtgcctgtaatttccattatcttctaatgtttaccttcatcccaatacatagtaagttagtgttctgccactcaacaaagcccccctaaggctcagtgctacctgagacactggtggaaagttgagaatgtctaagattctgtccctgtcccctggaaactggagcttccactggccttgcagaaggaagacccatcactcgaattctgtcatgacagtctcttggaagctctatcttgggagtactagcgtttaggtggattctgcttgttaataaaatggactgtggtgttctagaagaggtgttttctttcttctcagatatttccatatgaaatgctcatggtgaccaacagagggcgaaacaaaatcctcagagaggtggacagaaccaggctggaggtaaaacaaaaccgaaaaatccagtcccaactgcagatccctatgcactcccccaactctcccctaagcaatgttttatttcttcagtgaaaacaaaaaaaaattataaagatcaccctcatgtcataggtagaactaagaaataactttggagaaaaaaaatatccaggttttcacttagatcagcataaaaatgcctggtaatatccagaagaatgacccaggaggtgggcatggtggctcacgcccataatcccaacactttaggaggccgaggtaggcagatcacttgaggtcaggagttcaagaccagcctggccaacacggtgaaaccctgtctctactaaaaatacaaaaattcacggggcatggtggcaggtgcctgtagtcccagctacttgggaggctgaggcaggagaatcgcttgaatccaggaggtggaggttgcaatgagccaagatcacaccactgtactccagcttgggcaacagagcctgactccgtctaaaaaaaaaaaaaaaagaaagaaagaaaaagaaaaaaagaatgacccaggagacacagaatgatttcagtcattttctttgaaacttgatgttgccataattatggctggtaattcagaatgggagtcgctatttctcttgagatagtctcagatccttatcttcccctgagctggggttgagttcatgggaggctgtgggagcggcaaaggctctcaggagagacatttatactgatttatactggacaagtttctttcttggctgtttccacattccttgttgaagggttatctgggtacatgtacccaagatctccttagacatggaagactaatttttgtattatagttttccatcccaatgattttaattaagaaaaaccctggctgccagtctccgaaagaatgcttactttttcctgacaaaaggcagtaccttggcgtagaggtacagagaataaaggctgcaggatcttgggggaacttttctaggggggaatgactgatgggaagtcttctcagtagaacagacatccaccttaccccctattcctcagccaggaggaagccctggggctccccagggaccacgctggaggtcattttctttggctttctattgcgatagtccattttccctgcatcttctcaacgttccaaggacctgggatggagttgtctccaatgtaataaatcacctctctgtgtcccatcaccagtcagtgttattattataatccccattaatactctgccagctcttttatctgatgggaagggctcctcacctggcccaaccaggtaagggatactgatgtcacaagcattaaagatgggctcctctcccgtcctcctgccttgttcttcagaatgactctgtataaactatagagcaacgctcaaggccatttgtgtggccatcaggactgacagcagctcttttttttttttcttcttcccagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagatgcctccatacctgtgtttcatttctcgttccctggctccctttgaaggtctatctcattttaaaaagcaccaacgcaacttccaataatcaaaacaaaatcagaatgaacccaaggctgtgggaatgcatttttatcatgcaggtggaaaaatgcagcaaataacagcaggatattccaggactatgtgtccaataacccagaccatattgaccaagctgtccaaaggaaagaaatgtttagtagagccattacactgtgctgtgtcatgggtgtttgatttggtttgtgacacagcagggatagtcccatcatttcgacaaagctggggatttgaggaggtttgaagcttctgagccactatgagtgtgggccactttttagtaagaagctagaatgcagtaggagaaaagcatccttccaattttgggcatcccctgcatgatcaaactttacatgaagaaattgtagatgttaacttccttgttatcatcactgccaagattttaggcttgccagaaagtacaaggatctatgtccaagatggcccactccaacgatagccttccttctgctctgtgtctgctgagactacccaagacccagtcacactggcattcacatgaccctcccctggaagcgggatgcaggttgttttcaagacagttggcatctttagttcaccaccatggaaaacaggccgggagacctcagctcaaggtctgtgttctgctcatctctgcctccacccgtgggaaagcatccctgctgtggtccataattaccatagctaggggtcatctccagtccttatgaactctctgtgggatttggctctggtggccacctctccaatggaagttgacccgtgcctcacttcagttgctagactttagtcagcgaatctcacactgcctttgctgggagtggaaggatctcgcctcacccactgctcagctgcctctcccccagtaccctgccttcagatcttgccaaaccactgcaagttcccaggacataccatgcttgctccctcccaggcagctttatcaaaggtatttcttctttacgatgctcaactcttcaaggaggtggtggagcagagaggacctggccccagggaaaggaagtaatgatcaatgttgactctttaaaaacagctacccatcagctctttggagttacccatgtgaatttcccatgggctccatttgttccaaattaaagacaagtccaagttcacaccctctctatgagcctgtcttaatgggcccagcccaatctgcatgtaattctttgcatgcctctagttgaacctcaaggtcggtacttagcaagtgttgcctcgaactgctagctgcgtgggtttctgctcttcagttgaactgtagtgagatctctgtgctgagcgccaggcaccctagcttggcataactatattgctcgtgagagcctttcaaagtagacaattgtagctccactatacaggtaggaaaccaaagctcagagtctaatcaaacatgcccaatcactcagccagtgagcagcagagctagaattctccaggtctgcccttttcagatcccatgctgttatcctccacatcccattccctgtgactttcttagggcaaggactgtgtcccacattctgaatctcccagggcacactgcacagagtgggttcttagtgtgagactggccagcgcccttcagtgtggccatgagccccaacactaccaccaaggcgcatttatgaacagtttgggggttactcactgtctgtgtgtcttggagcctgtttagcctctcttcagcctcaatttgttcatctgcagaatggacaagataataatatccatcaaaagactgttgccaaattatagcacgtgagcacttaggtggttgaataaggactagtattattttaaataatcatttgagaatgaattagttttcactctgggctttttacccctccctctagtcattttgtttgtgttcacagggccttcctcatggattctccttctagtctttatataaatactccaggattaaaataatcccacgacctcttttacatacttcaacaacagcactctctccacccaagcatagtctaagatagagatcccctgaagatgtgctaattagtagtaataataaccagaagtattactcagcagccgagtgcagggtatagcatcaggctgcctgggttcgagtttcagctccaccaatagctatctgtataactaacaaattgtttaacttctctaagcctcaatttccatgtccataaaagaggaataataatgatacctaccacaaaaggttattatgagaattcctgcaggacaagagcctgcatgatactaaacgagcacttaaaatggcttttattcaggcccggcgcggtggctcatgcctgtaatcctagcactttgggaggctgaggcgggcggatcacgaggtcaggagatcgagaccatcctggctaacatggtgaaaacctgtctctactcaaaatacaaaaaattagccaggtgtggtggcgggtgcctgtagtcccagctactcaggcaggagaattgcgtgaacccgggaggcggagcttgcagtgagccgagatcacaccactgcaccccagcctggtgacagagcaagactccgtctcaaaaaaaaaaaaaaaaaaggattttattcatgaagtagctgccatgtaataagtactgtttgcccagccccgaactaaacaatttctgtggtttctttcatatacttccttaggttccttccattttagttaaggaaacagacccagagagactgtctctgagtagtggggctgagtaggctgaggtgggtggatcatcacgaggtcaggaaatcgctaccatcctggctaacatggtgaaaccccgactctactcaaaatacaaaaaattagccaggtgtggtgatgggcgactgtagtcccagctactcgggaggctgaggcagtcctaaacactgcctatgggcaagtgtcatgccgagaggggcacaggtgcccccaaagcactgtggccacccagcatggcagactcctcaaactggaagcgttcagaggtgccaggttgggactcagctgctccagagggttttcctgggttgggaggattgtcctagcctactccggcggtgcttagaaacactccctgtggaagagctgagactcattctcatgaaagatggtgtttgttccagaaagatcttttcaatggtatgactcacttcaaagcaaccaaaggctgtaaaagttgagctgctggtcctgagagtattgagggagaaagccaccaatcctccccagcccctcttgcccgttgctggaagaaggctactcttccccacaggtcattgccagggtgtgtctgtcaggcccaccctgctggaggtggcccactgtgggccggaaagcactgggaagggcggggacttggagctgtcagcgtttgagaaagccagggtggttgggagaatagcacccaaaacttcagggaatctcgaccccagccctaagaactcacttccgcaccttcttccccacaggagaccaggactctgaacaaacacttcccttctactctggcagagctcagggataggctgtagcgagtcgggtctgcagaagagggggtaataggaccacatttattttactttccaatctccactggataaaacttgctctccagggcctgctattgtgctgaacacaatcacagctcctggagaggtttttctgtatttatttgtgctgtcccctgctgctcactcttaactcagcccttcccatcagataaaaagaaaaaagttggcttaggaaacctccccttcagagcagaggctgttcctgctttgcccctagcatatgttagccataggccctcccagagtatcccgaaggggctggaggcagggcagagcctcaggggtttctagccccagatctagccgggttgagacccccaggtgtctgagtccaggcactaagaagagaggggtctgatggcagcagcagcgaacattctttgcaggcctccaagtgccaggtgctgggctaaatactctacgtagattattttgtttaatctgagaagggcaaacccaaggctgggcgagctccactgacaagtgggtaggattctagccccctcccatcaagtccaaatgccaccttcctcctaaggcaattacagctctctggggtctccacaaggccttctaaggatgtcaaaaggattgcctacaaagacaaataccaggctttctcagcaaggtggagcctggccatgaataacattttgttctaagctggacggatgctggcacagaaagaataggttctttcgttcctgctattgtcttaaaacatatgcttcttaatgaaaagttagaaaatgttgatgccagttacattcccatcagataagagcgagggtcagctggcttctcctgttgaaaaaaacaattattatgcccctcctttacataaaaacaaggtgcttcatacaactcaagagtaaattgctcggatttattaaccattttttcaatcaaatggcttccacttgcacagacgtgatctatgatcctcacgagccacctgggtgaatgttgctcccttcgatacacagatgagagcctgcctggcttgtcgaagctcaaagggagacttggggaaggagctaagatctggacccaagtctaaccccaaagctcaggcttcagtccacaaagaggctttgattgggtagatctgggttaggagctgggaagttgaatcttacaacaaaatataaaagcctccagataattctgatgatcaaccaagtttgggaacccttccccacatcccaggatctcaggtcagtggcagagctggtctgtgatgaaccaagcatcccttgccaggatttgttatcactgtcgccctaattcacaagaccacagtcagacaaggcctgggaaacctgccctcgctgagacctccatgggaaatcacccacatcttccttcagctcggcaaggctcggaatgcccccgggacatcccactgcagtctgctcaagtgtcaccttatttgcaaggagattatctcttgtaaaatacaaaagtatgagatgagagaatcagttaggtgcacagttgcttaaaggaaaagcaatccaccagtatcctattctccctttctcccctcacaatcttgagaaacctctgaacattgaaaaaaatggcctagaaatgttattattgtaccaacttatttccttttcaatgtactctcgttctcttcgttctattgttaggaaggtgagtataataaatgctggtcttaagttttctgtggagacagtcacttcagggaaacttagtgactgtcctcagggcctggctggagggagattaagagcaagcaagccagaagttgtgattacaaactcttcttttacagaaaggtggctgtttttagttttgagcctttatatcagtgcatatgtagtgggtcgaaatagtgtctcccaaaagatgtctacctggaacctcggaatgtgactttatttggaataagggtctttgcagatgtaactctaccaaaagacacatgcactcaagtgtgctattcactgtgctattcacaatagcaaagacagggaatcaacccatgtgcccagcaatggtagattggatcaggaaaatgtggtccatatacaacatagaatactatgcagccataaaaaaagaatgaagtcatgtggtttgcagcaacatggatggagctggaggccagaatcctaagcaaattaacacaggaacagaaaaccaaatacggcatgttctcacttccaagtggaaagtaaacatcgagcacacagggacataagtatgtggactattagaaggttggggaggtgggttaaaaaactacctatggggtactacactcaccacctgggtgacgggatccatactgcaaaccttaacaccacacaatattcccatgtaacaaatctgcacatgtgcccctgtatctaacataaaagttgaaaaaaaaaaaaagaatcaagatgaaatcttaactaggagattaggtaggaggaataagttcaagagatctcttgtacaacatggggattgtattgataacaatatattatatacttgaaaatcagtaagacagtaaattttaagttctctcaccacaaaaagtggtatgtgaggtaaagcacatatcaattagcttgatttagccattccacaatggacacgtttcaaaacatcacgttgtatcccataaatatatgcaagtattatttgtcaattcaaaaattaattttttaaaacactgcctaaattaggctgttcctttgaagtatgaagtaagtttgattattaatcactagaaagagactatatttgctttaaaattaaaatagaaatcttgacatctcatttctattttctgtaattggttatttttaagcaatacaaaatgccaagttcataaagtttattgtaatgagtctgttctggctcccagaagatgcctcagttcaaatcgctaagctttacgctcaccatttctcaatctttgtaattaaaacaacaacacagtatttaaatggatcctttccattctgggacaaaatgttctgtcaaagacaggacacgatggctcatgtccgtaatcccagcactttgggaggctgaggtgggcagatcgtttgaggtcaggagttcaagactagcccagccaacatggtgaaaccccatctctactaaaaatacaaaaaatagccaggtgtggtggtgcaggcctgtaatcccagctactcaggaggctaaggcaggagaatcgcttgaacccaggaggcggaggttgcagtgagctgagatcacaccactgcactccagtttgggaaacacagtgagactccgtctcaaaaaaaaaaaagttctgtcaaagctttgaagttctttaagctctttccagctgggtatggtggcacccatctgcagtcctgggtactcaagaggctgaggcgggaaggtggcttgaacccaggagttctgggctgcagtccactatgctgattggatgtctatactaagctcagcatcaatatggtgaactccagaaaggagggaccaccaagctgcctaaggaggggcaaactagcccagatcggaaattgaccaagtcaaaactcccatgctgatcagtagtgggatcgtgcatgtgactagccactgccctccagcctgggcaacatagcaaaaccctatctcttaatagaaaaaattttttaaaggcctttccagtggtaagaaataaatttgttcttctttggccattgttttttctttgcccaaacacatcagcagaggcacgagggagcacctcctagcacacctagcacaagtgagagagctgtctgtccttctctaaagacagccaaatgctgctagatctgtagctttgttgtccaaggatgcctctctttctctgttgctgacgcaggtgtacctgctgtaaaatgttctgaaaacaggtcaggaagtcagcttccagatggaatggccttttccttgaatctctgaatctgcaacccttgaatggagaaagcctccttcccttgtctccaagcagcccaagaagtggatgtcccatgaaaactcatacatattgggaagaaaaaagtgcaactagggaaaaattgcccctgaatataatgaccctgtcgtttcacatctgggcctactccgactgaggatagaaagttgtctttccatttttaggcctcacacattactcctgtctccattgctactttccacctgaatttggttccagattttaaaaaatacactatcagagcactttggttaatcatctaactcagcaacactgttataagaaggcaacatagaggccgggcgtggtggctcacacctgtactcctggcactttgggaggctgaggcggacggatcacctgaggtcaggagtttaagaccagcctggccaacatggtgaaaccccgtctctactaaaaatacaaaagatgcatggtggcacgcacctgtaatcccagctactttggaggctgaggcaggagaatggcttgagcccaggaggtggaggttgcagtgaaccgagatcgcaccactgcactccagcctgggtgactgagtgagactctatctcaaaaaaaaaaaaaaaaaaaaaaaaagaaagaaagaaaagaagaagaagaaggcaacgtagaataaaataactttctggaggtctgggctagcagggggcattcaagtgactgcgcatgggaagtgtgcctcatacaatcagtgcctttgaatgaccacaaatgatgtttcctagttaccctaatttgtcttaattttcaatggcatacagagccctaaagcctttctaagatctcattgtttaatttcaggaacatctgtactgtatctaaagtgagaagcatgaggctggggtgttgtggaaaacatgaacatgaacacaggctgggactatgggagcaactgaggtgtgtaggctccaaatgtcaggcgatgctcactctagggcttacgcaaatgctgaccctgataaaacaatctctgccctcaaagagcttgaagcctggaagggcaacacaggcacgtaactaatagactagatttgaggcttaaagcagacgaaaaagttcacaaaataaaagcaaaaaaaggtggcccaaagacccaactataaaaccaaaaactatagaatttcttgaagaaaatacaggagaaaatttccatgaccttggtttaggcaaagggttcttagaattgataccaaaagcatgatccagagaaggaaagaaattgataacttggtcatcaaaatcaggaacttctgctctttaaaagatgttataaggagaatgaaacaagtctgagattggaaaaagcaattttcaaatcacatatctgatcaaggacttgaatccagagaaagtagataaagaactctcagtacaaagtattgcaaggacgcagaacaagtggaactcgcacactgatggtgggagtacaaaaggatacaatattttggaaaacggtttgacagtttcttttaaagatatacacccctaacataagacccaatgactccactcctatgtatttattcaagtaaaaccaaaaccttagttcacacaaaaacctgtacatgaatgtttatactcactttattcgtaatcaccaaaaactggaaactgcaaatattctttaactggggaataaataaacaaactatagttcatctatacaatggaatattactcaacaacaaaaagggataaacttttgcaacaacatgggtgaattgcaaatgcattatgctaagtgaaagaaaagccaggggttttcaggggataggatcgaggggaggggttgaccacaaagggtcacagggaaattttggaggtgatgaactgttctgtatcttaattgtggtcgtgattacatgactgtatgcatttgtcaaaagacacagaatgacgcactaaaaaaggtgcattttactgcacataaattataacaatttaaaaattgtgaaaaaagaagcagtttaagacaacaaactcttattgacaatgctagtgtattgggagctgtgagatgttgtaaagggagtgtgatacatatccaatcttgaaaaggttacatgccttgcaacaaactaggcactatgctaagcacttgaactaaaactgtgagcaaacagatattaatcaaataaccccacaaacataaacacaggggttaaagcatataaagaatgaatgacctgattgattctatcagcaaagcttctctgggaaatacttctatttgagttgcaactggactcaatatgggctgcagcagggtggaggatgaggagctgaggaaggtgcaaaggatgacttgtaagtttctggcttgggcaacaggctaggtggtggagcctgcaatgcgcgctggaggaggagcagatttggggtggagtgagagatcgtgagtccagcaaaaaaagaacaagtgtgaaaccacagagagcaatgcctgattaagcacagaactatgcagtggacccaacagaaatgaaaacaggtatctacacaaaaacttgtacatgaatgctcatagcagcattattcataatagtcccaaagtggaagcaactgaatgcccaccaactgacgaaaggataaatgaaacgtggtatgtccacgccatggaatattatttggtgatattaaaaaatgaggtactgatacttgctacagtgtggatgaaccttgaagatattctactgagtgaaagaagccactcacaaaagaccatgaaatgaaatggccttttggaatattgtgtgattccacttattatgacatttcaaaaatagggatatctatagagtcagaacacaaattagtggttgcttaaggctgagggggatggggagaataaagtggctattaatgggcatgaggtttctttttagggtaatgaagatgtaccaaaactaattgtggtgatagttggaaaactttattctattaaacaccactaaattgtagattttaaatggatgaactgtgtggtatgtcaattatatctcaataatgctgctttaaaaaataagataaataatctgcataaagatgttcttttttttttttttttttttttgagacggagtctcactctgtcgcccaggctggagtgcagtggcatgatctcggctcactgcaagctctgcctcctgggttcaacgccattgtcctgcctcagcctcccgagtagctgggattacaggtgcccgccaccacgcccagctaattttttgtatttttagtagagacggtgtttcactgtgttagccaggatggtctcaatctcctgacctcatgatccgcctgcctcggcctcccaaagtgctgggattacaggcgtgagccacagcgcccggccataaagatgttcttatatgttctatttagaatattgcaacccctcagtgggagaatggttataaaaattatgacccatcagtaaggtaaaactcagcacaattaaaaacacatccaatgacaaaaaagagtaattaatttggaaagatgtaaagttttgtttttattataaaaaacaaaaagcaaaaaaactacacagtaaagaaagatgcaatcacttcggagaagacagagatcctgggagtctggcaaaggtgaaactcaaaagcaagggccatgcatttctagagcttttgcaggagagcctcagaagtggctatgttggcttcttctgtgatgggaagtgggcaggaagcctgggcaggtgagaagtgggcaagaagcttgtgcagtggctcgcgcctctatttatggccaagagtgagggcttgaatttggttctctgcgcaggaaggaaggcactgctagaaaaacaacttgcggcccggcatggtggttcatgcctgtaatcctagcactttgggaggctgaggcgggcagattgcttgagcccaggagttcaagaccagcctgggcaacacggtgaaaccccgtctctacaaaaaatacaaaaattgaccggacatggtggcacatgcctatggtcccagctacttgggaggctgaggtgggaggatcacctggtcccagggaagttgagactgcagtgagccatgattgtaccactgcactccagcctgggtgacagagcaagacactgtctaaaaataaataaataatttcaaaaaaaaattaaaagaaaaacaactttttaagctcttagctctttcctccagcttagtcccccactccccacctacccacgacctgggcacttcctaaatgtgctcactatcattttcaagcactcactctgtcccagatactatgctaacttctttgtgtgcttcatcctacagaatccttacttgtttatgaaatagatattatcgtaatcccatatgtttgtttcatttgataaagaaatctggacaatgtcacagggatcataaatgatgcacctgtgctgcttctaacccaaggcactctgactctacaacctgaaggtcacatttaaatcaattcatgatccacactcaagaaaaccttcctcacagattcccacaactgtcccacttttacaccccacgccaaggaggcccacctattggctagaccatagattctaatgcactcagcacttgggtacttccagttgtcatttgaattaagcaataatagttgtgtgaggtaggataggaatcttccaagagccctgtctttgtcttatgcttctataacagaatcacagggactgggtaatttataatgaacaaatatttaattggctcatagttctggtggctgggaagtccaagagcctggcactggcatctggtgagggccttaatgctgctcatcccatggtcggaggtgaaagggtgagagagagcaagacagaaaggggaatgaactcttgctctgtatcaggaaaccactccctcaataatatcattagcccacacatgaggacagaaccctcatgacctaatcagctcttaatggtcccatcttaattctctgttgcattggggattaagttttcagcacatggactttgagggacacattcaaaccatagcaagctctcaggtcagtcgggacagatcaaggaacaaatccacaagccaagcacactcacaacttcattctctgaacagtccaagttgccacatcttcatgtactaacaggttaggcttcttctgaggaaactgcttcttaaatgcattttttaaaaaaattctgtttcttgacatcttggggcttctggttcttttctctgaatcttatgctctgaatgattctaagatattccataaacattacttgaattctaataaaaattctaatctagtgatagaatgggatccctagacactgtacgattatgctggcctggtttcaaatattctgccctgcttgggcttcctctataaaagattcccatttatattctctcagtcatttctgccagaagaaattatggctaccttaggctgtttccaaaaagaagttaggaagttgtattataatgatcctcctctctccctctcctccccttctctttctttctctctgtctcttttcccctccctcctcctacgtattttgatcataaaagaaaaacaagtatagccgtgtgacccagcaggaacactgaagcgatctcacagtagtacagtgttcaaaatactcaggacccactgtgactcctggttgcaggatgaactctccttgaagattttcttccataatttaccaacgtgaaattttttagacactttattgtggaccccatcagatgtcaaaataatatgcagccatcggcagagaaagaaaaacaccatttccccagtttggcaaactgtggaaaacagcagctccttcaacacttcgctccttaaactgtagcttaaaccactggcattggtatcacctggagcttgtcagaagtgtcaaatctccactccaaccctagatctactgaatcaggtctaaattttgaaacgatccccaggtgattgctatacaagttaaagtttgagaatcactggcttaaattaggctgtttttccagtgaggatagactttctggccaagtgtggtggcttacacctgtaatcccagcactttgggaggctgaggtcgggggatactttgagcccaggagttcaagaccagcatgggcaacatagtgagatctcatctttacaagaagtgaacaaaattacagagcatggtggcatgtacctgtagtcccagctactcaagaggctgaggcaagaggatcacttgagttcaggaggttgaggctgcaatgagctgtacggcaccactgcactccagcctaggtagcaaagcgagaccccacttcaaaaaaaaaggaaaagggaaaaaggatagagtttcctgtctccctctggggctgtaagtcccttaagggcttcatgcaatttatccaacaaagtgcctggtaccttgctcagcgaggtggagggtggtagctgagtgggtggtggatgggagccgggtggttgaaatgagagatccaattccaatacttagcactgagcaggactcttttgcctgtagggtgatggccattggaacaattggtagctctgttttatctgccacgggagtcctgtttcctatgacattatcacaatggtgggaagagttcctcattttcagccaccttaatcattattgcaactaatatcagttgtgaacttacacacagacactgagctaaactttttccatggattgtctcacggaatcctcacaacagcctctgaggtgagtagaattttcattcccatttgactgagggagaaactgaggtaaaaagtggacgtaacttgtccaaggtccgccagctagaaagagatggaggggagattctaacctggactccagagcccatattcctgtgtttctcaaccactttttcattatttcattattgcctcccccaggagtcttcttagacattttgtcctaattgctcccccatgaaattttaatgctgcagataaactatatctgtttatattttttctctctgtctctctttctctctctctctctctctctctctgactctgtgtacgtttatatactgtaggtgaaatttttttttcacccccaagatccaattttcatccccttgggggcacaatcactcctgctgagaatgccttgctccttcattccctcattccatgaataacttgtggccatttactatgtgctagactgtactcacagtgaggaggttggtgtttggggccctagaaaggctgcctttgagcaggagaacaggaccagggcccttggccaggtgcagcaacatttcctatcatggaggccacagttaccctgggttcacaatcagtacagcggctgggaatcaggaccacagagtccagccgtagctccgccatgacctgctcatttggctcttgtaagccatgccatctctcagcacccctgtttccaaccttgaagatgaggggtaggaattcaactggcacttttaagggaaacacaagctgtgtgtctaagggtaggcagattggtgagctgcaggtagcacacaggacctattggagaggtatctcgtggcaggaatacaaagatgcgtgcctataccctccggactgccttctgtttcactcccatctcccacggggttgcttggccagagcctcatcactacccacctctttttcttggatactaataaaatcttgtttctgcaagattgggacaatctctaaagtagtttcttctcctgttcccaccaattacccagatccatggctttagaaaaaaagataactgatttgcatttctctgatggccagtgatgatgagcattttttcatgtgtcttttggctgcataaatgtcttcttttgagaagtgtctgttcgtatcctttgcccactttttgatggggttgtttgtttttttcttgtaaatttgtttaagttcattgtagattctggatattagccctttgtcagatgagtaggttgtgaaaattttctcccattttgtaggttgcctgttcactctgatggtagtttcttttgctgtgcagaagctctttagtttaattagatcccattgtcaattttggcttttgttgccattgcttttggtgttttagacatgaagtccttgcccatgcctatgtcccgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagagcagatagttgtagatatgcggcgttatttctgagggctctgttctgttccattgatctatatctctgttttggtaccagtaccatgctgctttggttactgtagccttgtagtatagtttgaagtcaggtagcgtgatgcctccagctttgttcttttggcttaggactgactttgcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgtaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactgtaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcacaaggacaaaaaaccaaacactgcatattctcacttatagatgggaatcgaacaatgagaacacatggacacaggaaggggaacatcacattctggggactgttgtggggtggggggaggagggagggatagcattaggaggtatacctaatgctaaatgacgagttactgggtgcagcacaccagcatggcacatgtatacatatgtaactaactggcacattgtgcacatgtaccctaaaacttaaagtataataataataataataataataataataataataaataaataaaagaaaaaagataactgaaaatgttactttatccatccatccaaccatgggaaaaggggtccataaagagttcacccaggatctgaggagctggaagaggttgcagccaggcatgtaaaccaggagagagtggtgttctgaaacccaggagtgagagaggtggaagaagctcagccatgctaaatgaagaaggatgcagaagctgagcttttctggtctgatgaggtgcccaggcagcctcaagaggccttggggagctgagcttgctggcagcgaggtgctggaggaagcacccactgcagagaagtggatgactcagtgtgagcggccgtaggcatgcagcaggtctgccaaccaacaaatctataaacccaaccacccgaggtctgccagccctgactggcttccaaggcacctctgttgagttcctgttcacatgcagttgtagtctatttggagagagaagacctagaaaaatggtctttattttctgttatcaagcaagaaatgaatcttgactaaaagtatcacaggattgcaagaatcctttcaacttttcaatcctttcaagaagttcttggcgccttgatggaagaggaagtcttggctgggtctgggagggcattccagaaggggaaggcattgctctgctgataaggaagtgcttccaggcgtgaagcaatgattcctctccgggctaccctggtctggggactctgaggaatccgtggagctgccaattctggtccagctgcatttctgcttgagcctcatctgagaaatgaagatcttagcaatcacaggaagagtcagcaaaaaaaagaggaaaaaaaaatcatcaaggaagtgaatccaagatcaagaccttggcaaatgtccaggaaccagaacaactcaggcaaatttcagcgaagctgtgagacttactcaggatgatgtggggttaggactgcccagtgagataggtcagcagagccctgaagagaagcagagggacaaggagcccttgctgggatactgtgtctgggctctggggctggcatctccctgggttcccgcatcttgaatgtgaggccacagggttgggttcagtattgactctaagtttccaaacagctctgaaatagtctacacccatgggttagaaatcatggtaggaaatgggaggcaaagggcctgcaggtgagccagggagtatgagataaagacaagagggaaatggtaggagacaaagaccaattgaggatgtgtctgttcactgagtgacagaacctctgattttgatgggacgataactgcagaattggtccttttgcttcctccagacctgacaactggagaagaaaccctgttgagaatttgagaatcctacctgttagctaagagtaggttagctaagagttgggtgtgtgatttcaggaggaaagtaagaaaggtgatgagggagggtcaattcttgatctcttctggagggtgaaggatgacatatcagaatctggagggtgggggagtagtttgcaaaagcatccagtgtgctttctggagtgggagaggaaagagtgaggctgagctagcgcccacagagcctccagaggaggatacaccttgtgcacattgagtagaaacccatcaggcctgctcatcaaacatcctagggaccaaggagggcccaggacactcaggccacagaaaggaggcccgggctctggatcatgagcccctgaaccacagcgtgacatgggcaagcacactggttctcagagtcaccaacctctgtatgaaagcagggtcagaatagagatgccctacatctgccacttccaaaactgactttcttgggctctttgatcttcaattatgtgggtccttagaaagtcaccttttgtttactctacttcacaggaatataataaggaaatttataaaaaccaatgacccctttagataaactcaatctttataggaatattgaccagaatagactagaggtgtttttgtaagctgaacacttcctagaggtgtagctaaaagtaatcttactcaccccggtttgtaggcctgtaacacctgacttatgtaggtcacgtctgcggagatgtggaggtgaagccaccgtgagtctggagaggggaactgatgtgtctttcttttctctattaagtcactggctatggactggcacagagccgaactcagagggacacccaggagatccccctcctagagcctccgcaccctcctcctctcctcaccctctcagcctttgcttgctttaagccaaacatttattgtttctaaaaatgctggagtattgcaaacatattggctgagaggctcaatcatcctcagtgaacacttccagttttgagattctgagcctcagtttcctcaaatgtaaaacaatgagaagagtggaccccagacagtggtcctcattgcataatataaaaagttctcatgtaccaaccactcagatctaagaaatgttaactttaggcctcattgacttcagagtcttgaaaaacaaatgaagcccactcgacgagtataatttttttttaacggaaaataacaactgttggtgaggatgtggagaaattgaaactcttgtacattacaggtaggaatgtaaaatggtgcaaccactgtggaaaacagtttggtggttcctcaaaaagttaagcatagaattaccacatgactcaacaactccactcctaggtatattcccaaaagaactgaaagcaaggactcaaatagatatctgtacactaatgttcataacagtattattcaaaatagccaaaaggtaggagcaacccaagtgtccattgacaagtaagagataaataaaatgtggtatatacatacaatggaatattattcatccctgaaagaatgaaattctgatatatgccacaacatggatgaaccttgaagacatgctaagtgaaacaagacagacacaaaaggacaaatactgtataattccacttatataaggtgccgagaatatcaaattcatagagatagaaagtagaatagtagtttccaggggctagggagaaggagaatggggagttactgtttaatggggtacagtttcggtttggggtgatgaaaaagttctggagatgaatagtggtgatagctgcacaacaatttaaatgtatttaatgtcactgaactgtacactaaacattattaagatagtaaattttatgtatattttaccacaataaggaaaaaaaattatttcatcccttcaaggctttgttcaaaggccacctcctccatgaagccttcctcctgctttatcccaccccatgcccaaccagacctgatgtgccctttagcaataatctgtttcaccaatctgaactagaaaagacattttgtagtttttattttccttttcacagaaaccccaagagggataaaaaatgggacaatcattcatttcttcattcaacaggcatgactgagtacctactatgtgccaggtgctatattaaacacaacagcaggggattaatgcaatacacgagagcactgtgagtaggggcagactgcctggaagagccagagtgtggggctgtgctgagaagggggtgcaggcttcttgggtcgggggacatcctcagaggagtggcttttgagctggctgtgatatagaatgtgtaggcatgacgctgagaatagtttcaggaatggcttttgacaatacatgatcacaaaagagtgcctgggtgagaagtctggtcagagacactgcttcagtgggactgccttgtgccctgcccacctgtggccttgggcaagttactcaaggtctccatctgtgaaatggggggaaataatatctgctgtccagatcactgtgagaattaaacaggataaagtctgtaaagcaactgccttctggtgggtaccccctccttcttgtctcagctggagaagcccctggtgtttgaaggaacatctctgctgctgagaattggtttaggacagtaggtgatcctgaagctcagttctcttcctctggacactttcagccaacacacccagggggcctagagccctcctaccccatctgagctcagcggaaacactcgctacctggattgcagggcagcgttactcagtctgctctgaggactgtctgcattggaatggatcgtttctgatcctgtggtccagggtggggtcagtggtagcacccccagaggattgagcatgagctaggaaccagatcgtctgattcctgaggccaaaaacccaatgaatttgaatcggaatgtgaatgaaccctgtgtggacgttgcaaagccacaaggggttaaattgcacccaggttttggagaggaggagacagtgctgagcttccagaggcccaagattcctattgacggttttaagtggtggggttttttatttttttcccttcagttttgttcttggaaaaggcggtgaattcccattttaaattcactctgcatacatttctgattgatttttgttttgtctagagcctctgggatttgccaagtctccatcaataaactagagaggatttagggaagaggtaattaaaggggctggggcaagagaggaaagggggagagaggacaggcaaaatggagatatcgagctgtccccagcctgcagggagggtgctgcggttacaggaagtgttcagggagatggctatcaaagggtttgccggggtgaaactgtccagttggagcccttcgaaagcctgaactaagggccatggtaaagtccaggaaattggagtcaggaaacttcatttttgagtcctagttttgaaagagattcctttgagactttgggtgagtcacctaacttctttgcttcctcatttgtgaaacagagatagctcaatttgctcctagccaccctggtgggagagtcaactcaagcaaaacggctgctgagtgggaccttgtaacctggccctgctgaccccaattgacagccagggctgggaacagagacttgaggcttccttcaaaaggaagagttacaccatcagattcgccctgagaatttgaaaggaaaccaggacccattgctaatagtctcttgacaccggtagaatagagggtggatgccaggccgggccatttgcaatatgaggaaaggaagggaaggagaaagagaaggcaaaaaggcaagacaccatccgtcctgccccactttccagttccagcttgcatggaggcccgcggaacgctgttccctctcctcttatgcatgagacgtcagcattcttgccacagcctctgacttttctatttcttgagccctcctgagcaggcccacgtggaacagggtgctgatgtaaggggctgagctccagggctcagacccagtgttctaactcccctgggagcaccatgggcctttcactttctcccttcaactccccaacctgcagccacttctgagtgtgactcttttcctgctcattgtctccatccccacccccaaagcagcccaggagagcaggacttgtttgccctgctcatgctctgcagatcctggagacacctggcacacagcaggccccacatctgagggctgcatgacgctgttcacctaaccactcaaattgctggaaactgcagagtcggcctcagctcttctcctccctcacactctgctcaggcacaacttccagaaggttgctgccatcagtcctctcttccccattggcttttccaccaccccatagcttctcacctggtgggtacaactgcctcctgtgctccccctgctctcagcccctgggggatccccggggcaccaacactcttcagtgctgtctaatcacctcagctcagcactctaggccctggaacagtgctgcacccacctttccagcctcacttgcttcattcctggcttctccctttctgctacagcaacagagctgtttgaccctgaaaaggctcatctccctgcctctgttcccactgtcctttctgcctggaaagctgcactcactgtacctttcctgtcacctcactaactcgaactcatcccactcagccagctcgtcgcactcttcaaattcatggaactcagtgcagccgttgctgcttcagtgtcctcttgtgtgttcccagaatccctcgtgtttctgtcttatcagagcatctacctcactgtgctgtgttgttcactggtctgtgtgccccatgagatggtaacaaacagcctggcacttcctatgagtgccaagaagttttgtgaatatttggggctggcagagtgactcacacatataatccaagcgctatgggaggccgaggtggaaggatcacttgagcctaggagttggaggccccatctttataaataataaattaacaacaacaacaacaaaactaggcgagtgtcatggtatgtgcctgtagtcctagctacctgggaggctgaggcgggaggattactgaagcccaggaggtttttttttattgttgttggtttgtttgtaaacattttatttcattttaatttttgattttatttatttatttatttttgagacaggcttgctctgttgctcaggctagagtgcagtggtgtgatctcagctcactgtaacctccagttcctgggttcaagcaattctcatgcctcagcctcccaggtagctgggattacaggtgtgcaccaccatgcccggctaatttttgtatttttagtagagactgggtttcaccacgttggccaggctgtcccgaactcctgacctcaggtgatctgcccgcctcggcctcccaaagtgctgggaaatacaggcatgagccaccacgcctggcctaaatattttatttcatttaacacaatacattccagttttaccttaaatatatttttaaaaatatttaattttctgattattcttctttttctttttaaacttttattttagattcagggcaaatgtgcaaattgttatataggtaaattgtgtgtcataggggtttggtgtggagattatttaatcacacaggtagtaagcatagtgctcaataggtaatttttcaatccctactctcctctcaccctccaccctcaagtaggctgtggtgtctgttgttcccttttgtgtgtccatgtgtactcagtatttagatcccacttaaaagtgagaacatgtggtatttggttatccgttcttgcattagtttgcttatgaaaatgacccccagctccattcttccttgctgcaaaggacatggtcttgttcttttttatggctgcatagtattccatggtatatatgcaccatattttgtttatccagtctactgttgatgaccatttaggttgattccatatctctgctattatgagtagtgctgcaataaacatacatgtgcatatgtctttatggtagaaccatttatattcctttgggtatatatccaataatgggatttctgggttgaatggtagttctgttttaagttctttaagaaatcaccaaactacttttcacaatagttgaactaatttacatttccaccagcagtgtataagcattccattttctctgcaacctcaccagcatctgttattttttgactttttaataatagccattctgacggtatggtatctcattgcagttttgatttgcatttctgtaatgatcagtgtgaagcccacgagtttgaggctgcagtgaaccaagattgtgccactgcactccaacctaggcaacaaaccaagaccttgtctctaaaaaaataaaaattaaaatacacatttggaagcagacagatccgagtttaacgcctgctccgctcttttctagctgtgtgactttgagcaaattgcttaacctcttttcttttttttgagacgtagtctcacactgtcacccaggctggagtgcagtgcgcaatctcagctcactgcaacctccatctcccaagttcaaacgattctcctgcctcagcctcccaagtagctgagtttacaggcccctgccaccaagcccagctatttttttttttttttagtagagatggagtttcaccatgttggccaggctcgtctcgaactcctgacttcgtgatccgcccgcctcagcctcccaaagtgctgagattacaggcgtgagccaccgcgcccagccgtagcttcttcacctctatgaaagagatcataataatacccatgtcacagggatatcggggaaactaaaggcagtgatgtacagcccttagcgccgtgcctggcttgtggggagggctccatccacattaggtgctagtataactaagaaaaatatttctacatgctgttgggaggggttgggggaggtctccaaacatcacaactaaatctgcgattccaaggaagaattaagaagtcttttagaaaaccaccactgccaaatcttccttaagtgttccttcaaggaagctggggaacttaggtaaccaaccaggcacccagcacaaaccgtgactgagattttaaagtgaaaactgaaaaagtttaaaagaacacatagatctctggggggagcatggagaagactaggtcgcattaagggcctggaaggaccggtggcaaaaggcaaaggatggaagtgtggcacttctggatggaggcagtgcagggtggagattcagagccatggccgagcttccttatggaaccggcgccacccctccaaggcggtcaggtttactgggcgccccggaaacggcactccctgacttgtggcgttggccctggaaattcaggtagaaagcagcaagcagatgttttcacacaccctgaagtgtgcgcgattggcagcggctgcccagagaggttccaagagagtgggagcaatccccaaagaacccggagcaggtttggttgcccgccccgctgccctcctcgcccctccaggaaggcctagggcaaaagcgcgctggctcgggagccaagcgcgaggagctctaagccagtctcaacctcctagcttggacctcggtctcctcctccaggcattgggtttgcagcgggcaggggtgtgggaacaatcttggaggcccacccaagcccggcctcccggagcctcccccagagtttgggaacgtcccagtctcgttccctctcgacgcccccggagtcaagacgtgaagggagtgccaaggcggccgggggcggcgagcggggccgcgggcgcgcaccgactcaagagccgactgtcagcctcggcgggccggagttctccggcgctgggacaggggcgctgggacaggggcgctgggggcgagccctggcgggggccaggtccgaggaccctgggcgcggcggccccgccaggaggtccggccgcgagcgtgacctcacggggaggggccagcgcggcggcctgggcgctgagccgagcgccgggagagcagcgcagaagccgagccgcgaggagcgcactccgtggccccgatggagcggtacaaaggtgagggcgcgggttcctcgcgcggcgcacacccactccctttcgcccagcgacgcggagggcagggctaggactcgtcttgccaggactcgggataagcagagcccactgcccccacccagcccggacctgggcctaagagggggcgacagcggcgccgcggactgggcgggtgggctcctaggtggctgctgcggcccgagccctttgatcctcccgggcgcggaaggagggggtcgtcagtggggggcgtggcggggcttctcacctgttgcaggagagagggtgagcccggcaccccactccaccctcagtcccgccgcacaggaaagatgcctggggccgaggaagccccgaagaaggtgggaaccgtgctgagctgctgggggcaaagggtcgggctgttgagtcctttctcccgggcgcccgccgggctaggggcttcctgctcccggcaaagcgcttgggcagtggagtgggcgcgcagaccctccccgggctaggtggggcctccccaaacgtcctgccgttcgggtcatcgtttctctccaagcccttctttgctcccccacaccaagaaaggagggatgcgagggtcgggggccgaatggagtgcccggcaggtggagctcctggaggcgtccggacccgagggcttagctcagtgcgcagctgggcgagctttgggtttggcgggggccaggatctccgccaaaccccggtgggcgggccgtcccgggtgcgccggacgcccagcttagcacccacactcggagcctcggagctggtctacaagtctcgattgcggttcttttgaaaagggagtacagggagttgccccttaagaggaaccctgcgggcgctcccccctcccccatcctcctgcagaccccttccctttggaaaagcctcttgccttctcttttgctggaccggtctccgccaaacctgcgggaggaaatgctgcttctatatttgttttcccctgggagagagtaataaaaagagaacgctcagattcccaggaatctcactcccggagggctctgatccctgaaactgacataaagggacctgttgggaccggcttccctaaagtagtcttgtctttcactttcccattgctttttctcatctgggtagcctggttactggtgaaggcaaaagatccaagtcccagacagagcttcatatattcaggaagggtctttgccgacagcagggagccggcgtgggggacagggttaaaggagttggccacctttgatttctttctgtgaaccctccctggagcttctctcgcatttctaacccggtggttttcttcttctcaaattctactgggatcacgtcagttttgtgcttgaatgactgaatgcgcgcttatgctgtctcagacacttgaggaagccacagtcctgctccttgtaacatggccgtttgcactccctcccctactggggcccctccgcccttcgggagggaccctctctgggaattcaggccttgagttgagcctgacaggaagtgttggcctctggggtgccttccagctccctgacttgcaaagctggggtgtgtgtatgggggtgggggtggtgttagttgtaggttgcaagctactttctcaaatcagcatattaatctctctaaatcagggcaaatcacatttggggtctttcaaaatgtcccgttattctcagaaggcttttgtattaataacttttgacttggcccttgacctgataaaagtcttcttagttatctttctctctcaggagcttaaaatcctcccaccctcgaagaggatcagtttttgccaactgaagggaacttcgtttccaggtcagggtgcttatgtttttggtaacacatgtatctgcctgatcattttgcagtaaaccagacacagagtgataagtgggtaaacctgagaattatctaggtttcagaggctaatccaactcaaattccagtgtttgactcatgagaaaaatctttattttgtctcgctggtgtcatgctgctaataggtttactacacctttcactgaggaatttggggatcccctagccccaggatatagaattccccattctcctgagaggcagataagttgtgctttgaacaccctttaaatggaaaagttcctctatgcaaaatgcaaaatgaagcccatctctgattaaccagtgtgactgactagaatcggtagtctcttcttgcttttcagagactggggccatcttcttaaagttgagattgaatagttattggaataactaggaatagtggtttaaacaacaaagttaaacggaaaaagcaggtttatttagttgggctcctggagcctaagtaaaaactgtaaagaaaaattcttattgtgtgtgacactttttaaatgtgttatttaaatgcctcttcattctgtttctgtacttccaattttgagctctccctctctcaggtaggtggaaatgcctcatggctgtcttcagagtctcaaaatgttttctctaatttgcaaatcttataaagcagttcatgtaggagaaattgtctttccatgttccttagcctgcttgttatatatattgtacatcctccaaaaatagcctatcatttttgggctctgagtggattttccattgtcttgtaggatgtaaagtgaggtctggagatgatgggtggttggaatatcacccatgtgacatgcctgttgcagagacacttccagactttcttcccagtcccttccaagatttctgctagatagccatgactcacccaagcaaaaataagggatcggggagtatgtgggagtcccttcctagagagatggcacttttatgagagttgccataaatagcgatggtaaaatggctatgtcttgtatgtgaatctctttggcgttgtataagcagtaaggctctcgcaaatgtcaggatgtggggccaaatcctacagggtgctttgagaaggttcccatccttatgtgtttacatatttatgactctcataagagcatccttttatcgctgtgcatgagcccattggctgaactcacccagtgtggtcacgcattctggttctgactgctctcccagctggtgagtgggtctgggccaaatgtgactgacctactatctgtggattgtgcttggaacatccatgccgaagcttcctgaaattgcatcatacttggatacagatgggcctggttgagatattcagcttcaatttagatcacagtaattggttgaaagtgttattattctttttctgcggttcttttgtttctgaatttgatcatccagtccccccgcttagctctagggcattggaggcagatatgaactgcaaagagtcaatccagtaaaatactacttcaaagtttatatgggaatcctgagatctgtggtcagggaaggtctggaaaagaaaagcaaattaaaagagatgggcatgctaccttcaggaatcatctgtatttgttatttttcaatgcctacgaactcaggtttttttgtgttgaagttctatctaaggcagtagttctaaacctttgctgtgcatggaatcatctgtggagctttcaaaaatatggatgtaaaggccccacccaagacattctgatttaattggtctagggtacagcttgggcattgtattttttaaaggtcttcaggtgattccaatatgcagccaaagttgggaaccaaatttcctccaaaaaacatgaaatgtcaaaagagcaaaaaagatcagtaattttatatacactttcctcacctggaaaagtaaaagcaagtgtggggtgaaagggatgcccccccgatactcacacgatgtgccttaaccaaatcttgtaatacctgcagaaatctactgtaatcaccttcagctattagaggctttaaaaggctatgggaacgttgcttaaaaacgatctcaaatgtggtgcttaaaatcctaagctcagggtttgctccttgtacttgaccctgagctccctgactttgaagttgcgtgggagccctggatgatgtggcaatgaaatggtctgaaacagaaatactgagaggtcacttttggtgctgaaaggccaagcagagtgggggaattctgctttgggcccttcctctcttctgaaggggtaggagccctgggagctgggctgcttccagcacaattaaagggccaggaaaggccaaggagcttcaaagctgaggaagctgtgccagttttcttccaattccctttcataacgggaaatgtttctttaaaggcttctgtcattcagagaagggagactttcctcaagccaagggaggatggctttttctgtccagagccctggctgagacatgaaggcagtcatggtgcaatgaagaaagtagtggctcaggaacctggagacccacaggcttcatttccttgggcaaactgctgagctctccaggcctcagtttccccatctggaaaacaacctccagtgttcgcagtgttcctctatctgactttccaatggttcttcgatgctagttgttctgtggtcactgaggaatctttggagagaggatgtgtcttggggaggagagggaaatgagggagggaatgtgggtgggtagcccagcaaaggtcagtttaggattgtgattcttataaataaaaccaatttcctgttgagagctggagagtagcagacttagtgggaaagagaatgccgtaggccatgtgaggaattcatttctcaaggacttttgtgtgaccgtgtctccaaagattgttcatcgagcccagagccaccctctgcaacacggaccattattcactcccatttgagagacaggccaactgaggcctacagagattaagcaacagtccagacagtcagaaataggatataatatccctgagaactgagtctctaaaagggtagaattccttttcaaggatttatttaggaaagaagtgctcaaagcaatttcaaattcattccttatcggtgtcccttcagccagggagggactacctgctcagttaaactctcctcaatcttcaggacctagcccacatgtctcttcatccaggaagcctcccctgactcccactgtgtaccctcattactcttgggatagcctcattaatgcctagcacatcgcaggtgggcaacaaatatttgtggaattagtgtcacatttgtctaataattgtacatgtctatgtttgtttccctgccaggctgaactccttcaagacagggactttgtctttccttatgtccctctccagcccctggcacactgccagctgcatagtgggtatctgggacatgattggggagtggggaaatgaacaaattccaggcaaagagatcacatattctcccgtgctctagctctggagaacagacctggttcacaaaaagaaatgaagcaaaatctcaaaggcagattccagaaatggagatgaaagcccacagtggccacccttggctttcccgacttgagccttatttctgtctattccagcacaggggtgttgctgtctggtggtacagagaaggatccggcaggtttctgcgtgtgagtatgagcctgtctgtgccctctgcagcagctcacctggcctccagggctcccgagggtgcagacctggctctgcccatgctctgggtggatggttgagggagatcaaggagctgggcaccggcctgggcactcaggggctcgggattctaatctggcttttgccactaactcgctatgcgaccttgggcaagtcaattaatctttctcagccttgtttcctcatctgtatgagtgagaataatgattactaatctaccttgcaggccacttggtggaataacttgtaagagctattggtaaagactttgagaaagagaatgttaaattaacgcaggggagcagataccctgaaacctctggcatgtggttctgatcccaccagttcctgccttttcacagttcactgggctctgcccactgtgtgcttttcaatgctgttgggagatataagttggggcttctcagcctctaggcatcctagcttctcagagatagcatctgtgtattcttcatgtcagtggagaaagagataggtgacgaactgctcatttgttatgtgtagagctacatcctagccctgcctgacttttctctgatgtctcattaagtccacataggagagacccttaaattcaaatagtagctttgagcgctttcctaattttctatcactcgactctcatattctccccagttagtttcaaaaaacaaactaaccacaaactgcattgagcggggagaagggagaatgtgtagaaaaacaggaggagcctgcctccccctggacgcgttgcattggactgatgcaaaaacacagtgaggccagggaacacggatctcacatctctcaggggagtctggtattagggaggagtggggagaggcacccatgccagtagaaatcctgttctgctgttttctaagcaggcccctgagttctcttctcacttcctggagctcctcccaggacttcaaaggcagatacagtcctggtggactgtggtgagcttgtacggaagctcagccccagcacactgcaaatcagccttctgctggagattaaagcaagagaggctagccagctgttagctcagagacagcaaccactgtgtaccaggaagaatccaagctgggtgaatgtacagtcctacccttggaggtagctttcccaaattgaatgaccagccttccgggcttgcttgggactttcctggttttaccactgaaagtctggtgtcccaggaatccccttagtcctgggcaaactgagatggtgagttgccctattaccggacctaagctttagtaaaagtttctgaatcaagagtttgatttctccgtagcaaagatgagctggaaccaattattttgtctctttgacaagaaagtgaaagtccaaggcttaaaaactggcagatcgtaacttaccactagtgatacacaccagtatgctaagtgaaagaagcatactgctattcaagattcaaaagcttgcacactgaatgattctatttatatgactttctggaaaaggcaaaactatagggaaacagatcagtagttgccaggactgggactgggggaaggcgtgagccacaaagggcgtgagggaaatttttggaatgatagagatgttcagtatcttcattttggtagtggttacacagccatacatacttgtcacaattcagaactgtgtagttaaaagggctttttttttttctgtgtgtaaattaacctcaataaagctgacttttaaaaacactctagcagttgtgatgctgtggtataagatgaagggtcaaggtcaaggttgggtatcatgggttgtaattagcaactgagtcttggtgtgggtgtgtctgcaatggttctggaggtgtatgcagcagaaaagggtgagaaatttggtacaaaacaaaaaggccaagggctcatgcctgatgacatcctaaatgccagagactttttcattaggcacaatcagtgtgatagtggaagctctccctctgtttagagaaaaggcaaaagcagctcccctaaaggccaggcagccaacaagcccaggaggaccatggaatataagagcattagactcaggttcccaccctgggaactctgctgctacccacacatggatctaatgtactggctttggcagcctgtctgcaagtcttttttttctaccaataaagttattgtattagaattgagtaatcaagtctgcaggataattatttcctggttgactttttgtttttggcagtcctgcttgtctatgctagctaggattgattttgaggggaagaacccatgatttatcgaaataacacacccagtcgcatttgatgtaaagaatcagtcctcttatttctagacaaggagaagccttctgatgcaagggcagaattaccagtcgtcactgcaccaggccagcggacaggatgtggaagtccccaagaaggaagaagtatcactctgggtgatctgaatggactcttaagatcttggtgttttcctttttatttatttatttgttttttaatcaaagcccatgttgaatttgcctgttcttcaggtgaattttgtctggctctgtaccctgggaagctgggtctgtgtctgcatctctattaagcacagcctgttggaaggctgtggaacttccatccgtgaggactacatgggctgaggtcatgttcaaccatgaattatacaggagaatttcccacatgcaactttttaaaatcacagacacatccaagccactagtcacccacaaaggcaggtctcttccacctgttccagggttttctggaagaattacagactcatagccagtgcaatccttagttctaattgtcttagttttgttgggggaaagcattgatgttagagaggcaggcagtgtttttgtgcatatttgaagtgaaatttccctgatgcagggtcaggcctggcttgtggctggtctacctaagaagggtcgggtttggggcagccccaaggcccgcgtctggtttgagtgcaagggagaagctgggagcttatgagtgggggattccagatgtttccttccctgggctgcacacctctgccacaatctcccctgggctgcctgggcacactggcatctgtttgggtttaggggactgtcttagccttcttgttagcccaacaagtgggaatcctgccatttccttccatcctccaccccccgtttttttctcccccagtttttatacaacaggatttattcatgttcactgtattcaagtccccagatggggggagaaaaaaaagattgttgaatgagcttattgtttggaggtttcactgacttcttttatttaatacccacagtcctagaacatattgaactgatttactaaaattcaaatgtggtccttttggaaggaactcttctagggtgcttcgtgtccccggtatcagagctgggacctactgggtggcaagtttgcttgggccatcttcatggtcttgggtctccttggaggcaaatattctgttactatcctagactccttatcagctcacaatggtcaacaccctaccgccctttgcattgtcaggacttttgcggcacccaattctagcacattctttgaataaagatgaacaccaacattaggtactacagttaacagaagccctctgtggcttctgcttggcagtttcctgcacacttagggagaataaaggatggtgaagtggcacctactgcttgactgcctagtgcagggcagctggtccttgactgacatggcagagttggatcacatgtctttggcatgttttagagatggggtccctaccgttgatgttaccggaattgtggctgaggatcgtggcgtgcatggtggtcaagcacggtttctgtatggctgtgacacagttgtgctgtgacggttccagatgtctggagcccctggaaatctcctgagagagcaggggcaggtacttgagctgggtgagactcatgtctcccaggagtcggtggaagcttgtctctggttcaagtcggtaatatcccagatgttctgaaagtagcctggggcaaagcaggaagggtggatctcaaaaccacacacacaagtgtgagttgtgggtgcttcaggacgcctcttggacgcacaggctcacgctggctcctgcacctgcatctcttgcttcctccctccctctctccctccctctcctcttcccctctcttcttttgttcccctcttgactttctcccactttttcactctgtttctttctaccacttccattcaggtctccaggtctcctggatcttgagtccaaagaagggattcccactgagaacctgaggccagaaagacacagaggatagagtcagaccctcccaactctctcctggtccccaggcctctggtggtctcaggctctcatttcaaatagccgtggcttgaatttcaggcttctcccaggaggggctggtgacctcagagtcagggtggggaaactggggcttattctcagtatcttactccctcctagaagtgcaggcctcaatggaatttgttcactgtggcccctgctgcttcctcaagccctaaagggtgtcacttctcatggcctgctgcaagaaatgacatcttccacaatcctcaggtccagagctatttgctaaccctggggctttgccggtcgtccccccggcacagtgcaggttagtgtcacggtgattagggtcccaggaaagggcacacgtactctctttctgtgggtccttaaacagtgctgtgactcgctgaccaccaaggggtagaatcaaaattcctgcactgtgaggggctcctcccaccgccatcccaagtctcctggaactgagtatcagaggagggactggtgtcctcccagggggagcatgagaatgtgtccattgtttggataaaagttccaagcatgaaggctcaacgttgactaaaataattttttcccattgacctccttgcttctcagcgggcaagcgcccatctcccgcccttctgaggctgctttggtgtatgtaattgtaaacagctctggctggcagcaaatctccaagagttacgggatccaggtgtcgctcccaactcaccacgcactggttcccttgagagtggaaaggctgttttgttctcagagggagaattcaggctgttgcttttgagatcagatccttacaaagcctgactcactctcccattccacccccaacttccctccctgtccccagcctccaggtctctactcacgatgaaagaggcttcggggattctacttcatgaatgaagcccttagcatgtggatttttgcttttctgacccggaggtaagagtgtggatcactgagtgctctcaggtatgcagggagccacgagcatgtttattgttgagcgtaagagcaaaccagcagcccacattccctgtgtgagaacaggggctcaccaatcagggcgagagtgtgggctcaggtcagtgtcagcctcgtttcttggctacattctcacccctggtgcaggtcatggcagtatgggagtgaaagcctcttgtgctaagcaggaagccccaggagagtgttggtggctttggggcacttagttacctccctttgcctagcaatagagttgggaatcatctcagagcaaaagtgatccaaggattgtgttggaaaatgcctttggtaggttcagaggatacggggtgctcctatcttgggggccttcctgcttcctcctctccttgcagccctaagcgtttactttccgggtatcaggtatgataggggcacatgcgtgttgggggaaaggagatgtgggatgacaatcagccccttttttcttaaaatttcttaaagctatttacctaatgtcctcaagtgtaagacttgtcctacaagatttattttcctgccaagggaaggttgaggcagcttggaagagagaaagtgagagtgcaaaggaccttgttctattggagtggagagacttcagttcctcgcaggcctcctctatgctttcaggcttggctgccatgtgtctgtgcgtatagatttcttctctgtttggaaaaaataacaaaggtggtcacatagcttgcagcaaatattctccccaaatggctttttaaaaaattaccattatgagtgtgaaaatggtttagatttaggaggaaacagctggctggcagcgttcctggtgagttcctggataagattctgcggtgtcactaatgactttattcggtatatttctgacacaagcacccttgagagttggggaattttgtggctgagaactgaggtgaaggagggaaagtcctaatttaattcaggacaatccagacctgtccaatggatatctcttatccaccttgatagtttaacttggatgcacacaaaccctttttctttctttttccctttctttcaacagggtcttgctctgtcacccaggctggagtgcagtggcactgtcatggctgactgcagtctcaaattcctgagctcaagccatcctctgactcagtctcctgagcagctgggactacaggtgcacactaccacacctgaataatttatttttcatttttttgtagaggcggggtcttgctatgttgaccaggctggtcttgaactcctggcttcaagcaatcctcctgcctcagcctcccaaagtgctgggattacaaatgtaagcccctgtgctcttctttctaggattctgtctatgggtttctctgagacttcaatacattgctatcctagctaagataagcctagatttcttgagacccctgaaccaggacctgtccttgagtgcaggcggcatctagggcagctcaccagtggctgtggggagagtaaggaggtgtgctgttccttgtactgctctggagaaagcctgagcccctctgtacctggctcattcctatttttccagcctctgcagccattcctcacttggctctatgccacagtcataccgggctccttgtagctccctaacttgggcttttccacgtgctggtcaattggtttgaaatgcttcagggctgcctggtaagcacgtttgtcaaggctcactgggccttgacaccttgaccctggctgccactggatcccttaaccctcacctcatcttgtacaaccctcatggccgtggtcattgtgtctgttgatggaagtctatatttctagtaggctgtaagctccttaagggccaaggacagtatttttggtgttcacagcactaatctcacgtgtggtatattgtgagtagtccagaaacacaaattggttgggcccagtggctcatgcctgtaatcccagcactttgggaggctgaggcaggtggatcacctgaggtcaggaattcgagaccagtctcgccaacatggtgaaaccctgtctctactaaaaatacaaaaattagccagatatagtggcagacacctgtaatcccagctacttgggaggcggaggcaggagaatcgcttgaatccaggaggtagaggttgcagtgaactgagatctcactactgcactccagcctgggtgacagaaagagactctgtctaaaaaaaaagaaaaaaagaaaagaaagaaacaggaactgaatgagaaatgtttgctgtcctcaggttttcttagagttggattacatcaaagttaagggctctgttcactgagtgacaccctggacaaaattaataggcagctggcagaaaggagagagagatttacaatgtctaaaagctgttctattaacatttaggatatacaaggcacatcaaccagaaaaaggcatgaatgtacatagtaaagacagtgaatcaagggtatgaacaggagtttacaggtcaaggaagctgccaaaaggctgacaagtatctgaagaaatgcctgggcttctttagtcatcagaggcaggtcaaccaaaaccaccacccagtagactggcagaaatgagaaggtggcacaatgccccattttcccagggacgctgggttcaaccatcttcatgcagagctgagggagtataggctagtacagccagtctggaaggtaggattttttttttttttttttttttgagacagagtctcgccctgttgtccaggctggagtacagtggcgtgatctcgggtcactgcaacctccgcctcccaggttcaagcgattctcctacctcagcctcctgagtagctgggattacaggtgcgtgccaccatgcctggctaacttttgtatttttagtagagatggggtttcaccatgttggtcaggctggtcttgaactcctgacctcgtgatctgcccgcctcagcctcccaaagtgctgggattacaggcgtgagccaccgcagccggccgatttttcttaattgcattgaagatgcacttaccatacgatctagcaattcccaaagagatgtctgcatgggtccataagggggcagggttgaggatgatctctgcagcattatttgtcatggtggagaatgggaagcagtctaggtgtcacttgggagagggaacaggtgaactgatagatacatgtcttagagaattatgcagcagtagaagcaatggctgagatatacatccaatggcatagatgaatctttaatacacagtgctgatggaaaggcaggaaccagaataggacagtggacaatagcatttacagtcattcaaaattcacgaagcagtccacattgagcaaaacacatacaaacggaaaggtgcatattaggaaggtcatcgttgttgcgggaggagaatggggtatggggaagaaaaggaaattgcatgagtttgcttgtagcctattgtcaatgccagaagcctacaaataattctgacttggagcagaatttgacatagtgagaacaataccagaagctcaagccatgtgctgtgaaaggatggggaggagactccccaccacccctcaccctatggaggaatcatgggaaggtcattttccttcatattaatttctggactgtccaagaagttctcatgaagctgtgataacagactatccctacgtttgactctaaagcttgcatttgactgcgagggctgtagtggtggttagcagtccaccattgtcacagaacgggggagatgcatgaataagcctggggtggtagggctggcttttcatagctgtgtattttttcagtcacctccagccattctgagtgcctgagctcttagtcatccttgggttcacatcactaagtacaggtcatggctgacagccagcgtccaaatgtttatcacactgagtaaaatgcagtggaattagatttttctagtacctgatggattggacacaagatcgctagactctgagctagggggttcattttgctcctcttcacttaggagattcactcaaaatcagtgtatccaagcatgatacactccctctccccacttcccaccctgggttgatctgatctggacagagttggcccctgatcttttttgttccatcatctctatttctacttgaaataatagttgctttcttttttaaaaaaatccttttttgagattcagaggtccatgtggaccagatgaccagagtccctgtttgcctcgcattgtgtcctgcctgggccccagaggcaggacctggtgctgcctggggtctcgcaagtgtgggcaagagaagagctaacccttttggatgtgggctcagggtgtgggcagcaactccaattgcatttaaagtcagtaactaaagcttaagtcttccggaacatagaaataacccctgaggttggcactggtggtgtcactgttttcccagcattctttctcatgccctggatgttgcttattgatgcctcttccttctagctgttcttcatccaacctgtccatcctttactgacagtgttcagtttctgcccatgtctctgaacctgcatttccaatttctgggtcccttgggatattgatatcttaagtgaggggacaatagaaatcctcatttctgttttctcaagctcaagtatcagccccagggtcccttccagttcaaaggatgtgtgattttgtaatgaacgtgctgatgtccttaattagcccctttaaatgggagaatatccaggtattcacacaatggacattttctaagctttactttgtgccaagcattgtctcagtgcagaggtaggctggacacagtactgacgaggcccctgtcctgatggggcttgtgttctagtggaggaaagcagaccacaaacatgcaagcaccgttctaaaacaggttcatttcagagagtaatgagtcaacgtgaagaaagaaagcaggatgttgtgggagtaacttggtgatggtggggggtggtgtccaacattagcctgggggtgatggagagtctctctggggaggtgacatttgggttgagacctcagggaagaggaagagcctgctgtggggagaaccaggcccaggcagtggcagttgcaaaggttctgaatgggtgtgtgtgtgtgtgtgttcatgagggctgagaggagcttgtcattgagagggaatgtagagagagatgaaatgggagagcaggatggtgcgagggagctttcatgcagtgaaactgagcttccccgccacccatctgagtggccactgtcccttccaaatgggtaagtcaccgccaggtagaccaccttggatccatctattttccacaggaaaaatttgagcatatcctaaaataatatcctccttcatctttctcccaagaggtcagggtgccacaaacctattgtagttgtccacttttcactgaagggggcgctgggatgagagaggacatgaaggatgcctgtacttactgggggtaggggtaggaaaattgcctgagatccctgcattgtggtcccgtgtccttcccaccaggtaaagccaaggaaggaaaggagctttttgatccctgacctacccagagtcttccaagtgcttccttccatgaggcatgaatgcttcatcccccactgttcagactgtctgaggtctgtgtttagctgtaggaaataaatactgttcgaaagttgcagggtgtggcttcgtgcagattgggttcatatcaggcttggacattgcaaccatgagcaattacttactctttctgaacctcagtttcttaatctgaaaagggttgatagctttttccttggggatttgtagggttggagtgaaattttgcccttagagagcttggcagtaggttcagcacatggtcagagccccgtagtgctagccagtggtggtgaaacaaggcattgggctgtatgtgccatgggtctgccatgtttatttctgatgcctacagcctttgcttttagtaatgctgccattaggttctatgtggggcaggggaagctgaatcatgaaggagagctgtttcctctttctgaccccatcagtgtggaaaacgtactagtcttttatcacctgagcttcagtttcccccatctgtaataatcaccactttcctcacaatgcagaatgctgggaagatcaatgaaaaactatgcataaaagtgttttgaaaactggaaatcactgaacagatgtgtaagatgactctccaccattgcatcaggaattgcaattccaggctgagggaagcctgcagtgctaccatagctattgctaatttgctcctgactaatgatcagttctagagtatttatggccagaaggcagactcccctggccatggagacccagggttgggtggaattgtgtttgagattggctgacgagatgaacaattagatacaggatcacttggacagggaagtgaaggctcagtaagggattcagtcaggccagtgaagttcattccagtcctgcagggaatggacccttccatgccagggtgcctgtctgcaatgggagtgccctcattttgcgaagcatggaggccagtaagccctctgcagtcccaggaccgaggcccacatggcctgagcatgagttgcaactctagaagaacatctgcctggggatgtgccgttgctgggtgtgctttgctcggtcactccctggctgctgattccttagcctggccaggagggcctgctgggcctaaggaacccctgggcctcctggcagctgctgtggagcaggtgcagttccggctgctgcctgggtagggcagggctgcttgggacacattcatctcacctctcctaacttctagcaccatctctgccgggggaagagcccccacctgtcggccctgattctcttcatcttccttgctttgcagctgctgctgccttgttgatattaagcagggcatcacaatcaagagtggttattaaaaataataattaatgctagtaccttttccttttttccttttttctttttttggagatggggttttgctctgttgcccagtctggagtgcagtggtgccatcatagctcactgcagccttgacatcctgggctcaagcgatcctcccacctcgacttcttgagtagttgggactacagatgcatgccaccatgcccagttccttttcctttttatttcaaaatatattccatcatttccctcatttcccctcacagatattccgttgaaggtgtcagaagtcctaccataggcattttctccatgaggttaccgagggcctgggaccttaacttacctgtctcacagcaacagactgggaagctgttactacgggatggtgggttttcagactctcagccgagtctcggcctggctgcccacatctggtagtgaccgtgctccctggcttctcgttccttccttggacattttctactcattgtctcagtgaatcctcagggactcctgagcgggggcggggggtggtgagaacctgaactattcaactcgcaccctccaccaggtacctgcagcctccctggagtggctaaacaccagaagggttccaataagaaaagcattttagaatctttcactgacgttcttggcattgctttgctcagggagatgtcccctggaatgctggaacttgtttgcctgagctaggctgagttaagaatgttaatcaaaggcttcccaaggcttttctgtcagacactttcattttattacaggctggcagaatcacaatggggtgtgggggcagggaggcaggcatccaggggtaattgtcattatcctgattctgaggatggaagacattgaggctggacactgaggccaggggtaaccccagcaaaagcccacggccaacctggcagcatccaaacccagctctatctgactctctggcacattctgctgcctggtctagcttgatcaagctggacatgacctccatcctcagatggcttcgaccctgacctgcagccatgtttggatctgatgttaaccaggatgtcaagtcctccagctgcagtcaagtcatcttggtgcattcctttaggatggggaagaaggtgccccagcatcactcacagctgagcttgggactctgtggctgtctctgaagagatccctggcctgatgaaatagcctctcctaaaacggggcttctctgtgtgcctggcttcctgccctcctgtctccatgtcctgtccctgctggtccagccaggactttgttcatgctgttcctcatgacaggggcctgcttccatcccttcaccttcccgatcacacccaccttcactgcccccctgcctcctcctggaagccagccctggttgatcacctctggcccctgctgcttatacttcatatggggctcagtcagtgcttcaagtccctggcctatgtgggtctctgttcctgatgtctctgttttacagctcctaaaatgtgctgcagagtgtctggcacacaggtgggcatctgctttgttcctgatcattcccaagaggttctgttgagtttcccatctgcccctctcaaccaggcctggagcctttggaagtccccactgagtgtgtgggccccgcactgctgtgggcacatggaggatcacaggaggtgaggcgtggtccctggccacagggcacagcccccagtaggccgtgggctaggctgtggctgtacctctctctggaagtaggtgtttaaccggtgctgctgggctccccatgggccttacctactatgtgattagtgggatggccctggactcttgcttggcagaagaaggcgagtactttcttgtttcttaaaatttggaaggaaaaataagtgaggttgttctcacttgaaaaataaatttcaccccaggcaacgttcagccacatgccattcaagcccaacagctgtctctcatttgctggcaagtgttcccagtgatgaatgtcctccatctacgctcacagcggccctaaatggaggctttggacaagtgtggggggaacaatggcccttctcagagagcctgcagcagacgctccagtgaagttggttcatcacttgcagcgggggggggacgacagacaagatgccattgatgaagcaaggaaggccaagcagccgtggggagggtgcagctgaagacagaggcggaggcaaggatgggattcgtggctgccaagaaaggtcctgaataatcagagtgaatgatggtgcctctcacgcactgccttctggaagcttccttatgggatgtctcctcctcttgacatatatgtaaaaccctctgcagttgtcactggatcatggggtttgagagggtccggtccttttagggcagaccatgttgttgcgtccatcgtcattggatggacaagggcactggggccaagggagaagcgctaggggcaggaccggaaggcggggcctgcttcattcttcctgtgacgaggttggaggtgggaggggaagactgagaagaagagaagatggactgagggtttaggaagagacggggagagcctctgtcagcctgcgggctacgtgttggcaatccccacttccaccaagctctgcttccatttccctccctggttatgtctcccccaactttccagggcaaagagaaagggtcagatttccaagttggttggacccaatgtggtaaacctagttttcctttctcctcttctttttgttgtttttggtttttcagatggagttattttaaataatttaaaatagcatgcacaacagctacacatttcaaattgctatttcactctgtaaggagttcagtgtagtaattttacatctatatttttatggcaaagtcatacatgcttattataaaatatgcatatgtggcagaaatttgtaacatagaatatgaaaatccctagaattccaccctccatgataatatctatcagggatgtgttacactctccagatctttttctcctctctgcgataataaaaaagctcctttcctctctcttttctcctccttccctcccttcacccttcttgtgttccctcccttccatctttccttcccttcctccttttcctcccctcctgtccctgttttttgcctgctcctttccaacccctatggtaataagttctaaaaagcaacagagcacagcaaaaaggaagtccctcagagccaggttcattcacctgcccttgccagaggcaaacactgccccagattttatgtatctttcaaaacattgtccacatataagcagccatgtatatacaactttttttctttctcccaaacagagcataccactgttgatcttttttttcctctttcatggctatataataattgacgtatttatggagtacatgtgagtgtttgttatatacatagaaagtgtaatgatccagtcagggtatttggggtatccatcacctgaagtgtttatcatttttatgtgttggtatcctttgaagtcctttcttctagttactttgaaatatacataatattgctgggcatggtggctcatgcctataatcctagcattttgggaggctgaggcgagcggatcacctgaggtcaggagtttgagaccagcctaaccaacatggagaaaccccatctctactaaaaatacaaaattaaccaggtgtggtggcacatgcctgtaatcccagctactagggaggctgaggcaggagaatcacttaaacccaggaggcagaggttgggcagtgagctgagatcgtgccattgcactccagcctgggcaacaagagcgaaactcggtctcaaaaaaaaaaaaaaaaaaaaagaagagaagaaatatacataatatcattgctaaattgatagagtgctatcaaacattagaacttatttcttctcttaatgtatgtttgaactcattagccagcctgtctttgtccttcccgttcttctacccacccttcccggtccctgatatctgtcactctattctctatgtccatgtgatcaacttttttagctctcacatgtaagtgagggtggaccttcttccttaagtcaaggctgtatctcgagctcattcctgatagatatgctgctgtgttctttgtacttctgctgtctttcctttatatggcgagcaccagttcatataatcactgggcatttacattttcccccaatcctttgctatgacaaacaacacgtccatgaattgccttgcatgtaggttatttcagacacataaaaaatatctgtagcataaaatctcagaatagaattgctggattgaaggatatgtgtgcttacaatttgcaaagatgttaccaaattgctttctggggaggctgtgtcccttttcactctcatcagcaaaatgtcttgtttgtttccccaaaccttcatcaacaaattggtatcaaacttagtcatctttgcccccagagaaggggcaaagctatctctttatgggatctcttcctgataatttatacttctttttttatgagtgaaatggaacatctttccatatgtttaagagctctgtgtgtgtgtgtgtgtgtacactctcttcatatgcattatccttttttgttgttgttggattgttagtctttttattttttaggagctttttatgtgtgaaggagattaaccctttaagtatgagttgcaaagatttctccagtttcttatcttttgacttgttttatatttatttttctgaaataggatttttaaaaattattttgtggtcaaatttatttccttttatgtctctgggttttgcttatacttagaaagtctttccctagaattatactttaaaaaatctcctgtgttttctttgtgtttttaaaaaacagctttattgaggtattattcacataccatacaattcgcccatttaaagtgtacaatttgatggcttttggtatattcacggacatgggccaccatcatcacagttaatttcagaacattttcatcatctcaataaaaaaccttgtaccttttattgatcaccccttcatctttacatcctcctctcctcatcctcatccctaaaacaactactaatctactttctgttcctacagatttccctattctgaactttcttttgaatggaatcatatgctatgtagactcttgtgacagacttctttgacttggcataatgttttcaaggttcaatccaagttgaagcctgtatcagtatttcattgcttttcatggcttaataatattctgttgtatggctataacaactcttgtttatccattccaccactgatggaaat

SEQ ID NO: 12082 - DNA, 3529 bp, Human
  misc_feature (1)...(3529): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12083 - DNA, 13286 bp, Human
catagtaattgctcagtaaagctgtgttgagttacttgataaaaagtaagtcagtagaaataacttaaatgctcaacattaatgtcattggttaagtagcaatgcatagaactaaatattatgctattaaaaagtttatttgtaaagtcaaggatatggaaaaatatttgatacatacatatctttttgagataggttctcactctatcaccaaggctggagggtagtggcaagaccatagctcactgcagcctccaactcccaggctcaagcaatcttccagcctcaggctcccaagcagctgggactacaggtgtgcaccaccaagcccagctgattttttttttttgaaagaaggggtctcactatgttgcccaggctagtcttgaattcctgacctcaagtgatcctcctgccccggaatcccaaagtgctgggattacgggcatgagccacagtgtgggactgatacatttttgaaaaaaggaaacaacatatattcatgaaggaaatacacaccctcctggtgagtttatgtatgatttttgttttgttgttttctgtgttatctgatcacaaattactttccttttcaggaagaaaaaaatttaattttttttttattggggcaacatccaacccagatatgattactacctagcctgaactgaatgtattactaataaacaaagaaatgcagaatggcatacagtcggtaaagcgtagtgcttgagagcatggattatggagactatttaaatactggctccataacttaatagcttgggacccacggtgttacttagcttctatctgctttaatttactcatctgtaaacttgggataagatacttcctcataaggttggtgtgaagaccaagtgaattaactatcgtttaaagcacttacaaaagtgccgggcaccaccgagatatgcatccgttagcttttattattattagactcaaaacactgtagtagttctaatgagaggggtaagaataaaaaatccaggcacctgcatagagccagagaggcacacatagaagcaacgtaagagtggaagcggaatgaaaacatgctaaagccaggtacaagccacaagcgagggtccacaggaagaaattgttaattctgaagagagtgaatgcacgaagttacaggaaaaataacatctgaacagagtttaagaatgagcaggacttcaacaagtggctagtaagacataaggaacctacaaaagatcttagcaaaggcgcaaagattaccatcgtattgctcgtttcttcctactttgcagaagtaacctctggcgaacagaggtggttgcagagcatgcttatcaagcaaaataccacgaagcagtaaggaacgacagagataacagtaacaataataattcaccccaaggtactcaactggaaaaaggaaatacagaggagaggtgtcgttaagaaagccaggacgcacatcacggccccgtcgctgcactactctcgtctaggggtcaacagtggagtcgagactcgaagcttccacgcggcggaacagcgtccctctcaggcggcgaacgggctagggaagcgcccggaggagacctagcgtgagaactacaactcccgcggagcccgagggcgagctgcctgcgtaacttccgcttccgccacctgcccctcgcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgtgagtgtgaggggcgtggaggaggaggcgggctgggttgcgctcacacttaagcgtctgtgacaggagccggaatcgcattctcccttgaccatggttctagccaaagatctggctgaggagccctaagggtagaatggaggcggaggcatgagagcggagagtcacggagttccgaaaggtgtgagggagaaaggacttccaagaccagagaggggatttacgatatttagaaagcagggaaaggaaaataccccaagtatggagtccgttggaggtgttggtggatttatttgtaggaggaattttggcctgcatcacggtgggaggtcaagtggcatcatttggagagggtatggctacaagcgcttggaaagtcgggacactagacagagcgagaatttctggcaccctgggagagctttgagggggatgcgactgtggtgtggataagaatggctgatggacggattatcttgtgttcctcgttgtggggagcttccgctcttgggacatagccgctacttgtctgaggctccttctctcttgagttctttcagcattaggccttttagccaattgaggctgcttttctaaacatgtaggctgctggagaaaaagggataaggactgctacatcagaaaggagccagcgggaagacagtagaaattccactggtaaatggccatggctgtcttaacagatggggaagtgagtgctacagaggcccagtggtgtaagctgcttcccagttgctggcttagtcattggccaccctaataaaggataatttttagcattgccaaataaaatagatctgtcgttagagaataagaaaactgaaagatttttcaagatcataaaatcctgctccttatttccaaagtatatagacaaactcttgtaccttgagaatctaattgtagcatattaaaagggggctaccgggcccttccatttcattctcttcctgattgttgcacccctatgtttataagttttccagcagttatctttatgccacgaatcgtctaaattgccccagtaacttcacacacatttaatatctgtgtaatgtacagcaagtaatttaacaagtaattctgtaaagcatcagttttctcatctgtgaagtatgaaaaattatacctattttctgggttgtgaagatgaatgaacataatctagggaaaacatttagcgcatatgccactgaattaaagagaagcagcttaaatttaaagacaagccttaagcaggaaagaagaatacagtataaatttattatcctaactttttgaataataagcaaatgaaagatagttcaactcagctaatggctgaggtgtttaacctttcatcccttcctaattttgtgagattccttgttctaatttaggaaaagaaatcaactgtcagtttttaattaggtcctgagagactggaaaggaaaatggcaggctaagtcagtctagaagaaggagtctcctatttctttttagtgagtcagctggtcaagttgtgtgttgagcagtgggttaacttagggaaggtgggagttggaggtctgagttctttatttcacctcctattcagtcaactgtgtgaggaatcacttccccttcacttcttagtagaaaaaaaaaaaaacccacagttttggctgtctactctcatctccaaaaaattgttatgcacatagtggaaatatacatgtagttgttcaacacagaccatgagctctggagctagactctctggctcactccactagctgtgtctcagttttcttactggtaaaatagcaacaataattgtatttactcataaggttgtgaggattaattagttaattaatatatgttaagtgctttgaacagcacctggcccaaggcagtagtctgttgtttcctgctgttgtgtggtttcagtgcattaaatgtgttatgagggccttggacctcttggttagctatgattattctatggaaactaccataatattacagtagagaattgatgtttggggtacaggaagtcaggtagacaatttcccgggattttttgctttagtggggtgtgggaagtggaaggtcagatgttaggttgtttaggggaatggggaaagtgcattcacggccaaggttggagcttccattttcccatcttcaaactcattagtacccatgaaaattctgcctgtttcaagttttatattttaaaaatgaggtggagtaagtggacccgcatgaaaaagaactagagaactttaaagaatattcaaaccaaagtccagacttgcagcgttttttgtaagtgagaaaagtttagaagagttaaatcaggaaattgtccgtgatactcttggaataaacaagtagcaatggcctgagggatcattaacagataccagagtaaagtgttttgcaagggtaagtcagtctgtcctgggtatgaagatggataagagaaaagaaaatgttaggttttggtggggtttttttgccaaaaccacaatgacctttgcaccagtctagtaagtttgggaaagagagctgtctgtgtgttttcattcctagagcagtacaagcagcaggtgcattgaatttactcaattgtaaagtggcttggtgatccccaatttgttgtcattgatttgtagtgtaaaagacaactgtacttatgggaagtctagaaacccttgagatttgtgacctgtagaggccaaagaggtttcagaagactacatcaagccatcaaacagtaaagaggcaaggatggctccacccaagctgtcatcattcttttttaagttctttcatttccctcttcccaactttgtagtttgttctgaaagactcacctatacattagactacaagttacatataaatgaattttctgctgcagatgctcttgttacagagatattaaaatgtactatgtgttgcatatgccagagaatcttgtactttctggataattaaaataccatcgatttattacacattcatacgctttatctctttcctctctctcctgatcctacctgccctccccaacacacactctctcccaaaggatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaaggtaaatgagaagaaccttaaagagcttgagaaaatatttatgttaaagtcttttcttcttactgattttatttcataatgtgctctcttttatgacatagagcaaattctcagcccagtttttagttgctgtgtgcagttttctcatctttcacagaagtgtagctatttccaagactggatccaagagaccagcttgtagaaatttaaggattatttgacacctacatataataggactttagaaatatcagataaacatatttaggccgacacatgtcattataagtgtcaggaaccttcagatatataaatctgaagttggtccctaagaaacgagactatccgatgaacatgggcccttattcattggaacatggttactaacaggcattctaaaaataactagaatattgagctatcaagatagctcaagtgtgttttaataattcatcatcagcaataaggatggtctgtcaaggttatgaatatcttaaaattaaacaaatattcactcagccatgacctcaaataaataaatcgagcatgttgtttgttttgttttaattaaggaaagggatgctgttattcctgaggctgatagctagtaactctcctcttctttcttcccacttctctttacagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaagaaaactccccttcctaccatcgattgactaactgatcccaagtcaatccctctgacaatcctgtatgtcttggccgtttctagtgtcttcagcatatcatacgtgtggttcggcacacctgagactgtaatataccacaggatgcctaattccacagctcctctgtaagccacagctcaggacagttgtgcattaaaatcagtgaaaaacttatgcaaaatgaagactctagccagaattgttttgttttgttttgagacggagtctctctctgtcacccagcctggagtgcagtggcacaatctcggctcactgcaacctcagcctcttgggttcaagcgattctccagcctcagcctcctgagtagctgggactacaggtgtgtgccatcatgcccagctaatttttgtatttttagcagagacagggtttcacaatgttggccatgatggtcttgatctttgacctcgtgatctgcccaccttggcctcccaaggtgctgggattacaggcatgaaccaccgcgcccagccaactctagccagaattctgtagcctagagtccttttattcacccaaatacttttaatgagtttcacactagacttaaaaataccaaccaccaccaccacttttcatcaaattaatcaaagtttaccagttaaattttaagagctcaaacttttttttgcaaactactcagtctgcaaaactttacccactgatttttgtgctatggtggtgatatttcttaaaagtcatattgctggagaggaccatgtaagcacctatggtccaattccctcccatacagataaataagttatacaaggtagctatttactcctggtaaataatacaataaaaaagtaacaaaagggtttggggctggggatcatgtgaccaggttctcctcctgtttcctaatcctgtgactggaaagtcgtatcaccttttgaccttgttttctcatatgcaaaactaggagcagaatctttaccttattcacctcacaattactgaatcaaatgatattttgcaaaagaactgaacacagtaaatactaaagaagagatatgcattccaatcttagatatccactctgaatttatctggggctaagttgaaatcttagatgggcttacccctgctgctcagcaattgtatggaacctctttttttgcttttagaaggtattcagaaaatgaatcagtgttaaggtatggatcataattggttttgcattgtcagttgcctacctttaatgttaaaaattaagattattcttaaatgaatatctgattcttgtcttaagggaacacaagtctttgtaagcaaacaagtttagcttggcatttctggtataccaagttcgtactgatgagggttgtttagttataaccaattgcaatgaattacgcaattccactctgccataccacccagatctgcctctgcttttcccccaccccatagctccattttccttgtccctcctcaggtaattggatcatgctgatctataaagggggtgatgaatatgacaaccactgtggcaaggagcagcgtcgtgcagtggtgatgatctcctgcaatcgacacaccctagcggtgaggcaccctgtgttgtataagccgagggaggagactgaaaggactgacctgaggttggggagaatatccagaggggacacgatacgttgggatggacattagaaaactaggagctcagtttctctctgtgtcagacacgcatcttccatggaaaataggctgctgaaccaggaaggagcagatgttttttgggttttttattttgttggacaggagtcaaaacacttaaccacctgaatgtgttatgccatctcatcatcaggacaattttaaccctgtgtctgaggagcgtggcaaagtccaagattgtttctacctctttgagatggatagcagcctggcctgttcaccagagatctcccacctcagtgtgggttccatcttacttgtcacgtgagtatgccttcctttatcagaacagaccttccttccttttgtttttaaggtcagtaactatatggtggtacataagcacaaattgtatgtgtacattatgctgtaattgatggggataactttttaaatcctctggctataaaataattctgccaggacacagggctcacgcctgtaatcccagcactttgggaagccaaggcagatggatcacctaaggtcaggagtttgagaccaacctgaccaacgtgatgaaactccgtctctactaaaaatacaaaattagccagcacagtggcacatgcctgtaatcccagctacttgggaggctgaggcagtagaatcacttgaacctgggaggtggaggttgcagtgagctgaggtcgcaccattgcactccagcctgggcaacaagggcaaaactccgtctaaaaaaaaaaaaaaaaattctgactgcaagtttttgaaaaatgagatttaatgtttagttgccggtatagatttgcatttggaggtgcttttttcccctactgcaggactaggcaatttttatattatttcattagattatgagaacttctagagaaatggaatcatatacttaatggtgattattcttggccatagaatcacacgctgtcacattttgtctgggcctttgcttctcttggactgacagcactctaactggttttctaagagttaccagccccctttttcatttagtatcactactcatttttccttttcagggaatgtatcttaggaaacagctgacaataaatgcagaggttatcctatctgagtttttactatttcccagttcttaagtatagatgtctttctctctctacaggtttgcatcactggttgctgtttatgttgttggggggttcctataccagcgactggtagtgggagccaaaggaatggagcagtttccccacttagccttctggcaggatcttggcaacctggtagcagtaagtaacagggcagctggttgaatttgtagcctgcaaacaaggttgggtgaccaaccatcctcgtttgttcacactgagggggttcctgggacacaggacattgagtgctaaaaccacaaaagtcccagcaaacaagacagttgccctagtacagagtagtaagtggcacagcatccatttctggccttggtaagacattgctgaaagagcaacactgttgaccagatgggctcttctaaatctgatttagcttttaagagggcctgggtgggaagaaggtgaggcctaataagaagaaactttttctcctgttgccccaaattgaatttaggctgattgtcagatcttttaggttttctcattatccctatagaaaaccaattcttgccacattcctagaccataagtacactttctcatatcctaaagttagatgctgcgaattatttccttcttttttctccccctacaggatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggcagcctagaagaaatggtgagaacatgtaggtaatgccagatgataggagaagggaagctaaatgaaactgaggtctagcaatgattaattccaaagtacctgtcctaaattcagtaatatgaagtcagatggcaagctttaaaagcaaaatgaaattagaaagcaactggtatttaaaaaatggccaggtgcagaggctcacgcctataatcccagcattttaggagaccagggcaggcagatcacttgagctcaggagttcaagaccatcctgggcaacatggcaaaaccttgactctacaaaacatacaaaaatcagctgggcatggtgatgcatgcctatagtcccagctactcgggaagctgaggcaggaggatcatttgagcccaggatgcggaggttgcagtgtgccaaaattcatgccacagcactccagcctgggcaacagagtaagactctgtctcaaaacaacaacaacaacaaaaccaaagtccaagaccaagaaaggaaaagcaactaaattgttcaaccacagaaataacttcattcaaatagcttagagacaggggaaagggagagaacagaaataaaagcatgttttcttttatactggcaaaaagattctttgtgatatttttgtttaagggcccagaattcagacaaatagcaagaagggtagggtgattttcatttccgaaaaaaactctgtcaaaattgcatataggctgagtgcagtggctcacacctataatcccagcactttgggaagccaaggcagaaggatatcttgagcccaggactccaagaccagcctgggcaacatagggaatccctgtctctgtttaaaaaaaaaaaaaaaagaagactagcaaacaagccctctttgaagagtggggcaacaatggccacttagtttctaataccctgctccactgaaaa

SEQ ID NO: 12084 - DNA, 25633 bp, Human
gactacaggcgcctgccaccatgcccggctaattttttgtatttttagtagagacagggtttcaccgtgttagccaggatggtctcgatctcctgacctcgtgatctgcccgccttggcctcccaaagcactgggagtacaggtgtgagccaccgtgcatggcctcaattccggtttttaagccacccagtttgtgaaactttgttgtaacagccctggaaaactgatacacctgctctctcgtaaaagatcagctgatacggcagcaccggccactggatctgcgggtcagttgtccccttagacagggcacctgcccgccagtcacaggtcctgtcacccagccccttcctctcatgggctccagccgcctcgctcccacaggtctcctggagacccgagttgctgatgtcagcgactattgcgagtgctcctgtgggacactgtcctctccccagcaacagccttcagttcacacccagggaggagatggagccccacactgcaccagcacacgactccagctccaactaggtgggtgttgatgctgaaggctgtgacatgcaaataccccccaggatctccttgtcaccccgaccaccaccaccaaagcccaggcaccaggcccctctcttctccaggacccaggcattcaagccccgcccgactctcaatggtcctttgtcccggactgggaaaggcacgggcagagtctgacatcatgaagcctggggtgggggtgggactccccctccccctccaactcccccccagccccacaacgcttctctccctggtctgagggatttccccgcccctcaccccctgggttctcccttgagagcgaggaccccccctccccactgctctggcctgaaggaggacaggagatgtcccagtgaggctgaacagctcatggtgaaatcactgctgcactttgtcacgccacctccagctgccccgagcccccacccaccttgcaaaagtcatgaccaaggggtggaatctgcactcagagggtccttgcccaacttggtcagcacagtcctatgtgcaccaagcactgccccggggacagaagggtgcacatgacagacagagaggcagataggtttctggtgagcccctgcctctgagagctcctgggttagtgggaggcagaggcgggcagacctagggtgcacacgggccagcctgccaaggctacagaaggaaaggacagcattgcaatggaggggcctggctgatgggcgaagatgggaaagcttcccagggaagcggcacccaggctgctgagcctacaggatgggtgaacggcagccagtgccagagtggggagtgctatggggtggggactgctttccaggaagaatgagcagcaggtgcacaggccttgagtctgaaggtgccctggggctctggggaacacattcaaccacccacactgtttattaagctcaactgcctgccaggagcttgtctacgagcaaggatggattgagaatatccaagacgaagcttctggcctggtggaggtcacgttctcatgaaaggagttggtgaacacggaaggtcatttcagatggcaagaggaggtgacactgacgttgagggtggaaaggacctgtctcctcctgctgcccacctaatgttgccaccaagattccctgaggacaatgcctctgtccctcagcctgggacttccaaagagattagactgcccccccacccccgggacccagaatcagggtgtacagggatggaagatggggagagagcaaggcagccactcccgacccctccaggaaagagctaggagaacccaggcgtcaggctgcccagtccgagccccgtggtgacaagggcccctttgtgcccccctcccccgggggtagggaggagctgggccctggaggcaggcggcccctggcacccagggggaggggaggggctggcaagtgggggcctagaccctggaaggcaggggactgcgagctgggctggcggagcagaggtgcagaagcaactgagtccaagtgagtatggtggcagggaggccagggcaaggggagcagggcaccggggcagtggcacccagacgtgagcagggtcaggtgctctgggtgagggagcatcgctgtgcaccgctactgatttaggatgcaggagtgtgtggcttggggctgctttggggatgggctcggaccatcgctggggcagcgatggggctctgggaagaaaccacagagagaaaaaacaaagggccccccctcagcaccccttgtgggtgaagattttgcaggagaggtttccttggggttcccgagtgcggggcagatggggtggaggaggtctgcatctggccgaagaatggaaggatgtccaggtgatcagacacctgcaggctgcaatctgggaggtggatgggggcagtgggctgttagtgactgcattctagcacctgggcacatagcaggtgtgtgtgtgtgtgtgtgtgcgtgtgcgtgcacacacatggctgcccatgcaccttcctctgtaagcctcagtcgacttttcttcattaatccccactaaggacactttttatttttcgttacttttttttttttaagagacgggactctcactatattgcccaggctggtctcaaacttctgggcacaagagattctcccaacttggccttccaaagtgctgggtttacaggcgtgagccactgcgcccggccccaactacagaaactttttagatgcatttgtcctcatcccatccttcccttggcattttaatccaacagatctgctgtacatatgtttatggactgtggccacacacactgtaatagctgaggttgatttggcccccatcccgagaacttgttttccccgctgttaagagtgcatggtctacctgcttgtttcatgtctgcccgggcacgtgctcatcctcatctgcatctctctcctgtaccttcctgtcacaggtgcaagggcagcgtcggccaggtgtccatcggcgcgtgtctgagtggacgcgtctatagccatcctcagtgtgtgtgtgcagttccttgcatctttgttagcctggcatgcatgctgggctgtgtgtgtgtgtgtgtgtgtgtgctgaatgccagggctgtgtctgtccaggtgtgtgtggacagcagcagaggcattgcatgcacgccttgggaactatgtgagtgccagcccatccctgtgggcacaggggtccctgtgcctgtctgtgtgttcagggtcctgtctgggtgtctgtatgagtctccgctgcgtgtgcctgccccttctggctggggctacatctgtcacatttcatccccgcgattggatgtgtctgtgcatgtgtctctgtccgtgggaagagggcggtgaaggctgggaaaagcaattgcttggaaaccctggctgcaaccccaaggcaacccatggagcagcagggtgccaggggctcgctagcccccaccctgggccttcctggccctgctcaaaggccagccaggagtgcctgacccctttcttactccccacttaccctgaaagccccccgcaggctaaaacaccctctccccgagggaacaggactcttttgtaccggggaccagcttctggtgagggtgcggacaccaggggccgtctgtggggtgggagagggcggcaggaattcacgcggcatgtcgggaatgctgatactgtgaaacccagtcattgatggctctgggtccctgcccgccacccccaggccccggccgtgggacatctgctccctcactccactcgccacacccctcagtctcacccccgtaccccgatgcggtcgttcccccttccctccccacagttctctgacaccccagcttggagggagttgttgccagagagtggcttcgaggctgtgtgggagggtcccaggcacaatgggaggccacatgggcagcctgacaacaggtcacaacccatgcaggagatactgaagcgggggtgggttgggtgcctcaatcccgcccccttgcacctgagtgactcttgttgcatgcaggttgtctggcggcttcaggtggacccagaagacgtccccaactcagggagattcaggtgaggggcagggtaccaactctcttcccttgcttcagctttgcaatgctggccctgccttggctctctggttcttactttctggagatctccaggggcatcacggtgacaaagataatgatcagcacatcatcactgcatagagacaggacatgcagcaaagactgcagaccaactgtgtggccttgggcgagtcacttaacctctctggacctcagctataaaatgaggataatgcatcttcctcaaagagatccaatgagttaagacagcagaataagcagtgagggctggcacatggccaatgccatagaagggtttataattataagtaatagcagcaggctgggtgaggtggctcatgcctgtaatcccaacactttgggaggctgaggcaggaggatcgcttgagccaaggagttcaagaccagtctgggcaacacagaacatggcaagactcccatctctaaaaaaaataataataataaccaaataaataaactaaaataaaattagccaggcatggtggtgtgtacctgaggtcccagttactctgaaggatcgcttaagcctggcagattgaagctgcagttgagtgagccacgattgcaccaccgcattccaggctgggtgacagggctgagaccccatctcaaaaagtaaaaagttaaaaaatatcagcagaccaggcatggtgatttacacctgtaatcctttgggaagccaaggcaggaatattgctggaggccaggagttgaagaccagcctgggcaacatagtaagaccccacctccacaaccatttccacaaaaaagaagaaaaattaactgggtgtggggtggcgcataccagaagctgagacaagaggataacacgagctcaggattttgaggctatagtgagctgttattgtgtcactgcattccagcccgggcaatgaaacaagaccctgtctcagaaaaataagtaaataaatgcataaataaataataatagcagcagcagctaacatatgaatgggccccttcctgaagcccagatggaacaccccctttcacttcccccagcctttaaccctctcctctccctttccagcgatcactcactcgctgtacagaatgatattcctcacggcactgcctctgttctggattatgatttcaggtaacggctgacaggtgctggggacctaaaggctttggcccctgagcaggttggaggtgggtccccgcagccccccggcatgtggttggggatgggagccggagggggtgatcgggtaggacgtgtccctgagcctcagctctcctgcttgcccgcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcagtgagtccccagcggttgtgcaggcaccgggagctggggcagcggggcgggaaggagtgtggccggaaggcctccccgcaccttccccagcaggcctggatggcagatctgggaggtgctgatttggctgggggtgcaaacctcaaggcccacgcagaccatgcagatgacagacatgaacaaagcagggccccaaaatagtcttgctgccctcagggggaaacaggtgctgctactcttttggaaacacctggagaaaggcagtggggccagggggtaggggcaaggctgctgggcccccactttagcgtggtgatcttgggcaagtgacttaacttccttgggccttggttttcttttccgtaaaatggggataagaacagcacttaaggcaatgagtgaaaagccatcagatgcccagagcagcacctggcacgtggcccccagctctggccaacagaaagcagggcggtggctgtcaggtgttctgaattttcaagataaaccagaattttggattctttggtgtaatctcctaattcttaaattttggttgctgattcagatttctttttttaaaatcctttaagccaaatagaatacagctatggccagacatggcaatcagaatagggcacactgcctgatttcagggatccccctgcctcatttctgagtggcgctgctgcttggagtcctcagcgctgagtccctatgagagagccgggttcaccctggtgcagaaagagactgcacaggtgcagtacacacacacaccactctacagaaatcacacactacacactgcacactctacctacacactacccacacaccacacactacacatacatcacacactacacaaaccacacaccacacactgctcctgctacctacacactgcccacacaccaaacatacacatcacaccaaacacaccacacacacacactacacaaaccacacaccacacactgcatacactacacacacacacactgcttggcgctgaggactccaagcagcagcgccactcagaaatgaggcagggggatccctgaaatcaggcagtgtgccctattctgattgccatgtctggccatagctgtattctatttggcttaaaggattttaaaaccacacaccacacacacaccacaccaaacacacaccacacacacacaccacattacaaaaactcaccacacactacacacacaccacacacaccacaccaagcacacaccacacacatcacacactacacaaaccacacaccacacacttcatacactacacacactacccacacaccacacacacaccacaccaaacacacacaccacacacacaccacactacaaaaaccacacaccacacactgcatacgctacacacacactacacacacaccacacaaacaccacaccaaacacacaccacacatccaccacgctacaaaaactacacaccacacactgcacatgccacacacacactacccacacaccacaccaaacacacaccacacacaccacacacaccacacactacataaaccacacatcacacactgcacatactacccacgtaccacacacacaccacacacctcataaactacacaccacacactgcacacactacccacacaccacacacactacacacactacacacaccacacacatacaccacacactgcacatgctacccacacaccaaacacacactacacactacacactgcacaaaccacacacacactacaccctatatacactgtacacatacatgcgccacccccacatcacaacacaaaccacacaccccacacacaacaaacatgcacaacacacgctacacaaaccacacaccacacacacaacacaccaaacacacaccacacacacataccacactacaaaaaccacacatcacacactgcacatgctacacacacacaccacaccaaacacacaccacacactacacaaaccacacaccacacactgcacatactacccacgcaccacacacacaccacacaccacataaactacacacacagtgcacacactacccacatgccacacactacacacaccacacactacacacaccacatacatacaccacacactgcacatgctacccacacatcaaacacacactacacactgcacaaaccacgcacacactacaccctatacacactacacatacatgcactacccacacatcacaacacaaaccacacactccacacacaacaaacatgcacaacacacactacaaaaaccacacactgcacacacaccacacagtacccaaaccacacgccacacaccacacactctacctacacactacccacacaccaaatacacaccacacaccaaacacacaccacacaaaccagacaccatgcacacaccacacacacaaaccacacactatacccaccacacactgcacacacacaccacgtactacagaaaccacacaacacacactgcagacactacctctacaccaaacacacaccatgcgctacacacaaattacatgctacacaaaccacacacactacaccctacacaccctgcacacatacatgcactacccacacaccacacacataccacacactacacacagcacacacacaccacacatgatacaaaccacacaccgcatacacaccacatactacactcacaccacacaaaccacaccacacacacaccacacaccacacacaccacgtactacgcaaaccacataccacacacgacccaaactacacaacaccccacacacactgcacacatacatgtactacccacacatcacacacacaccacacatgacacagaccacacaccacatacaccacgctctacacccacaccacacaaaccacacatcacacacacaacacacactgcacacataccatacacaaaaaccacacactacacacatacatcacaaacacaccacatactacacaaaccacacacatcacactacacacatgcaccacacacccacaccacacacacacacacacacatacctacacacacacacactcacatgcccggcggagggtaaaccaagcaggcatgggagaggagagccgcttgggaagtgatgaggtgtggggagcccacgctgacgccagagccacagggtttgtagccagtgttacctggtgccagctgcagcctcagtttcttcatctgcaaaatgagcaaaattacagtcctcaccctctcgctttgcgggagggactggcaagttaaacgccgtcaagtgctctggccacgacactgtgattttcattacgatggcgctctggtggctccgtggagggctccggggtgaccaagaggaggaagggtaaagggaattctgaatctggaggcagggagcggaggcgataccgttgaggagtaccattgccagcaatggaggtggacaaggaggagggtgggtggggtgggaccgggaccgtagcccagtgctgctttctcagccctccctttccccgcctcgtatagacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtgtgagcctgggtgcgggcggggcggggtggggcggggtggggcggggtccggggagggggtggacctggggatgcggccggaggcggggccgggccgtgatgggggcggggccatgcccagggccaggcagggattggggggttgggtgggacgggggcggaaccaggcagtcctggggcggggccaaggctgagggcggggccggacagtgttgggggcggggccgggctgggagagggcactgggccggttccccagcacctgctcactaacctcgctgtgtcgcgggccttagaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtgtgagtggcccactctgtgcgtccacacgcccacctgcagccgagagataaagggaaaggggcctcatccagggcgagcatgggctgggtcccgaggggaccggccataaacagtcgaggccaaggtagacaggggggttgcaagtcaaggtgtaccttcattctttccacaagaatctggggaacacctgctctgcctcatcctccttccaggacaagacccaggcctgcctcctagggaagcctgttaactgcagcttcctgggggcagttcctggttgttctgggacttgatgtgggtctggtcccaggaatctgcgttttactttataaaatttttttggagacaaggccttgctctgttgcccagtctggaatgcagtggcaccatgatagcaccacttgccctcaaactcctgggctcaagcaagcctactaccccagcctcctgagcagctgggcctacaggtgtgcaccaccacactccaggctaattttcagattttttttgtaaaggtgggattttgctatgttgcccaggctggtatcaaactcttgggctcaagcaagcctcccacctcagcctgctgcgctgctgggcccacaggcaggtgccaccacacccagccaatttttctatttttttatagagacagagaatcgatatgttccctgggctagtcttaaacttctgggctcaagtgatcctcccgcctcagcctcccaaagtgctgggattagaggcatgagccaccgtgcctgtccaggaatctgcatttttaaatgaattccattgtagttctaatgagagggttgaggggacttcaggcctcatccagccccttgtatgcacatttatattactgggccagcaagaagggagctggtcagaagaggattcttagctgagaaccaaagagataccattcattcattcacaaatgtgtactgaggcaaagtgcccagcactggggatattaataatgacagccgcagccaacatttactccacagctcttgagtgctttttttttttttttttttttgagacagagtctggctctgtcgccaggctggaaggcaatggagcaatcttggctcactgcaacctcccacttccctgttcaagcaattctcctgcctcagcctcccaagtagctagaattataggcgcacaccaccacacctggctaatttttgtatttgtagtagagacagggtttcaccatgttggccagaatagtctcaaattcctgacctcgtgatctgcccacctcggcctcccaaagtgctgggattacaggcgtgagccaccacactcagcctaatttttgtatttttagtagagacagggtttcaccatgttggtcaggctgctctcgatctcctgacctcaggtgacctgcctacctcagcctcccaaagtgctgggattacaggtgtgagccaccacgctcggactcctgcatgcttttgacatgcaatcttccccccggcattcccacggctggctctgcccacctcctaggctcgctgaagccttcccccatcatcctatcccaaactgtaactaccctgattttccataccctcagcccctttatttttctctacacacttcttcccatcttacaaattacatattttatttaattacatcggctgtttccacatgggccttgttcaagctagagcaatgcctgtcactcagcaggttctcagtgaatgttggatgatcacccctatgaggttggaactattatgaagcccattttccagatgagaaaaatgaggcccagagaggttaagatgtgggtccacacacaactggacaggggtagagtagggatctgaagacaagcatgctggctaccaagctgctgttcttggaaatgagatagccaggactggggtcacctgagccttcctgaaccggtgtgctaggtttggggtgggatctggggtcatatctggggatggtagttggctggcagaagaagcacctcctgggttctgaccatcagtcccgtcctaccccgcagatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagtgtgagtaccttccgctcccctatgctggggatggacggttccgtgggggacaccagggttactgtgggtgcccacgcatcccaatcagtattggctttgcctgtcctccgcagagacaaggaagggagggcagggaagctgaattcacagcaggaaaataaaatcccatctgagaatattgtgttcccacatccgggagtgggcttttttttttttttttttttttgagacagagtattgagtcttgctctgtcacctaggctggagtgcagtggcaggatctcggctcactgcaattgctgcctcctgggttcaagcaattctcctgccccagcctcctgagtagctgggattacaggcgctcgccaccacacctggcaaatttttgtatttttagtagagacggggtttcgccatgttggcctggcttgtctcaaacccctgacttcagatgatctgcctgcctcagtctcccaaagtcctaggattacaggcgtgagccaccacgcgcagcctggggtgggcttttgaccagtgaaatttctggatcctgtggccactgcccctctgcactaaccgaaacaatgaccatgatctctaacctgtgtagagtgtcgctatgtaccaggcactgttggaagcgctgtacagcaacccactcatttaatcctcatgacatcttcatgagggaggttctattactgtttccctgtttacggagaaggaaactgagacccagagaggttatgccacttgcctaagttcccacagccaggaaatggcagaatttgaggtttgaatccaggcagtctggttccattcttcttccctgcccaaggctgacctcatcctatgttatgacagcagaatacattgatggggtaattgctatacacaaaaggctgtgcggctctgtgagaggtggaggatagggctgagaagacaccacgcttatgaacaggtacagaatagctggagagatgacacagatgcacataaaaagctactgtcttggaaatgaaactcaccattgcaccgctggccagcgcctctcatctcctcactatggactgtgccaccatctcccaccacccctacccccacagccatcactccaggttgtagcagccaagtcacagttttgactccccttccttaagcaactccctctggaatatcgccttcctgtttccatttcccctgcttcctcccaagttcctgttggcttctagcactcctccccaaatttcacctctctggtcttcacgatgcccacaatggcccccaccacacaagtttgccagaaggttcgatgacattcaacatgcaaagaattcaaagcagtgtctgctacacagtacatgctctgtgctgtgtacatggcgacaatcagtacatggcagatacaggttagtcctcgggggcaacctctcgtggcaaagccgtccctctcctgctgacctataatcttcaggcactttccctcctggttctgttccctagcggggctgatgtgatcctggcgcggggctgcgtggtcccctgctccctccaactgtgcgtgctatcctgggccagcttccccctctggttgtcccctgatccctgttacaccccacaccagtgattcttcagtttaagagtcagagagaggagccgatgggagtacttgaacaagcctgcagcaccaactcacatacattttccggtggggtgcagatctctcctttatagtaagagcagcaggcagcaaatgcgcgttaggggcctgccctgggccagaccttgaatcctctacagctgttttctggttcagttcttatttttattattattattattttttttttgagactgagtctcgctctgtcacccaggccagagtgcagtggcacgatcttggctcactgcaacctctgcctcccagattcaagcgattctcctgcctcagcctcccaactagctgggattacaggcatgcgtcaccatgcccagctaattttttatttttagtagagacggggtttctccatgttgcccaggctgttctccaactcctagtctcaagtgatccacccgcctcggcctcccaaagtgctgggattacaggtgtgagccaccatgcccagcctatctggctcattttcaattctagggtcaccctgtgaaacaggggtgtgttataattatcccctttaccaaggagaaaactcaagggcggaattccctgaggccaggcagctataaaagtgggtccgagcccgataattccagactcctgtctgccccagctgttaaacctctggctgcctcacctccctcacagctcttagcactctaggactcaatccggcttctcttgaaaacgaacacgcaggcagatgtggagtgtgcaggcctcacctgctagacttgaggggagcagtggccctgtcccctgccccacctgccagctccctactcttcacccaggcctgtgtcaaagtgcttgcccttggagagtgcgaccctcaggccccctccctctccacacagtcaatgttccctggcaccaggtctccaatgttcactgacagtggtggtgacccttgagcagggccttctgtcttacctgccaaccccagagccctgaacggcacggggcatgcaggaagtgtgcaaccttaccgagtgcctgagatgtctagggaactagcttgagtacgttgtacgcattgacctattttgttcttacaaccatgtgattgaggggagggtaccattcttcaacccagtttaatacaaggaaacagaagtttgactggcatccagtcccaacagggctgaacagacctgggctagaatcccagctctgtccccatcctcctgcctgagctcaggcgagtgacttcagctttgcaacccttagcaagggttcataacagtatcttaccacaaagatggctgtgagaactaagagaattaggctgggcgtggtggcccacacctgtagtcccagcactttgggaggctgagacagttggatcacttgaggccaggagttcgagaccagcctgaccaacctgacaaaaccccatctctactaaaaatacaaaaattagccaggcgtgatggcgcacacctgcagttccagctactcaggaggctgaggcaggagaatcgcttgagcccggggggtggaggttgcagtgagctgagatggagccagtgcactccagcctggatgacagagcaagactgtcccagccccccactccagcctggatgacagagcaagactgtcccacccccccactccagcctggatgacagagcaagactgtcccatccccccactccagcctggatgacagagcaagactgtcccacccccctactccagcctggatgacagagcaagactgtcccatccccccactccagcctggatgacagagcaagactgtcccacccccacactccagcctggatgacagagcaagactgtcccacccccccactcccccacaaaaaagaagaactaagagaacaatactgagtgttcatagtgctacatactctgtggatattggatgtcatcatctttctcactgatttttcctttggactccaggttaaatatttgttgtgtgttttgctgctgaggttttgctcatgtgacctctctgctggaatggttctgtctatccacccatgagtacttgggtgggatgttacgtatttttaattttaattttttatttttttgagacagggtcttgctctgttgcccaggctggaatgcagtggtttgatcatcgctcactgcagcctcaacctcctgggctcaactgattctcacacttcagcctcctgagtagctgggactacaggcacacatcaccatgcccagttaatgttttaattttttgtagagatggggtcttgctctgttgcccaggctggtctcaaactcctgggctcaagtgatcctcctgccttggcctcccaaagtgctggaatgacaggtgtgagccactgcacccggctgggatgttaagtgtttacaacacacttgcgcgcctatcttcggagtcccgtagccccttgtgagttactgactgtaaccccctggtttgcacagatgagaactccatcctagaggcccaggagcctgagtggcctcacccagccagtagatggcagagctgggattcaagccaaatccatcccaccacaaactcctcattctttgtacctttgtcttacaggtttgtctagagtcccataacagtttccgcagcttcacaggttgtctgaaaagatactaagcacgtgcaccggcagggtgtcggcgttccgccgacatccaggtcgaacactttgtcaccagagcaccagtggggctgtcttgagtggaagtgctttgaaaaagttttatgtctgtcggttcaggttcgctgttattaatgtactccgtggcgtgttagctggttaacgctatagcaagcatattgcagctctgcccgaacaggactttttattcagtagacttagagatgtttgcacagaggttcccattcctgccgtgaatccgtgtgcccgtgtgactcccaggtccaccaccgttaccggcacattctttttgctagcaattgaaaataggtggggtaggtgagccaagggtctcttgcctgtgtgtaagtgggttttggtgagaactcactgagaaccagtgctcagtctagagcaagccaaggagggtgctggactctcaggccaagaaagagaacacagtttaaaaagcagcattctgtgctgtaatacaattgcgtattttggtacaaaaattagccaggcatggtggcacgcacgtgtagtcccagctactcaagaggctgaggcaggacaatcacttgaacctgggaggcagaggttgcagtgagcagagatcgtgccactgcactccagcctgggcgacagagagactccgtctcaaaaatcatagtaataacaataataataataataatttcctgttttggaaaatgaaagaaaaaacctaccagtactatttttgtaatccagtggcagcaaagcaaagctcaaccaagtgactttgggtggagggtggtgtttggtgctagtggcaggagggaatctcatgggtgaggaagggccggggttcaaggcggctttaggggaggaagtggggggcatctgcagcgcagactgaaaggaaggagcacagcctggaagccagaaaggaggggatagtctaagcctgtgtgagccccaagggtctggggaggccgggggctgggagagttccatggttcctcccttctacgtgtggggcccagagtggagaaggagcaagcccctgtcttgatggaaacaggaggccccttatgtaagtgtgtgatgcagggagggtgagtgctggggaggagaactgagtgaggcagggagtgaatgatacgtggagcgaggtgcagcttccctgggtggtcagagaaggagacgccgcatgggtagaggccagtttggagcgagggagggcgttccacaggcaactgatggaagtgttccaagttgagggagaaacgcacagaccctggagtgggagaaagctccacgattttcagacacagcaaggaaccggtgtggctggaaaggactaagccagggggagagaaggagagagtgtgtggtcaggcagggcctgaggggccttgtagatgaaagactttgtattttgggctgggcacagtggcttgcgccttataatcccagcactttgggaggccaaggcaggaggattgcttgagctcaggagttcaagaccagcatggggaacatagcaagaccctgtctctacaaaaacaaacaaaaaccctccagtaactatcatgagtatgacagatttaccgtcctctgcaattctgaacataaagctttaaaatcaaaaggctttttgcaaatttggcaccaccctgatttgacagcaaaatctcgcctaaagaacacaaggctgtttgtaatctatactgatttcatttagggtgaatattcgtactttttgctgtatacattacattgaactatgtgaaattttttctgcatgtcaaaaatggtcaaatgtggctgggcgcagtggcttatgcctgtaatcccagcactttgggaggctgaggcgggaggatcactagaggccaagagtgcaaatgagctatagtactgccactgcacttcagcctgggcgacagggccagaccctgtctctaaatgataaaaaataaaggatttgtattttaggtgaaccacggagcaacagaaggagggttttgagcagagagtgccatgatctgatttatgtattacaaggtgaatgaggttagagagagtgtaagagccagggcccaggagaaacggcccgtccctgtgacatagtgctctgtccaggctgaagctgaggctagagtcgcctcaaaagtggcaccagaagaattgccccaagagagcaccccaaaccaccccgaaatgaggccacttgggattccaaagagagaggcactaaaccaccaggtgatcatcagtccaaagcatttgggaggggaacttgcacagtgctacggcgagagaaagggagggtctacccagacacgtccgtgagggtcagggtatgggtttacatgagggtttaaggaatttggcccagggctggggctggtttctttcattctttcatttttgttgttgttgttgtttggggtttttttgagacagcgtctcattctgtaacctctcgtactcctgacctcaagtgatccactcactcttcggcctcgcaaagtgctaggattacagcagtgagccaccatgcccggcctctttcagtgttttgagcaacaacctaaacacctttatcagtgcctgggaatgttcaaggccccaggcgtgggttagtgaagcttgcagtgaaaacaggcagccggcggggtcgtagtgaggtcaaggcgctctcagtcaggacagagaaaaaaggaggggaaattggagggccctacatgaagctaccgcccccatccttggccacactggccttgccttgagccaaggagtctcccgggccgggcctcgcgttggctccgggccaccctcagacctgattttgcccctgcagtcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccgtgagtggcgtggacttggggtgggagccacaggagggagcgggcacgtcttagatccaagctcccaaggctgaccaacagccacagagcatgggctatgcagattgacagaaaggtcaaattctccctttccggttggagaggagaagccgccctgagtttgccccgagtttgctaggacctttgaggcatgagcccctccccagggccctctagcatgaaagggattgccctggcacgaggaggctccgtgccaatcagtcagtgcaaggatgccccggctgtgtgactacattgactgtcatcccagcatgtctccaaagttctcaggtgtcgtcaccaccacccatagccctaagggcgcctgggtcttttctgtcctcagatcgactgatgtgggccaagatcgggcctgtgggcgccgtggtcgcctttgccatcctgattgccatcgtctgctacattacccagacacgcaggaagtgagtgccagctggggctgatctggggatgggagtctccaaaaaggggacctggtgggagatggaggcccagagtgggtgggggaaggcagcaccataagtgtagagaaggcagattctgttctgggaatgttcagctggacagaggagagagggttcctgttaattccagcccctgctggtcaggggcacaccagggcctgggctgagccctttacacacatcatttgagacctgtttgcccacattctattttgacagcctccctatctctaggaactctcccctacacactccagtgtggtggggaaagcccaggtaccccactgcagccacagcagcaggtccacttgacgccagaagccccaaagattacacacatctggggcaaaaaaaaataggccttggccgggcgcgttgactcacgcctgttatcccgcactttaggaggccaaggaggaaggattgcttgaggccaggaatctgacaccagcctgggcaacatagcaagaccacatctctaaaaaaaatttttttttaattagccaggcatggtggcacacactgtagtcccagctacttgggaggctgaggtggaacgattcttgagctcaggaattagaggccagcctgggcaacatagggagaccccatctacaaaaaaacgaaaaaattagctactagtggcacgtgcctgttgtcccagctactcgggaggctgaggagggaagatcgcttgagcctgggaggttgaggctgtagtgagctatgatttcaccactgtactccagcctaggtgacaaagagagaccctgtctctaaaaacaaacaaacagacagacagacagacagaaagcctctccagccccaaaccatacccacctggcccaactcagctgcagccgtgtttctttcttgtggcacacacacatcagctgtcctgagaaataaattaacccctctgctccacatcctggtggcaagaggggcagaaagacccagagcctatgaggggaacctggagaatccaggtgggggtcctgaaaaacggcagagctcaggggccaggtggctcgtccccagccgggcaggggccacagaggtgggaaggatgggctgtgtgggtaggagaggctggtggttctgaaagggctgcttgccacatcttagagatgggtgggagaactctgaggtcccctgagccaaactcctaaaacacgtgggggtgcagaaagggagggcagagagaggtctgacgagtcctgccctgcagaaagaacgtgacagagagccccagcttctcggcaggggacaaccctcccgtcctgttcagcagcgacttccgcatctctggggcaccagagaagtacgaggtaaggaccaggctccaggctggcctgggaacctggatgccagggacactgaaggcctgggaaaggcctgtgaggccaaggggcaggggagtgggagcggcctctcacaggaggagaggaaggacattccagggctgggttggacctggaggctggggaggaggtgcccaggccgaagctgtgtagggggcgatgggacgtggggcctaagggccccctcccctccctgcctgtgtctgtgactgcatttccttctccaatagtccaaagaggtttctaccctggaatctcactgagtgccccaggaggtaggttccgggggcctcagtgtgccctcctctgggccctccttgggccctggggttggcgtgcatgtccgtgtgtccctgtcaggcgtcaaggtggtctctggtgatgtccgggcctgcccggcagtgctggccttgtctagtctgtcctgttgcagctcccttctgtctgtggccaccgtcctgtgtgtccaaattcctgtggctagggggtggagggaggggtgggaagcgtggggggaacccacatgtcacctgcaggacctcccagattgagggcggacccatgcaggacccatgggggggcacgtaccaaaccaggtatttccaggaatttggaaagatggggtcctgactaggtggttttcacccaaaaaggtattaggggttacattgtgtgccctcaaaactcctatgttgaaagcttcctggacgggggcagtggctcacacctgtaatcccacaactttgggaatctgaggcggatggatcacttgaggtcaggagtttgagaccagcctggccaacatggtgaaaccctgtctctactaaaaatacaaaaaattagccaggcgtgttggcaggtgcctgtaatcccagctacttgggaggctgaggcaggagaattgctggaacccaggaagtggaggctgcagtgagcaaagatcgagccattgcaatccagcctgggtctcaaagaaaaagaagaagaagaagcagcttcctggagaaactgaatttgtaggcaaatttcaagttcagcaatgattaacactggcagaagctccagagtgggacctggtgaccgcagggctcgctgggcctgcggtccttgagaaaggaggttctcgcagggatttatttgggactgaactcaggagctctgagggtgcaaacgctctgtcctctgcattgggaaaaggcagggagcaggaccctgctaatgggcggtttcccctcttagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagccaaatgccagtctagatcctgatgctttctgacccgcctttgggcagcctgccatcccaccgtctacagaacgatgacagaatttctccttgccctcggctgagcctggtatgcaggcaagggcccagggattttagccttgaacccagggccagtggccactaagttgctcccactctgagctggtagctgcgagctgggtctggtttgacttatggatgatttcacataaaaatcctcatgctggtttttgccgcagtcagatcagctgacagcaccaggcttgcacttgtacgtggacatgacttgctgaaagggagggtcctgtgcactggccgcagtccccaccactccctattgtcccacacctggccggcttcctgcactgagattacctcctggtccctgcagcttggagtgcgagccacagatctaggtctcaccagcccgtgttggtttcaccaccatctctcacattcatgctgcaatttgcagcgtcagcctttatacatcactacattcagttccagaaacattaattaagcaccagctgtatactgagccctttctagaggctcaggctgtcctgagaagggtctcctaggacagctctgtgacgatgagaacactgagacttagagaagttaggtgattttcccagggtcccagagctcggaaacggtgtgtccaggccatggggttgatgcttctgattcaaatgcactctttcttttcttttcccttcctccctctctctctctctctctctcttttttttgatggagtctgtctctgtcacccaggctggagtgcagtggtgcaatctcagctcactgcaacctccgcctcctgggttcaagtgattctcctgcctcagcctcccaagtagctgagatcacaggcactcgccaccacgcccggctaatttttgtatcaaatgcactttttctataatacctgtcaggaagttaaaaagggccagagtgtctggtataaatgggattgataactaacagttgttgaacgctttctatgattctacccagtttgcattaattaatctccattaacctcatttaccttccctaataactatgacaatggttctcaaagtgtggtccctaggcagcagcatcagcagcacccaggaacttgctaaaaaggcaaattttcagcccccaccctagacttcaggaatcaaaaaccctgaggtggggcccaggaatctgtgttttgagaagtccttggtggattctgatgcacgtgcacgtttgagaacaagcagctgaagcatggagaagttacatcagttctgtggtccccaattgttagcagtggagcccagatttgagccccgaccactggcttcggaggccacactctgacgctgtgctacacggccatcttggtgagaaccaacagctgctcacagagcccgggtgctggaggagcagtaaggttaagctgtgggctgcgggcagtgagggcagggtttcctagacggcagctctccctgatttttttttgttttttgttttttttgtttattttttgagatggagtctcactctgtcatccagtctggaatgcagtggcacgatcttggctcactgcaacctctgcttcccaggttcaagcacttcttctgcctcagcctcccaagtagctgggactacaggcgtgtgccaccacacccagctaatttttgtatttttagtagagacggggtttcaccattgttggccaggctggtctcgaactcctgacctcaggtgatgcgcccaactcaccctcccaaagtgctgggattacaggcatgagcccctgtgcctggtctctccctgcattttgaagaaggcagaggacacagcacagagaccaaaataaaggcctagaggcaggaataaacaaaccaggtcgggaggggaggtgacatggggctgcttggctgggatgggaagtccacatgcaggaggaaaggagacgtgtggggggccgggc

SEQ ID NO: 12085 - DNA, 121982 bp, Human
gccgagacgggcagatcacaaggtcaggagatcgagaccatcctggctaagacggtgaaaccgcatctctactaaaaatacaaaaaaaattagccaggcatggtggtgggcacctgcagtcccagctactcgggaggctgaggcaggagaatggcgtgaacccgggaggtggagcttgcagtgagtggagatcgcgccactgcactccagcctgggcgacagagcgaaactccgtcccaaaacaacaacaacaacaacaacaacaacaaacatatatttcgtggagcaagaaatgtctcaaacatagcaagagagttgggatgccaacggaccaaagggaaagcaagcatgacatagccccccactacaagggcttacctattatccaagctttgggagctaggttagaatcccagctctgtcgctaaccaacctgtgtactttagccaagtcactgtacctgtctagacttcggatcgcatgtgtgtctgcccatctcatagggttaccctgaggctaaatgaggtaacaaatgtcatgaacccacaaggtagactcgactctcggtaacagttcgtgtcacccccatctcacactactctccctcttcggaccctgcacccatggattccatccaccgctggccaggagctgagtagaggcaccgagcacgtgaagaggtgaatgggcaaggaaggcttccaggtcaggtagcatttccagtgttccagcctgcaggcatctaccgagcctggcccgaggctggtacccagagatgcttccagtcttccagcagcaacgcactgactgtaagaaaagcctgcttataaaccccctacaggcatttggaagctggtccctggggtcctctacagattcatttcgcccccaaccccatcccctttgtgccaccctcgttattgcactcttccatccggatggcatttagctgggtccgggtctgtcacccgtctgaccaccagctccttgagggcaagaggcgcctgctgccctcagggtccgcgcccagcccgcagctgctcagatccggagacgggaaggtttgttggcgagaacctgactcccgggtcacagttaaggatgcaagagcccggcgccttcccgtagccccggccctgtcattaattaatgctggggctccattcggtgcagcgcagtcccagggatgcaaccgcaacttttgcgcacaataggctctcgatctgtaatccagccaacccaggcctgtagtgtgtaaatgccaactcagcgggagggctctggctgtcgcccagagccgtttctcggctctttcgcggttgccggcgcgctcgggacaggaggaacccgcagcccgcgggagtcagcggagacccgaccagcactatccagccctctgcaccgcccccgcggcgaggtctggaccaagtcgcccctagcaacaacagccgggccggctttctcaggccatgctgattggcgggactccgggtggcggcctgtcgtcacttccggcagccggaggcagcagaggaagccgaggggcggccatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgagggagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaacgtaagtaacctgggcgttgtagttggcggaccttcggggtggcattcgtgctcctcgggcagtgccttgcagtcgggtgttccccccagccgaacgctctggaaatagagggcaggccgtagtcacccaggaggcagccaggtcggaccgtttcctccagaagtctgccgtgtcccgctgttcgcgggcgggtctgcgaagtacatcgattatgccggcagtctagtcggttaataaagcccaggagttgcagcgttacggatcggtgctttgagaggccaggttgccgcgcaatggattgtgcaaatgtgtgtgtcagatcactgcagtggtcagtgcttattttagccgaactctgcttttaacttggtcaggcagttcttgagagactgtcacattaataacatatgttaccggtgctgattaagagtaatcgattgggtcaagtgggcggtctcgttctttaagatggtctggaactaaatttaatcacagtcactaagtgtccactgagggatctttgcggtccccttaggaattccaaaacactagcgcgcagcctttattaaggcagtttcctttccatacaaatcttttttgaaggagttggttaaacattttgaaaagcagatgtatagtgaagctctgctctgccactcactgcctagctgagggacacccgctgggggcttcgctgtcctccttcctaaaaagagattggcttagatgagctcttaggtccctttcagcgctcacaggctatggttttataaaaggaacctttgattttgttcatgtgaaactacaaaatgccaggaacagcattgctagagaatgagaacttgtagtagaaattccattgaagaaacgtttgactctgttcgttttctaactctgttctcctctaacactgggttcaaaagtgtttcaatctagttgttgactatattctgtaaaacatctagtaaataatttgtaaagaaacttcactggcctttcattaaaagtgttatgaggtaattgctggcacgaaatgtcttctcttagggaatgcttccttgctttgagtgttttcatgctttcagtaatgtcctgagatgttgtggcctagtggagttaatgctttcattttgatcttcaaaaatgccgcttgtttgctggatagctgtttgataatttaatccgtaaacgtaaaccatagcctaaagcatccctgtagcatattagtatacaatatttaatgctctgtggccctgagtaagtagaacagtgatgtacctttctccacctgagatagattagaaaattatataaagagtgagtaatagaaactcttagactaggtgagtcagggaactaatttccttatagtccttttaaagaaaccttatttatttatttatttatttatttacttatttattttttgagacagaccgagactgtctcccaggctggagtgcagtggtgcgatcttggctcactgcagcctccacctcccaggctgaagtgattatcatgcctcagcctcccgagtagctgggattactggcgtgcaccaccacgcccggctaatttttgtatttttagtagagacagggtttcaccatgttggccaggctggtctagaactcctggcctcatgtgatccacccgcctcggctccccaaagtgctgagattacaggcatgagccagtgtgcccaactgattagttttgatcattgatcttcactcagagaagcaaaaccttacattgaaccagagtaggagctccatgctttctaaactgaagccaaaaacagtcatagcagatttgtgataatgaaggatttcaaatgggtcttttttctttctttcttttttgagatggagtctggctctgtctcccaggctggagtgccgtggcatgatctcggctcactgcaacctccgcctcccgggttcaagtgattctcctgcctcagcctcctgagtagccaggattacaggcatgtgccaccactcccggctaattttgtatttttagtagagacggggtttctccatgttggtcgtgctggtctcaaactcccgacttcaggtgatcctcccgcgtcagcctcccaaagtgctgggattacaggcgtgagccaccacgcccagccatgtagtgtatttaaaatgaatttttgactttttttaaaaatcaagtttatcacacatcgttgcattaatttaccatgccctgttacatttttaactcttgcattggcatgttctggaaggagctgtgtagctttcacagtgtggagcccttgtgtcagtgttataactcaggtatagtccatattaattacctacattactgcactgctaagtattagacttcctgccaattgagtggtgaatgtacaagaatgaatgggagctctcattctgttgagaaccttttttcttaaagttaggtttgttgagatgtaatgttcatctgttttaagtatacagtttggtgaattttgacaagcgtatagttatgtaaccgctatcacaatcaagatgtagaacacttccattgccagaaaggtcccttatggccctgtatagtcagtgccctctccctttcttagcccctgggtaaccactgatctgctttctgtccctgtagttttgccttttctaggatgctatgtaaatggagtcacagtgtaaataatcttttgtgtcttctttcacttagagtagtgcttttgagatttatttgaatgtgtatcagtatcagtagttcattcctttttattgctgagtaagtatttccttgtttggatgtgccacaattttttttaatccactcaccagtgatggacatttttggctattgtgactagaacagttttcttttagtattctgtaaaaatactttttattgtgcttaccccaggaatcttatttaaattttaagtaattgtatataactgtgataagaatgtcgcttattagatcaagactaagaaaaggcaggccgggtgtggtggctcatacctgtaatcccagcactttgagaggctgaggctggcggatcacgaggtcaggagatcgagaccatcctggctaacatggtgaaaccctgtctctactaaaaatacgaaaaattagccgggcgtggtggcaggcacctgtagtcctagctactcgggaggctgaggcaggagaatggcatgaacctgggaggcagagcttgcagtgagccgagatcgggccaccacattccagcctgggcgacagagccagactccatctcaaaaaaaaaaaaaaattagccaggtgcggtggtgcatgcctgtaattccagctactcaggaggctgacgtgggagaatcacttgaacacaagaggtgaaggttgcagtgagccgatatcatgccactgcactgcagcctgggtgacagagtaagactctgtctccaaaaaaaaaaaaaaaaaaaaaaaaaaaaggcggacaacttgcaacattatcttcatccttgtacactaatttgtttttgtttgtttgatttccaaatattaatgtccacccttagtgaatgggtatataaaagtttactgttggccaggtgcagtggctcacgcctgtaatcccagcactttgggaggccggggcaggtggatcacctgaggtcaggagttcgagaccagcctgaccaagatggcaaaaccctgtctctactaaaaatacaaaaattagccgggtgcggtggcgggcacctgtaatcccagctacttgggaggctgaggctggagaatcgcttgaaccctggagacggagagtgcagtgagctgagatcaagccattgccctccagcctgggcgacagagggatactccgtctcaaaaaaaaaaaaaaaaaaaaaaaggctgggcgcggtggctcacacctgtaatcccagcactctgggaggccgaggcgggcagatcacgaggtcaggagatcgagaccatcctggctaacacggtgaaaccctgtgtctaccaaaaatataaaaaattagccgggcgtggtggcaggtgcctgtagtcccagctactcgggaggctgaggcaggagaatggcgtgatcccgggaggcggagcttgcagtgagccaagatggcgccactgcactccagcctgggcgacagagtgagactccatctcaaaaaaaaagttcactgttgctgcatcgtgttatagctcaaaagaactactcaatctgatccagtgaggttgctgagactcagagaggtgacaaaggctgctagtaatgacagaagaccactaactatttagtagcaaagcctctactgggccccagatctctagcttaggctccacaaggagatgtagttgtacctgtacatagagtatttctaaaactttttttttaagcttgtagatcaggggtgtccaatcttttggcttccccgggccacattggaagaattgtcttgggccacagataaaatacactaacactaacaatagctgataagctttaaaaaaactgcaaaaaaaatctcacagtgttttaacaaagtttatgaatttgtgttgggtcactttcaaagctgtggtgggctgcatgcagccctagggctgtgggttggacaagcttgctgtagattttattttgattttgagacagtatctcgctctgtcacccaggctggagtgcagtggagcaatcacagcttgctgtaaccttgacctcttgggctcaagcaatccttccgactcagcctcctgagtagctgggactacaggcgtgccccaccacatgcatggctaatttttaattttttcgtagagatgagatctccctgtattgcccaaggtggtctctaactcctgggctcaagcaggcctcctgtcccagcctcccaaagcactggaattacaggtgtgagccaccacactcagtcaaaactattttttaaaatattttattataggaaaatttaaaaaaatagaatgttatttatcaatgcttctcagccacagggtgattttgccctctagtggacatttgacaatgtctaaagacatctttggttatcacagctggagaaaggtttggctgaccaggaatgctactaaacattttacagtacataggacagccttccacagcaaagaattacccggcctaaaatgtcagtagtgccagcgttgagaaaccctggtatgtacttagccccccatgtactcaacagcgcagctcagtggccaatcttatttcatttataaatgaagaagcaaatgcagtatcatttcctctctaaagcttttagaagagataaagcctgttttaagaaaaaagcaatacttttatcatattttcttaatatcaaatatgcagtatttaaattttctcacatttctaatttttaaactgttcaaattagaatccagcttgaattcatacattatagttggctgatatgtcaaatatgcttttttttttttttaattgagatggagtcttgctctgtcgcccaggttggagtgcagtggtgcaatctcggctcactgccaacctctgccgcccgggttcaagcgattgtcgtgcgcagcctcccgagtagctgggattacaggctcccgccaccatgcctggctattttttttttttttttttttttttttttagtagagatggggtttcgccatgttggccaggctgttctcaaactcctgacctcaggtgatccgcccgccttggcctcccaaagtgctgggattacaggcgtgagccactgtacctggtcaaaatatgctttttaaaggcaaccaaacagtttgcatttcagtttatgttctatagttatatggagccacggatacatcctttttctatactggcaaaatgagaaacatatttttcacctgaatttcaaaggatatgacacttcgtaagcctggtaatgttattggccaaagtaccagaggcccagggctttcccagttatttaacagttactgatatgtgtgcatcatgtacttattattagttaatgcaaatagtcccccaaatttctgacctctgtgaaactgatgatgctgttgtctagtcagtcatcggttatgtgagactgaattaacctattcagcaagtgtgaatgcctaccgtgtgtatgatactgtgctaggtgctgtagaggccatatacctgggacacatagctttcctgctctttaggatttcctgctccttgcaggacaaagcagcctgagctttatgaaactagtctgtaactctcaaacttaagcaaacattagaatcacctgaagggctttagaaccgtgatcactgggccctacccctagaccttgattttacccgtagaattggaatttctaacaagttgccaggtgatgttgatgctccaggtccggggaccactcttaagaatcactatagcaggaatttctgatgtttatttattaagaaaaaaaaatcactgccttagtgtgcagtgaaggcttgctaactaaactatactccttttagattgtactgtgactatcaaaggaagatttccagaccatttaattgagttttcaggttccatgagtttaaaaaaaactgtttattaaaaattgtggttctggaaaataacaatagttgccatttggtgatcacttaactgtataccagccagcaatactttgtagagtatctcatttaaaatatgtaatatggttttatttaattagctttttttttttttaaatttcctgaggcggagtctcacactgttacctgggctggagtgcagtggcacgatctcgctcgctgcaacctccgcctcccgggttcaagcgattctcctgcctcagcctcccaggtagctaggattacaggcagccgccaccacacccagctaatttttaaattttattttattttttgagacagagtttcactcttgttgcccgggctggagtgcagtggcatgatcttggctcactgcaacctccgcctcctggcttcaagcaattctgcctcagcctcccgagtagctgggattacaggtgcctgttaccatgcccagctgatttttttgtattttcggtagagactgggtttcaccatgttggcaggctgatctggaactcctgacctcatgatcctcccacttccctcctcggcctcccaaagtgctggaattacaggcgtgagccactgtgccccggcttaatcagcttgtcaacttctaagcacaacctgttgaatcaagctgtttgggccttatcagaaaaaagttggcctatagtttcagctactcaggaggctaaggccagaggatcacttgaggccaggagttccagtcgacctggacaacatggtgaaactatgtatcttaagaaagaaaaaaaaaagttgatctctgaagaattcatgaaaatatttagtcagttttcagggaaagatcttatagacttcaatttgagcatccttatcttatgtatgtaaatgaggtaaaggttgaaatttgcagtaaatagaattttggtcatttaagttatgtagctcatgatatatacattgtataactatttagacttacatggtgcatgatttacattgtaattacatagaggcttatacagtctaataaaaattaatattaactatttgattgcaaagaggattgttctgcattttattactttttttttttttttgagacagagtttcactcttgttgccaggctggagtgcaatctcgtgaccttggctcactgcaacctccgcctgccagcctaagtagctgggattacaggcacacaccaccatgcccagctaattttttgtatttttagtagggatggggtttcaccatgttagccaggctggtctcaaactcctcaccttgggtgatccgcctgccttggcctcccaaagtgctgggattacaggcttgagccactgcgctcggcctgcattttattattctaagatatagccaaattttatgcctggaattttttcctgggctggaacaaattcctagtaagagtcagggaatattccgtgacttgtggctttggttaaaaaagaaaaaggagtcagggaatgcagtaccctctgatcaccactgggaggactaaagcagaaaattcatttgtctcatatccattttcaaatttcaaattaaacatgaaggagaaaataaatctcttacctgggaagctttaatgtcctgtctcacacaagaagttaaaggttgtgcttggagttggtctgcaaaagtaataaggaatttgtactcacccgtctgcacctgcttgtacagaacaattggaagggcagaagttggctttgaaagaaaaggcctttttttggaggtgggaggggcatccaattttgtcttcagccgagagttcgctagcactacactctagccactcaagctgctcaactatggttggtcttgtgtacttctgtgtgcactagataagacattgtttctgtgggttatgtgggaccttgaagttcagtgttgaagctcaaacaaagcaggtgttttttctgtatttcttgttgacaggcatttgctttttgttggacctaaatattgtggggtttgtgtatggacatttgacacaaaaatctgtattggtagaatttaatataaaatcagagaagttgaattcacaggttttgttcatagaattttacataactctagtcttttttctttttttgtgatggagtcttgctctgttgcccaggctggagtgcagtggcatgatcttggctcactgcaacctctgcctcctgggttcaagtgattgtcctgcctcagcctcccgagtagctgggattacaggcacccgccaccacgcctggctaatttttgtatttttagtagaaacggggtttcaccatggccaggctggtcttgaactcctgacctcaagtgatccacctgcctcggcctcccaaagtgctaggattataggcatgagccacagcgcctggccacaatcttacactactttcctgaagggatgtgtgatggaaagagtctgggcttgaaagtggaagacaaaaatgagagtctaagactgatcgagataaagattctgaagaggtagaatggacctcataagatggagcaaaaaagaaggaacaacatataaaaggagaaattagaatttagagttatagactggaatttgaaactagtcttgagatttaactgtggacaaattcactcggctgtgcctcatggtttttttttttttaaatcaaaagagaataacatcatctcaagttgtgtcttggtttttttgtttgtttacttagatttttatgacttcactttctcaatttcctctgtggccagattcatcaggcattcagtcactttcatctctgtcaggctggccttgtgttctgtctgtctgttctgctgcatagttgtcatcctgagatctcccttcacccatatcctagggattccctttgcctttcctgttcgatccattttcttccccttggttcactcccaggtttcattgcagcagttcctccagtgattttctgagaaagttgctcagaggtaaatttttaaaatcctttcatatctgcaaacatctttattctgttctcatacttgattgatattttggctgcatatagaattctagactgaatgccctttttcctcagaattttgttttctgtcttatatagcatctgacactccgatttggagagagagaatgctattttgagtcttgcttatttttctgtttatttaaggctgattggaagttttgtgcatttggatggatcttgaatacaacagtgggacacactgttatttctttgtggtgctcttgataccaatatatttagtcttatcacttggcctaggcaagcacggaatgcccatgttccagggagctgagtcgggagagggcagaaggaaagatctgtggctttctgctttctctgcttgttttcagtgtccctgccctcagttgtgccctgtgtccccaagcccagagactttccattttgccctttctaaagaacctccagttttttgcctgagtgggagaggagacccagggggtctgttatttaacagactgatagatcttcttgtttcaggcttacttcactcacacttctagaggtacttgtactaccagttcctgaaccttttgagagttctataatacaaatcaggattttccaatatctccatagctggcttaggattaatctttcttatatgtgttaagtcattttccttctttttttagtttctgaaagtatatctgttaccacttttattttctttgtcttgtggcttttttccttatgccttatatttttttcctttactttcatattaatggagtttggagagggaggggaagtaaatgcagccatgatttataaccagacttggattaggtgtttacatatgtcaatacatgtctttaaaatttagctagtacttgttattataaataacaaactaagattgataggcttcttgaaaaattggcggtaaatttggctaatggtgggttgttgtagtagagtagcgtttccccttttcacccaagctttgttacctcttcttgggtggtgcctggcctgagatgtccttcatctctcataagaactctcctacttgccctttgaggactccatcccttcacatcttggggtaccttttttccttcatctcacccaaatgtgatcatgtcctttgggtgcctagagctgcattatccagcacagtagcaactagccacatgtggggctaccaagcacttgaaacgtggttagtttgaatttaggtgttctgtaagtataaaagataaaccagttcaaagacagtatttcaaaaataggatataaagcctttttatattatgcattgaaatattggggggtatattgagttaaataaaatggtatttaatttaacgtattaaatatgtttctttttacattttttaatggagctactagaaaattgaaaattacatatgtatgtcacattatacacctattggacagcattagagtattcactctgattttctcttggggcaggaattgccccttgtttcagttgctattcccccgttagcaccccgtgtatatcatgagtgccttgaaggtttgacaccacacttttctgtttcttttattccctgctaatgcctaccatatagttgactagccgaaagttactgaataaacattttttttttttttttttgagatgaagtctcactctgtcacccagactggagtgcagtggtgcgatctcggctcaccgcaacctccgcctcccaggttcaaacgattctcctgcctcagccttctgagtagctgggactacaggcacccgccaccatgcctggctaatttttttatttttagtagagatggggtttcaccatattggccaggctggtctcgaactcctgaccttgtgatcctcctgcctcagcctcctaaagtgctgggattacaggcgtgagctaccgcacctggcctgaatcaacatttttttagccacaacttgtgccttacaagttttttattctaaggattagacaagtaaattatttttcaccgtattacattagttcacctactataccagtaacaattattttattcaaaagtgaaacagattttactatatttatgggacaataacagttcccccttcctattcatattcttagatgctttctcataaattcagctgtgaagagtcacattatctttgatccatgtgagactatcttcttgttttatctactcctgttagtctccatatgtcattactcttaccctccaccccacgttactgttttaatgtgtttagtatgtgtatgtgttcttacatagtttattttggtatgtttggtactttatgtaaatattacatatgtcttatctgtgcgcttaatatattgcatctaactgctgaatagcagtgagatgtatgcatctaccacattttaccagtctgctcgccagaggtgcacatgttaattttctccaactctgtcaccacaaaaaaaatgcttcaacatcttcatgcatgtccccttatggagcaatgtaagagtttctttgggatatatagcttggaatggacttgatgggtcacaggaaatgtcagattgttcttctagatggctgcttccatcaatagtgcaccacagtttttgtattcccgtttctctgccaacatttcagagctttctgccttttccctatctaacaggcctaaggtgatactacattgtggttttaacttgtatttctctctgatttttagaatctctttatacattccttggctttgggtgcattcttgttttttgcgggggttggtgatttttatcaaatcaaggacagacatcccattctaatcctagtttgctataggaattttgtgggggctttttggtagagacagggtcttgctatgtttgcccaggcgggtctcaaacttccgggtttaagcaagcctcttgcctcagcctctgaaggtgctgggattacaagcatgagtcaccatgcctggccaagagtttttaaattataaattgttcaatcttatcaaatcctttttctatgttgaatgaaataattgcctagctgctttcaaaagtgaaacgtgactttgtgaatatttctaaagtacaaaatacttggaggacagccatttattgtcacaacttggctttgtagtttgtttttgtttttgttttttaacatttggaaaccatacctatgtgttaagtaagtggcttgtgatttaaggaatagaatgcatgtaagggcacacttcttttgttttacagaagggatcaagttctgttcaggaagatttgaaacatagtgtaaagttgttgctgttttaaacttgtaaacctgattcttctcatgtgggaggtacgtaagtaggcctctcagatttcaggttggttctctgcctggtagatacaagggcaaaactattctggaaccatattgatgttaaaaaaattttttacggacttcctgccggcaaggatttttttaaaagattttttaaatgtgtctaagaaatgttttaatttgtcttctgattatacagtgatttacaattcatgcttcttttatatgtgggcaaaattaagaactaatatgtaaaacaaaatggagcacattcccatttttcttattgctttgagttgatatggcccctatgtcagtagtgctttggctgaacgtcacaaagacctaacacagtgccctaaacaaatagggggtttgtttttctccaaaaagaaatttggggtagggtgcggtggctcacacctgtaatcccagcactttgggaggccaaggcgggtggatcacgaggtcaggagatcgagaccacggtgaaacctcgtctctactaaaaatacgaaaaaaattagccgggcacggtggcgggtacctgtagtcccagctactcgggaggctgaggccagagaatggcgtgaacccgggaggcggagcttgcagtgaatcgagatggcgccactgcactccagcctggggcaacagagtgagactccatctcaaaaaaaaaaaaagaaaaaaaaaaaaagaaaggaatttggaggtatgcagcgtctagctttggatcagcagttcagtaatattggagttggtggtattttaaggtagttttgtcttttctgtcatgtttgagaccctgtagctacaggataatgttttacagttacagctacatggttgcattcaaggaaggaggaaggaactgtactggcaactctgtccttacccccccaccctccttttttttttgagatgaagtttctgtcactcaggctggagtgcagtggcggaatctcagctcactgcaactgtcgcctcccttgttcaagcgattctcatgcctcagtcttctgagtagctgggattacaggcatgtgccaccatgcctggctaatttttgtacttttagtagagatggggtttcaccatgttggccaggcaggtctcaaactcctgacctcaggtgatctgctagccttggcctcccaaagtgctgggattacaggtgtgagccacagtgcccggcctccccttttatgataaacaaaggcattaccaacccctaccccctactacattgccacctagtagactttaactaatgagaactggccagaactaagccagatggctatctctagctgcagagaagtttgggaaaacaagtatttggccaatgtggtctccctaaacacgtgttcaacttcttgaagaaggaaatctcatgtctttggctgtattcagcatttttcagtagcagttacatattctagttttcatggtggatgaagtggtaccagcttagttccacaggagggagaagaatcaggactcatttaatccataagaattaaactcagcagcttttgagtacccattatgtgcatagtctgccatgaaatattataaagtagtccaggtatggtggcttacacctgtaatatcagcactttgggagaataagacaggaggattgcttgaggccagagtttgagatcagcctgggcaacatagtgagatcctatctctacaaaaaattaaaacatcagccatgtgtggtgtacgcacctgtagtaccagctactaaggaggctgaggtgggatgatcccttgagtccaggagttcgaggctgcagtgaggtatgatcgatcacactactgtactccagcctgggcaacagaacgagaccctgtctcaaaaaaaaaaaaaaaaaaaaagttatcaaagaattatataacattttgtgtgtgtgtgtgtgtgtgtgtgtgtgtgtgtgtgtgtgtgtgtgtgcaggttgtttattggctccttaggaagaaaaaaatacgtgtatgaaataattgattaacagtacaagaactcataattatttgtttaaatgtttaatgttggtactgagtgctgtggcataggaatagggaactttttcttagggtcggtgatggattcttgggaaaataaaatgaagggcaaatggaagcaaaagacaatttaatttgcttctgttttaagggaacttttaaaaagttaattcttaaattttttaatttaaggacttcgtcaagaaacatcgaattaaatatattgagtttaaccctaacaagcatcagatctttcagtctgctgtatgaggaaatacaagtttctttctgctttctattatgattgttgatttgcatgagcgtgttttaggttaggctgtgttatgctgtggtaatacataccaccaacatcctcatgatttaacacaataaaaaacttctgctcacaccaagtctgcttgagggctcattggctccgtggaaactgatctccatgtccaggccagtttggtcttgtggccgtccgttttagggcagtgcttagggtcaggagagcaaaacacagggctggagagttaagcacaggcaactaaatgcttcagcatgggaatggcattcattttcactcacaggatgtgttcagcttagtcacatggctgtctatgcctaacctcaagggaagggagtgcagtcctccaggaactcagatgtaaaaaagccagtatgatggatatagtattgtctacaaaaaaaagtagcataatagagttagatacaagcaaagtactctaggatcccagtaaggagaagtaagaaattctgatgagatgcagggagagccttagaagggttcatgaagatggtgacagatgatacaaactcagtagaatgagcaggtttttcttagatttgaagagaagaaaggacattcaaactaagggaacaacactgactgagtcagagctagactcaaagctagagtctactggctgatgtcgtgggagaggaagaagagatgagcgggccttgaattcgtttaacattcagcaaaaatgtattgcatgtctaccatgtgttaggcactgtttcaggtttggggaatatctgataatgaacaaaacacaaaaagcctgtccttgtgaaggttacatgctagtggaagaagcgctaaggagttagtattttattataagcacactggtgagtaagcaaagataggaacattggatgcctgtgaatcttaagattttcctggccgagcgcggtggctcatgcctgtaatcccagcactttgggaggctgaggtgggtagatcacttaaggtcaggagttcgagactagcctggccaacatagtgaaaccctgtctctactaaaaatacaaaaattagccgggtatggtggcgcgcacctgagtcccagctactcatgaggctgaggcaggagaattgcttcaacctgggaggcggaggttgcagtgagctgagattgcgccactgcactccagctgacagagtgagactccatctcaaaaaaaaaaaaggatttttctaagatttctattttacattaaatagaaggcagttggtttgcatgaaaattattatttcatcaatttgactgcctcattatagaaaacacatattgaagtcaaataaaacgtagagatgaatctctgaagttaaaatatgttatttgggacgcaagaattgcaatttggggcacacagaccacagggtggtcttcagtatgtatgaagaacaaagtaaaggatggaggttttataaagagaagtgttacatattttgaaagacaggtcattggcactagtaaagttttggggaggtggcaagccctgattggtgagtgacagtggtgggtaatactggtcttagagtcagcaacaagttgtttcagtagccattagataaactggtttcaggttacaataggcagtttcagcagccaggcttacagagaattataatcttggagcaatgttacatccctccccctcccctggccccccaccccatccctgcccctcagctctgatttagttgagtacgaataggatgacccaattagtatgatcagctttcacacatgaaggttgaatttatgaaacatgtaaatttgaaaatacatgtttacattgcaaaaagcttttttaacaaaaattttggccagtagtataaattcagtgaatatgttttcattgcacagatagtaaaaccacttgatacatacctcatggggatatggactgctttatgcgctgctttttaccacaccttaaatagtgcctggttgtgtgtgtgtgtgtgtgtgtgtgtgtgtgtgtgtgtgtgtgtaactcagtaaatattcaatgaatgaatgaagaaattcagaagataaaaaagagaaatttcccttatttttaaccttctgaacactatagtggttagcatttatatcatttattcagccattctaatatttattgagtagcagttttgtaccaactgctgttctaagatataaggaataataaattcctgttactgttttcatgaaacttaaattctagtgtaattaaaatcatgtagaaataaacataaacatgatcacccagcttcttttaaaactagactgcagttgatgtaataatttgcattacaacagcatgcatcttgtgcacaacaaaatctacctgtttttgtattaaagccttagtgtcaaagctttattatcattttagtcttttatcaactccatatttataaatggtctattttcccaaagttctaatatggaaatcagaatcatttttgttagaggaacaatgtttacaagttgcctagatttgcagtgaggtcataaaaagcctgtttaatctaaaatagacatttgcaataaaaacagaaattgttgttgagatgccatattatgtgataactgagtaaaacagacaagagcctatcccctaacctggtatgtgaatgtgaaaatattagagaaataatgaagaagtagatggagactaatgaggaaattctgaaaaggacatcttttgagaaattcagaggtagatggcgcaagttttaaagcttactttcactttaaaacacctgagtttcatttcctttgatttgagtaaattacaaagcagtttattagttaaatcaggcttgttttgatttataggtatatagagaaagacaggacattttcctggacagaaagttggaaaagagaaacgtgtaaagggggtggaaagtggctgtgagtgcatgtggaatgagaagcctcccttgggcaggagttaacagccacaatggggaaaggattgggacatctaatcctttgagtgtgtgtgggggccaagggagcagtagtagcaggatgcctgcgcatacagccatgtacacagtgtgtacacagaagtgtaattcttgggcctgaatatttcatagggtagagacatattgagtactttattaagtaagcatattgagtactttattcatctatacaacaagggtcgtctattaagggccacacagtctagctgtttctgtaaagcacattgttttgaattactgttagcagtgtagtatagaaggaaatcgggaatccagattctctatggatttccccctgaacagttatgtggctgtatccttatctagtgaatggtgacattagcttttcccctgctgcacgggctgtagtgaggctcaggtgtgcaggtgcacttactaacatatggaaaagttaagcactgtataaccagaaggtagcccttttactcctattttatatgacagccacgtatgcaaaatatctaatttcttcctgaacactcaattgaacttcaacacttcgtatttttcgtctcagaatttttattttcctcaaatttatattatgtggttaaattcctttgaagtgctagatactttaagattaaaattaaagtaggaatgttttttcttcaattagaagctcttagaacttggcaagtactctgtgttctctcatttccttatctttgtgtatgctgtattgcagcacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggtaaataccagttatgcttatttctgttatgacagttgctctgtttatttccatgtaagagaaagaaaagaatatagatataggccttatttcttttttttaagatggagtctcgctccgtcacccaggctggagtgcagtggcatgatctcagctcactgcaaactctgcctcccgggttcacaccattctcctgcctcagcctcccgagtagctggcagtacaggtgcccgccaccacacccagctaattttttgtagagacagggtttcaccgtgttagccaggatggtctcgatctcctgaccttgtgatccgcccgtctcggcctcccaaagtgctgggattacaggcgtgagccatagcgcctgtaatatatagctactatgtattacatgtattacatgtcaagttctaaccacataatataaatttgtaatacatagctgggattacaggcgcacaccaccacaccacgctaatttttttttttttttgtatttttgtatttttgtagagacggggtttcaccatgttggtcaggctggtctcgaactcctgacctcgtgatccacctgccttggcctcccaaagtgctgggattacaggcatgagccaccgtgcccaacctattttattttcaagacagggccttgccctgtcacccgagctggagtgcagtggctcaatcatggctcactatagcctcaacctcctggggtcaggcagttctcccacctcagcctctcgagtagctgagactacaggcatgcactgccacacccggctaatgtttaaaaaatttttttgtagagacagggttctcaccgtgttgcccaggctggtcttgaactcctgtgttcaagcagtcctcctgcctcaacctcccagagtgttgggattacaggcatgagccaccatgcctcactaattaagctttttctttttttgggggttaggggggtgtcgggggttgggacggagtcttgccctgtagcccaggcctggagtgaagtggcatggtctcggctctctgcaacctccgcctcccaggttcaagcgtttctcttgcctcagcctcctgagtagctgagattacaggcgcacaccaccacgcctggctaattatttttttttttttttgtatttttagtagaggtggggtttcaccatgttagtcaggctggtttcaaactcctgacctcaggtgatctgcccgcctcagcctcccaaagtgctgggattataggcatgagccaccacgcccagcctaattaagctttctcaaaagaacatgaaacatatattaggtgtctgggagttttttgttttgtttttgtttttgtttattttctgaggcagagtctcactctgtcacccaggctggagtgcagtggtgcaatctcggctcactgcaagctccgccttctgggttcaagccattctcctgcctcagcctcctgagtagctgggattataggcatgagccaccacgcccagcctaattaagctttctcaaaagaacatgaaacatatattaggtgtttgggagttttttgttttgtttttgtttttgttttttttatgaggcagagtctcactctgtcacccaggctggagtgcagtggtgcaatctcggctcactgcaagctccgccttctgggttcacgccattctcctgcctcagcctcccgagtagctgggactacaggcatccaccactgcacccggctaattttttgtatttttagtagagacggggtttcactgtgttagccaggatggtctcgatctcatctcgtgatccgcctgcctcagcctcccacagtgctgggattacaggcgtgagccaccacgcctggcccatctgggagttcttttgctttcccattactttaaacgttggaaatatcatagagtgtttaaatagtctttacctttaaaaataggtaatgttttgttctttttcagtagcaaatgtctgctaccacagtaaaaattgtctttaacttcaggtatacacttatgtgtatgagctcatgttacttgctaatcaatattattgtcaatatttacagatttatcttcaagaagtttcttaatctctctacttttctcatagcgtatgtttaatcggttattgtgtaggaaggcacatactttcctaacctttgtgaaatggctttctgctcagccccgttcctattaatcaaaaatacatgcattaaaaccacaaaactaactccctcctcttgttatactcatatggtacagagcctgttttgcctctttttttttttttttttttttttttgagacggagtctagctctgtcgccaggctggagtgcagtggtgtgatctcagctccctgtaacctccgcctcctgggttcaagcaattctcctgcctcagcctcctgagtagctgggactataggcgtgcgccaccatgcccggctaatttttgtatttttagtagagatggggtttcaccatgttggccaggatggtctcaatctcttgacctggtgatctgcccgcctcaacctcccaaaatgctgggattgcaggtgtaagccagcgtgcccaacctttgatgtagtttcttgcatttaggtctttgcgcctgcttttccctgtacctgaaatactctttactcttctgtttagggaacatttctgagaagtaatcattgacaaatcccctttccccaggcatgggattccataaaaatcccgatactccccttatatggcacaatttacattgtattggaattgctcgtttgtctgtctccttctctagtttgtaggctatctccagtctgtaggggaagatgacagaacttaacacagtgcttggaacctgttaggtacttaataaatatttgctaaatgaatgcaataatactgttttttggcgggggggaggtggtgttggcaacagagtctcactgttgcccaggctggagtgcagtggcgtgatctcagctcactgcaacctcccgcctcctgggttcaagcgattctcctgccttagcctcccgagtagctgggattacaggcacacgccaccgcacccagcgaattttttgtatttttagtagagagggggtttcaccatgttggccaggctggtctcgaactcctgatgtcaggtgatccacccacctcagcctcccagagtgctgggattacaggcgtgagccaccatgcctggcctgaatgtagtaatacttttgaaggaagcttttaaaacaaatgctctccctgtgcgagacccttctgatagatgtgccaagactgtgacacatatggcgtagcattcatgcctgcagcccaccaggcctggggctgcaagagcatgagccctgggtctgtcatctgtcagcatgcatcctctgtttgcagcagtgtgccctgtaaatattttcatttcctgtgtgtgcggagacttggaaaaggttgggaagcactggactgtgctaactggaattttaaaagactgttgccagaaatttgccttttgacaattcattaattttagtgataaaattcttgtggatttttagttaagactccttgttgctgagctgccttatagactgcttttggaatctgtaaacagcttgtgtgggcggagctgtccttgttgtccttgattaaagctttcttgagataaggaacggtgagacctctgagtttcttagttcccaccagttccaggtggctacttgccagcttcctcatgtgggcagagatggtgggccaagagagcgttgagacagacgaacctcttccatttaccttacctgatttacattatctagagtctggcctgtggtgtttacttctagtaggttctttctctagaaatgcttgaatatgactagcagagtggtttaatttaaaaactttctcagtttctcagtttttttaaaactttgaacaagttctcactcgtaagtgggagttgaacaatgagaacacatgggacacaggggaggggaacatcacacaccagggcctgtcggggtgaggggcaaggggagggatagcattaggagaaacacctaatgtagctgatgggtcgatgggcgcagcaaaccaccatggcacatgtatacctgtttaacctgcacgttctgcacatgtatcccagaacttaaagtaaaaaaaaaaaaaaaaaaaaaaaaggaaaaactttgaacaaaatcattttactcttgtggggttttttttgcctattgtagatatgacatataaaatgtaaacattatagaaatatagaaattcattatgtagaaagtaagttccttgaaatttgtctcttcaaagacaatcactttcagcagtttggtgtatattcccagagttttttatatagacattaacttttaaaaaattttaacagaaagggactcatggaacatgatgacagtttttttacttagtaatgtaccttgaccatgtctgggtcttagtactcatagatctgacatattagtctaaaggcagcatagtcttcctggctatggtggtaccatagtttatttcctatcagtgggcattagggttgtttctaaatttttgttgttacaaacagatctgcagtggacattctttagcattgcgtgtccttgttaagtgtttctgtaggataattcctagaaatggaagtcctgggtgaaagtggatgactatttgacattgtaatagatactactaaattggttttgaataaaaagtgatgtacctactttattattctaccaaaatggaatagagtgttcattttcgtacatgcttctacactgtagataatttttgtctatctgaaggtctcagtctgtttttgctgctgtaacacaataccagggactaggtaatttataaagataagaaatttatttcttacaattgtggaggctgggaagtccaagatccaggggctgcatctggccagggccttcttgatacatgaagggcgtgatggaagggcaaagagtggggaaggaagggaagaggaggagaaaggaagaaaagagggcagagcccttgcaatctgattgcctctccagggccccatgccttagtactgctgcaacagcaattacgtttcaccatgagtttgggaggggacattcattcaaaccatagcacgtatggacaaaaaaagggtgtagaaaaaaccagaagttgctttttcccttttcactacttagatttatgatctttttatatatttttgtcattcataatttctttttgaggcaagttccctggccacccgcagtagctcatgcctgtattcatagcgctttgggaggccaaggcaaggaggatcacttgagcccaggagtacaagactgcattgtgctatgattgtaccgctgtactccagccggggcaacagaggacactctctaaaataaataaaaataaaacaagtttcctgtttatatcctttattcatttttctttttttttaatcttagtgatttaaaccctttatgtttcagtcatctgtctgatgtgtctgttaatgtaggttatgaatatctttccctagattactccttttaactgtttatgatgtctttcttgttttagggaagtttttaagtatttatgtggcaaaatcatttaatctttttctttattacatttgggtttcatgtcttcttgaagatttgtcccgtgacttaaaaaacagttctataggccgggtgcagtggctcacgcctgtaatcccagcactttgggaggccgaggtgggtggatcacaaggtcaggagatcgagaccatcctggataacacggtgaaaccctgtctctactaaaaatacaaaaaattagctgggcatggtggcgggcgcctgtagccccagctgttcaggaggctaaggcgggagaatggcatgaacccgggagacggagcttgcagtgagctgagactgcatcactgcactgcagcctgggtgacagagtgagactccgtctcgaaaaaacaaacaaacaaacaaaaaaccagttttgtattttcttctaatactcctcctatggctcacattttaacgtttaattcatgtggtatgtatttgggaagattagtattaggtgtagggatctgactttttttttccacttggattacaattgtcccagaaccatcagttctctcccaacaattgaagatacctgcgttaacacataataaattctcatatgtgtcctgttatttctccagtctgtttatttggtcctatacccataccgtggtgtttttattactgcagctgtggattgtatgttttaggtcaagttcccctcctgatgattcttttttttttctctctctctttttttggtgagatggagtctcgctctgtcgctaggctggagtgcagtggcgggatctcggctaactgcaacctccacctcccgggtttaagcaattcgcctgcctcagcctcctgagtaagtgggattacaggtgtgtgccaccacgcccagctaatttttgtatttttagtagagaggggatttcatcatgttggccaggatggtctcgatctcttgaacccatgaactgcccacctcagcctcctaaagtgctgggattacaggtgtgagccaccacgcccggccaatgactcttatttttcaaaattttcatagcttttttttttttttggtcatttactcttccacatgaattttagaattaagttgccattttctaaaaacagagcatgaaattttgattagattagttttcatgggattagttggttttttgttttttgttttttttactagtagcagtagaatcttttcaaatatgccttaatataggcgctggggcttgcccgtggtgctcttgatatataaggcccggacattctgccagttttttctcgagcagtgacaccaagaagttaacagccaggtgaatgttatgcacaagctcatcgtctgtcatcttcacgtggccaacagccacagccaaacataacatgttcatatgaaacttgattgtggacttcgcctcatccactttggccaccgtgttttcatcgtgtgtgagcagggaagggaactttactgcctttgttaggcctatgccgaggattcgtgggatttgctttatcagagactctgaaggcaaaaatgcatcatacttcttggccagcttcttgaccagattcttattcttgagtttttttggcacctcagtgtccacttggggggatatccgtggccttggtctcgccacagtgctgctgttcccccaggacccacacttgggacagggagtggacttaagcctgacggtgcccgagaagcgcttgtccttctgggggtcatagttcttcaagctgatctgcaactccaccatcttcaggaacttggggcactttcactggttcccgtgcaggacttcctgcaccgcctcatccagggtgtcgtgagagactttgctgcttatgggttctcatgccacgctaaccagaaaagagggtttagttggttttataaattattaatagtttgggaggaaattgatattttaatgacgccaagtctttctttcttttttttctttcttttttttttttgagacggaatttcgctcttgttgcccaggctagagtgcagtggcgtgatctcagctcaccacaacctccgcctcctgggttcaagcaattctcccacctcagcctcccgagtagctgggattacaggcatgcaccaccatgcccggctaatttttgtatttttagtagagacgggtttctccatgttggtcagactggtctcaaactcccaacctcaggtgatccacccgcctcggcctcccaaagtgctgggattaccagtgtaagccaccacatccggctaatgccaaatgtttctattcaggaatgtgcatgtgtctcaaatttgttttcaggttttgtaacttttttcatctatgttttatataatgcttgttaaattcatttcaagctattttataatttttgttgctaatgtaaatggaacttttttttcctcaagaaggcaataatcatataacttcttgcatttgggaaacttttgatctctcatttggaatgtcgaaaattaagtttatattgttttttaatagcatgctttttttttttttttgagacagagtctggctctgtcgcccaggctggagtgcagcgcgatctcggctcactgcaagctccaccttttggactcaagcaacctcccacttcagcctccccagtagctgggaccacaagcacacagtaccgcacctggcttattttattttattttattttatttatttattttattttattttatttttggtagagatggagtttcaccatattgcccaggctggtcttgaactcctgagcttaagcagtccgcctgcctcggcctcccaaagtgctgagattacaggcgtgagccaccacgcctggtcagttgtctttttttgagaatgtcaaataaaatgggatcatatggtatgtaaccttttgaaactggcttcttctcactcagcatcatgtctttgagattgattcaggctgttgcatatattgacagtttgttcctttttgttgctgagaagtattctgttgtatggctgtgctacagttggtattagctcccccactgaaggacatttgaatagtttccagtgtttggcaattatgaatagaactcctgtacaggtttttctgtgaacataagttttaatttctctaggagtgacattactggatcgtgtggtaaagaattaagtgaattgttaactagaaaactgattttatataacagtataatattcctagtagaaagaaacctaaagcctctggtctggtctgtgaattggtgtatttttattacttagtacttttcttttctttctttttttttttttttaaagatggacttttgctcttgttgcccaggctggagtgcaatggctcaatctcagctcaccgcaacctccacctcccaggttcaagcgattcccctgcctcagcctccctagtagctgggattacaggcatgtgccaccatgcccagctaattttgtatttttagtaaagacagagtttctccatgttggtcaggctggtcttgaactcccgacctcagatgatccgcccgccttggcctccccaggtgctgggattacaggcatgagccaccacacccagctacttagtacttttctcagctaagatctttatttttgtcagcgttctcttgccctgtgatgggaacgtgatgtatcttgcctattgaagaactaaaacctctgaagaaaacccagagggttgtgggaagagtggcattgatgatttggggacttaatttgttctgagtcagtataagttaaaggcttattgtgtattatgttgagagttttaactgctatccttggggtaagaacagagatgtagaattatatcgtgaaaagaattttctgaaagaagggagtagggacaatctatatcatgcatttaagtcacaaggatgtcgtgaacataaaagatactcacgaaggccgggcatggtggctcatgcctgtaattccagcactttaggaggccaaggtgggcagatcacaaggtcaagagatcgagacctgaggtcaggagtttgggaccagcctggccaacacggcaaaatcccatctctactaaaaatacaaaaaatagccggggatggtggtgtgcgcctgtagtcccagctactcgggaggctgaggcaggagaatcacttgaacccgggaggcggaggttgcagtgagccaagatcatgccagtacactccagcctggcaacagagtaagaccttgtctcaaaaaaaaaaaaaaaaaaaaaaaaagatactcatgaaaaactatatgttcgttggaagaaagttgttttaatttaacaaacatgttggaataagaattataaacaagatacattaatatgtacactctgaagaccattttaaatcaagcctttaaatagcctagttatggtgtaagttcagtttagatgagacttcccacaggatgaccatgaaccaatcagaaatggatatcaaaatgctcattttatatatttttaaaatacatgtaccagttgtgaaattcatctgatttagctcttaaatgaaaatgctacccattatccatattgtcctggaagcatctatcccatatttactatgaatctggggatgttagttgcatctgctgtcttgcttttgaccaacttttcatagcttatggttattttggtgtgaaatattgcctgttttacaccacagttttctttcaagttcattattttccccccactaattttcatagcctcccagagacctttcccctcacacgaactacagaactcacttgtttcagtcatttgtactttattggagttatttattgtttaaaaattattttcctaaagtaatgcatgcacatagcttaacaagtcaaatatactaaaaagttctaatgacaatcagaagtttcttttcttatccctctttttcctcagcattattactcaaaggccccaacttttttaagctctttcttctgttactccaatagctttctccaaatttatcattttaaacatcattgacttccacttcccacttccatatctacatttctttccctagcttttctattgcagtgatatatttggcttatttacttaaattacgactgtgtaagtattgttgagctttggctatgatcatttattttcttatataattgtaaagctttgtctaaaattaatagttgtttctttttctataaactcttaggttttatgtgttactgctaattggccaaaatgttctagcttatctttcaaatattttgcagtactcacacatataatataatgtattagctcaagagagaatcggtgagtataaattagagacagcaaggtagctctttctaggcacagataagtgggatggtagctacagggagacattaggccaaggtattttttagaagatggacaaaatatcaacatatttctctactaatggggataatctcatagaaaggaggaaattggtgctgtcgaagagattttggaataggtgaggggatggtggaggcattggtctttggataacatggacagttcttccatagaaataggaggaaagcaagccaggcgtggtggatcacgcctgtaatccctgcacttcgggaggccgaagcgagtggatcacctgatatcaggagttcgagaccagcctggccaacatggtgaaacctcatctctactaaaaatacaaaaaattatctgggcatggtggcgtgcccctgtaatcccagctactcaggaagctgaggcaggcgaattgcttgaacccaggaggcagaggttgtggtgagccgagatcgcaccactgcagtccagcctgggcaacaagagcaaaactctgtctcaaaaaataaagaaagaaaataaagtaaagaaataggaggaaagcagagggtgccggcatcagtgcaggtgaggggatccttatggtagtaggagcttgtagaaattttctgagtgcaaactgttttttcagtaaaatggaaagcaaactgatctgctacgatgaggagatgtattagagatgtgaggaggttaaaataattgccagataagcaggagagtgaatggactagagaaatgtaatagaattgccaggcagccttaaggcttccctgaggttggtgaccaaggatttaaagtgggaagagtcagcatggcgttgtgctactctccagccacattcagttgcccagctgcaggcatggcatttgcagagattggggttttgtcacattagtatagtgaaaggacaaaggagcattgttatacaacaccccagggagtgatcacaatgaaattagtgatataattaggaactaagaacttgaggaggaagactgaccctatgaaggtgtggggtcagtgaattacagatcctggtaagttccaacagttattagagtactagattgagtgagcaggaaggtagaagaagttagttaaagaatgggaagctcaaacttggatcatgaaaggttttcagatattgggaatgtcaaagactggagtataaccatgtaagtagcttaagtatgtaatattttttttctttctggaagtttatccttggtttttagaaattagccattgaggtgccaagggttagtcttcattcattgttcttggtgctcattggacccttttaatatagaggtttttgtctttcagttctggaaaattgtctcttttttaacttaaaaatcttcattctggaatccttaagcagagactggagtgcttgaaaagagcctcaaaatctatcttctatctctatgtttttactttctgggagatatttttaacttcatcttccattctttctgttaaaaatgtgtgtgtgggccgggcacggtgactcatgcctgtaatctcagcacttggggaggctaaggcagaagtgtcacttgaggtcaggagtttgagaccagcctggtcaacatggtgaaaccctgcctctactaaaaatccaaaaaaattagctgggcgtggtggcgcgcacctgtaatcccagctactcaggaggctgaggcaggaaaatctcttgaacccgggaggcagaggttgcagtgagccgagatcgcgccactgcactccagcctgggtgacagagcaaaactctgtctcaaaagaaagaaagctgtgtgtgtgtctcctcttctctccccagctcactctttgatcattttcatctgtttgttgttactgtctttacagcatctagccctggtattatgaatgttgtttcttctgctgactccctgagaatagtaaaggctttttttttttttttttttttttagctcttttataaagtagatttttgttccctgcattgcttctctttttttctggggttctttcttgttaccgctctttcatatagagactttctctggatgtctggtagcctctggttgtctgtacctaatgtggagccctaagcatctgatcacaagctgtgtttgtatgaataggacatgtttgaccacagagctttcctattgggagttgtctggtgcttttattgaagaccccagatatttgtgtccttagatttctgagagtatccagtttctctagataagaatcttctcttctgcctgggaggaactgatgatcccacccctcagtcacttagtcctcccccgcctgccttttcatctgttgcttcactcctgaaaccacgtttcttcatcctggggtgtgtgaaacttcctgagactttgcataaatgcttatgtttagtcacgagtttgttggtgaagactatgttaacaactttacagaaagtttggagaatagagaagaaaaaccccacaatcctaatattctgaataccatttttgtttttgtatattttccatatacatgttttttcaacatatttttgattataattttgtatcttgttttttccgccctcggaattttatccaaagcagttttctacgttgccactaatcgtcataattgttcatttcagtggttgtgtacaatgccattgatgagaacagcagttctcaaacgtttctgtctcagaactcctttaaattgaaaattgaggctgggcgcggtggctcacgcctgtaatcccagcactttgggaggctgaggcgggcggatcacgaggtcaggagatcgagaccatcctggctaacatggtgaaaccccgtctctactaaaaatacgaaaacaaaattagctgggcgtggtggcgggcgcctgtagtcccagctaccaggaggctgaggtgggagaatggcgtgaacccgggaggtggagcttgcagtgagccgagattgtaccactgtactccagcctgggtgacagagcgagaccccgtctcataaataaataaataaatagaaaattgagaactccccaaagcttttatttattagggttatatgtattgatagctgctgaattggaagttattacttaggaaacttaaaatatatattaattcatcaaaaataataatcctgttacatggtaatgtaaataacatatttttatgaaaaacaactattttccaaagcaaattattgaaaagagtgaattgtttaaattctttgcaaacccctttaatatctggcttaatagaagttagctgggttcctgtgtctgctctgcattcacactatttaagtatgttgttttggttgaagtgtataaagaaatgtagctacaaaaggaagggagcatattaataccttttcaggtgattgtggatattgttctttgacattataccaaaactcagcaagtggtttcttgggggtgggtagacagtgatgaatttttattcaaaacaactgtagtgactgacaaaaaaagttaaaacccagaatgatttgcttcaattaaaaattaattatatcccaagagcaggggtctaccaggttgtctgaggggaggggtgaactggcccagaaacggagcaggtcaaaattcctctgctgatcagtgggatggggattgggatcaagattgcttctgtgaatagccactgcctggggaacatagcgagatcctgtctcttaagaaaaagaaacagaaacttttggaaacaagcagacaagggtgaaagaaagccttggtgtaagatataatttatatattccatataagatatagaatacatatgttatataactaaaaagcataaaaacagtcagcatgcttttagtacaacctggaggtatggttaatgtgcaggaaaaaagctccatataagcctaatccctatatataaaaaatcacggaattccacagttttgaacatttttttttctttttgagacagagtcttgctctgtcgcccagtctggagtgcagtggtgcaatcttggctcactgcagctctctacctcctgggcccaagcaatccttccacctcagcctcctgagtagctgggaccagaggtgtgtactaccacatccggctgattttttgtattttctacagagacaaagcatccccatgttgctcaggctggtctcgaactcctgggctaaagtgatccttctgcctgggcctcccaaagtgctgggattaaagggatgagccaccacacctggccaacactttttttgtgtgtgtggtaaaatacatacaacataaaagttataattttaaccattttttaagtgtgtagttcagtgacatcaactatatgtacattattgggcaaccatcaccactattcatttccaggcagatagttaatactcatttttttgtggtttctatatttgcaaatttacctgttcgaaaaaatttatttgtaacacccaaatcagtacagcgctttggtaatccttttcggacatatgcagaacggtgaaaaaatatgcacatccctagttgaggttcaacaaggggacactttgctttctttttttcagtctttgtgccgtaaaccagtgtcttttttgtgatctatttaatgccttttttttcatttttgtactttttgttgatgattttgccatttaaaatgggccccaagcatagtgctgaagtgctgtctagtcttcctaacgcacccttgagtgaaacttacctaacacctgcattttctttgtaaggcacatcatagccttgccatggataaaactctggacagttgagtttttccttgcactgcacatggctatggtgctttacaaagaagatgcacgtgttagaagtttcactcaagtgtgcgttacagtgctgtggctgtgaattcagtgttaaccaatcatatatagtaaagaaggtgttcttaaacagacacacacataaaacaaacttatgtattaatctgctgttgcaaaatgttgtgaccagaggcttgcagaaacctaacccccagaagcaatgatttcgtattcactaattcagtgagcacagtaactgcatagaatgaacaatgagaattgactgtagctccttttttgaaagaagaggcttaattatggagcaaggcatcaggaaaaatcacaggctttcctcatttgtgtgatttttttattttgttcatgtcttcaagagtggagccctaagaagaaagctgagagctcccagtaaaggggtgacgagtgcctggcttagcctcatagaggccagaggaacgtcggtctttacactgggacattccacacacgcaacacagagttattttctatggacagttgagtttttccttttccaagcatattctagggttgtctttctgtgccctgctacatgttccactgtactgctgtcagatttttatctcccagaaattctttgaagtcacttgtcttctggtggcagcccttcccttctcttggccattctttgtcatttggtctttgttcttcagtgggcctatcaggtggcaggacagagaaatgcatgtgatcaatatgccatctttaaccaatgtcctcattatggttatgaaaataacttttcatgtaattatttttattcaagttacatattacacacagtttaaagagtcaagacttgttaaaaaagagtcccctagactcactggtttccttgtctcccaggatggccacttttaatcttttaaagtgattctttagtcttttaaatgattctttcatactttataacatgcttgtagtcttacttgtttttcaggtttaggcattatctattgacattttatttaaagtcatcattgactttaaaaacacaaaaactctttactgaaatgtaacacaggttgggtgcaatggctcatgcctgtgaatcccagcactttgggaagccgaggcaggcagatcacctgaagtcaggggttcaagaccagcctgaccaatatggtgaaaccctgtctctactaaaaatacaaaaattagctgggcatggtgtgtgtgcctgtagtcccagctacttgagaggctgagacaggagaattgcttgaacccaggaggtggaggttgcagtgagccaagatcgcgcgactgcactccagcctgggcgatagagcaagactccatttcaaaaacaaaacaaaaagaaacgtaacatacataaaaagtgcccaaatcataagtgtacagcttgatgaattatcacaaagtaaacacatttgaataaccatgacccgggcaaaaaatatactgtgacccacaccctagaagcctccctttggcctccttcaaatcccttcactaccccacctcctcaagtgaaccactgtgccaccttctaataccataggttttgtctgtttgttgttttaacattgtactaatagaatgttagagtattttaataatagtgtattattttgtgtctatttcttttactctacttcatgcttgtgatattcttccatgttgaggttttcatttgtaaccaactgttgtagttgtttgacttggcctccatttgctatggattgaatcgtatgcctcaaaattcatatgtgtaagccctaacccccagtgtgactgtatttggtgatagggtctttatagaaggttaagtgaagtcgtagtatgaatcctgattgatagggttagtgttattacatgaagagacaccagaacgctagctttttctaccacatgagaacgcagggagagggtggccatctgcaagccaggaagaaggtcccctccagaactgtgagaaaataaattactgttaagtcccccagtgtgtggtattttggttatggcagtccaagatgactaatgcatcattcttcaggccactctatccccctagaggacttgcagtcttttttttttttttttttgcctcctcttttactgactgagaatgttgttaacactttcagaaacagggtgttaggatcttttgaccgttggtgaaccaacagaaagtggaagataaggatttttctccagtgggtgtttgctgtggatttgttgggagaagcccatctcatgtatgagctgtcccatccctattttgtaatattccactttgctgctggcatcagagtgaatgtaaatggaatttcccagaaatttccacagcaagtggctttctcacttagtgagcccccttggtgtttgttgagtctccctttacccaaccccacaatcactggaataaaggggtggtcttctctccagtctacacctttctgaggcactgcaatcggggataccccagttaccacctcttttggtgaccccaaggtttcagctttgcctgagctctccaggctccagctctgggccaaggtgattttggtggagtcatcccagcggggagctaggaggaagaggggattaggaactcccgctcaggcttccttgctgcacgtacacatgtcacatcaaatgatggtgtttcactctggggacatagttgcttttgataaaatgacttttctgcagtttggttaagctgaatgaaacatatttgagctcctatttttgcttcagaggctattgaatagcagtacctgaagatgaaagtgtataagaacagaatcagtccgggcgcgatggctcatgcctgtaattccagcactttgggaggccgaggcgggtggatcacctgaggtcaggagttcaagaccagcctggccaacatggcaaaaccctgtctctactaaaaaaatacaaaaattagctgggtgtggtggcacgtgcctgtaatcccagctacttgggggaggccaaggcacgagaattgctcgaacccgggaggcggaggttgcagtgagccaagatcacgccactgcactccagcctgggtgacagagcgagaccctgtctcaagagaaaaaaaaaacgcagaatcagaatctttggaatagtgaccggatgccgtggctcatgcctgtaatcctagcacttcgggaggctgaggtgggcagatcgcttgagcccaggagtttgagaccggcctgggtaacataaggagacctcatttctacaaaaaattagctggacatggtggcacgtgcctatagttccatctactcgggaggctgaggtgggatgatcacctgaacctgcggaagtcgaggctgcaatgaactgtgatcatgtcactgcactccaccctggacaacagaatgagacctcgtctcaaaaaaaaaaaacaaaaaacaaaagaatctttagaataggaggaggatattgagcagaaccataagaaactagtgattaagagtccaggtgtgaaaatagaaaccacgtctcagaagctcagagagaagaagaactggaaaggcagcatctttgatggatttggccatgaagaggaggaggaataaagcagaatggaggccagaaaagagtgtgtatgtctaacggtttcattggaattgggagatctaggtataccatgtaaaattacttatgaaggtaaagtttgaagaaaattcattcgactttgatttatataatttttaaaacctcattatctgttaaaacaccagaagccctgttttttggttactgattatgagtgttcaaggcctcagatcaactcagcatttatttatttatttatttttatttttttgagagggagtctcgctgtcttgccaggctggagtgcagtggcatgatctcggctcactgcaacctctacctcccaaattcaagcaattctcctgccttagcctcccgagtagctgggattacaggcccatgccaccatgcccagctaattttttgtatttttagtagagatggggtttcaccatgttggccaggatggtctttgtctcctgacttcatgatctgcctgccttggcctcccaaagtgctgagactacaggcgtgagccaccacacctggcctatttatttattatttatttatttatttatttatttatttgatggagtctcattttctcgcccaggctggagttcagtggcaccatcttggctcactataacctccgtttccaggtttcaagtggttctcccgcctcagcctttcaagtagctggtgggattataggcatccgccaccaagctcagctaatttttgtatttttagtagagacggggtttcaccatgttggccaggctggtctcgaactcctgacctcaggtgatccacccacctcccaaagtgctgggattacaggcatgagccacctcacccggacaactcagtatttattgagtactccttatgtgccagttagggctataaagatgaataagatgtcttttccccagttgagatatgcataagacagttcgtgtttgcctgtttcagtagtcagtattttcttttgcttattcagtttccactgaaacttatgttttccaaatacaaaattagaattccaactttgcgtttttcaggcgcacacactcgttttccctccactccttccccagttctgatttgcttcctcctgaaaatgggggttatagcccatccactccagggtcagaattgctggataccttgttgcagtgattttttctgtagctcctctggaggttatagactcatagggaataaataatgtggtcaggtggaggctttagaccaagttaagcagggtttttaaaacatggtgttaatgtacataatgcagccattctcaaaagtatgacatggggagacccctggaggttttctgagacccttttaaggagtctgccgagtcaaaactatttttgtgatactagtaaaacatttgcttttttcattctgtctctcacaagtgtagagtggaattttccagaggttacatgatgtgtgatatcacaacagattgaatgtagaagcttgtatgaaaatttcatacaaatatattatttgtgttataatgtgcttattgttattttgaaatcaattgttaaatacttttttttttttttttacagtttctcagtttttatttgtattttggtagatattcgttgatacaacccacatttgggggaatgagtaatctttaaaagtgtaaaagggaccaaaaagtgtgagaatgtttgatgtagagaaactccaagctcattccctggactttggctatagatgctttcttcaggggtgggtcttctgggcctgtgtcctgcaggatgcccagtaggaagcacagcctctttgatcttatgggggtgggctcatttgctgttttggagctcaggtgcaaagccgagttacttgatattccctggtcatggcaaagcctctctccacttttcttcccttctattgtcacttccattctttttccatagtccatagaaatcatttttacgtgacagtgatgagctgaccagaagctatagaagctatagtacttcctatatcctaatgggttttaaaaacactggctggggcatactcaccctttctgaacaaaggctgctaggtgaccctgctgttgccgctctgtatattcacttggttagcccacagattggtttggacctaattccctttccttctttaactgcccaaagggcttttctatttaaaaaaaaaaaaaaatttttttaaagttttcagattcaatacccacctatttgtatgcttacccatcccagagtcagctaaatttaaagtgtcagtaaattgtaaagaaaagatttgctacattgcatatgtttttagaagtgctttctgtgtataatctctctctctctctctttttttcttggtttggaggagactttccccttgtctataagtaacttaaatataaaatgttataacaatacgtttattagtttgaagccccaattttctttttttttttttcttttaagtgaaaacaagtttataaaagaagtaaagaaacaggccaggcgctgtggctcacacgtgtaatcctagcactttgggaggccgaggcaggtggatcacctggggtcaggagttcgagaccagcctggccaacatggtgaaaccccatctctactaaaaatacaaaattagccagtcgtggtggtgcgcacctgtaatcccagctactccagaggctgagggagtagaaactatgaaaacttgggagatggaggttgcaatgagccgagatcatgtcactgctctccagcctaggcaacagagggagactgtttcaaaaaaaaaaaaaaaaaaaaagaaacaaaagaatggctgctccatagacagagcagcagtatcagctgcttgactgagtctacttatagttatttcttgattatatgctaaacaaggggtgaattattcatgagctttctgggaaaagggcagagatttcctggaactgaaggtccctccccttttaggggactatttagggtaacttcccaaggttgccgtggcatttgtaaactgtcatggtggtggtgggagtgtcttttagcatgctgatgcattataattagcttataatgagcagtgaggacaaccagaggtcactttcatcgccatcttggttttggtgggttttggcctgcttctttaccacatcctgttctatcagcagggtctttgtgacctgtatcttctgccaagctcctcctatctcaccctgtgactaagaatgcctgacttcctgggaatgcagcccagtaggtctcaggcttattttacccagccccttttcaagatggagttgctctggttcaaacacttctgacatatttcccccctcccttttacagggggacccttaatccttaagaattgtagcgggacaaagatcatctgtaacttcttcaagccaaataggggtgatgatattcctgcctattagggtctcttgtatttagggtagggagaagtttagttagaaagcattgttatagaagcccttattttcagttacacaattttataaagttacaattgcttattgtaaccagctgagttttaggttttgtggtttgttgcttgcttgcttgcttgcttcttaatgccatatatcttggcatttatcagtccataattactaaattcttaaaatccataaatatttattattctttctaggttgcaataaaaataattgacaaaactcagttgaatccaacaagtctacaaaaggtaagattggttcaatgtctagtactttttaaaaaattatcggtgctaattgccatctaatttgtcccttaaataccccaactgttattttatgtttaatgccataaagcttcctattcctcaaatgaatgcaacttaatgtagtatttcatgaaaaattgttgggttatctttggtcggagattatttttaaatgttcttaacagcacaaactaaaggctgtgctttttttttgtacttttttattgatatagttgtacgaggctgtactttttattgaatattcttaatattgactagagtttttttaaaaataatacagtacaaaaatattttcatgtaattgatattgtgcaaatttgtaccttatagctaatactgaaaattttaaagtgaacactttggcttccttaaactcttgacacaccacatctgattaaggactgatgattaatataaaagggaaatgttaaagtaaaactgaaagtggaaaagcatgttcataaagcagtattgccattagtatcatttaacatagatcaagtctttgccctagtgccttttagaatcacctgggcagatttttgaaagtcttaacacttacataataatgcctaagcaattaggttgggcccaggcataggtatttcagtggtaggacatcagcaaataattaatgatcttcataataaaatccttctagttgtttttagcttcgcagagtctttttacatacttcatttgatttctagatttgacctgtagtagttgaggggggtacagagaccatgaagtaggaacaggaagtactgaatttcagtcctggctctgccacttagccgaatatctgaccttgagcaaggcacttaactttgctggaccttgggtttctcatctttaaaatggagataatttcatcttcttatgatggatgtgagtattaatgaaataatgcatataaaagggctttgtaaactgcacagcactgcacagttgtgcgatattttgataagagcagtgctctatatacatttctaatgtattcctcatggttatttatatcctggtaattttgaagccctgtccctgttttgtgtttgggaggtggggagggagatagactttctctgcactaaaaatgttatttcaacaagtggttctttgtgatctgcaacccataatgggccttaaggcttctcaaggtgggcatgaaacatctaaaaattccagtcctttgtcctgaagagtaaattttatctatttccttaaacttccatatcttcagctatctaaggatttggtactaataaatacattagagtttaatacaatgtggtattcagaactaaaattaacatacaaggatgtttaatgaggactctaattgagtattctatgatgttacataccttccactattcatgtgtacctggatataattgtaatcctaacagttttcccggaaaaatttttaccatggtgttgtatcaagttggctgcagtttttccttcttgtttgcttgcttcctttagtcattttttattttattttatttttttggtaatgatttttcattgctgctcttcgtttattatttgtcacatcattatcagtttagtgcatggtagtttggttagcccattagtgtgattatgcatatttgcatctgaattaattttgacttataataataattaaaactttaagatttgtttttggtattattcaagtatgaaccattcactgaagacttattctaaagccagctctatcccaagttaaataacttgataagtataatattttcagtttataggccattgtttaaaattgtgtatataacttcatatgcttatgaagtaaattagaagcattttacatacatttgtttccaattctttttcaccaagtatcttatccccagcccccccatcttcccccacccccagcaattttgcaacaatgtagaatgtaccaggcaactttgtcagccccctttgcagtcattcttgcatccttttttcttctcagcaccattcatagttgtatcacacttgcttcaggaacagctctcttagatagtgatttaaagctgtggagcatgccctagcagctaacattcatcataaggaacattctgccatcagcagtgtgcaatctcttttttaccaccactaccgaaaaaggtggactggctcattcaggcagtattttaacagtgaacacacgtgttaaaatatcggtttcatgatattcaggcttgcatactgggtcatgaacatttactaaatgcacatataagtaaacctgagttgactatgtttgcaaattgatattattttcacagatgagtctcttcatttttcctttgtatttttgcagccattgaattaataaacgttagattctggtgagagatttatttttctccattgttttttaagagatgggtcttgctctgttgtccaggctggactcgaactcctgggcttaagcagtccttccactttagcctcccaagtagctgggactacaaatgcacaccacagcatctggctatataccttccaatgtctcactagtatatctggaatactattctattcttacgcatcttttaggtcaattttttgtttgttcgtttgtttttgtttttgtttttttgagatggagtctcgctctgttgcccaggctggagtgcagtagtgggatctgagttcactgcagtctccctctgcctcttgggttcaagcaattcttctccctcagcctcccaagtggctaggactacaggtgtacgccaccacacctggctaatgtttgtatttttagtacagatgggggatttgccatgttagccaggctggtctggtctcaaactcctgacctcaggtgatccacctgcctcagcctccacttgctgggattacacgtgtgagccaccatgcccaggccaaggtgtgtggatcacttgaggtcaggagttcgagaccagcctggtcaacatggtgaaaccgcgtctctactaaaaatacaaaaattagctgggcgtggtggcacatgcttataatcccagcttctcaggaggctgaggcaggagaattgcttgaacccaggaggcgacagaacaagactttgtctcaaaaaaaaacaagaaatttgtaacatgtaatgaaataattgattttttgtaatgtatttatgatagctggttagttagccaaccttgagcacattcagggatggagacacactccttcccgtagcatcttgttccagtgttcagtggctttgctattagagccttttccccttacttcagactagcatctgtcttctagaaacttctacaacactgtttaccatttgtcatatggagttatagttactccaaacataaccagcccttagaagttgctattttgggtcttgttgattttctcttatgcagagtaaatcccctcagcctccttgggtactcccacaggagtttcgctgaacagaagcctactttattccatacttggaattgtttccccccccccacctgaatttgtttgattcctgctaaaattcatttaattgattttctgccttaattccagtcttttgggggattttggaataatgggtcatttgtattagctgctatgtaaattagatatggatgtctccatccaattaaaatattaaacaagacaagaacaagacttttcaatggagaattcatccaagttgatactgctgacccagtagtaaagcattttttgagtaagatttaaccaccattcttaaatctagactgagtaggacagaaagggaaatccctgtgtttttaaattttaatgagatttacagaggaagaaaaaaaggaacattaaacacaaatatatgcaaaatacccagtaggatttattaaagcattattgactatggatttcatcagggtctttgtggggaaatcctgcttatacccacctcaatcttcctccctcccttccttccactggccttatcgtgattgtaaaatagggcaacactacattccataaaatagaataagtgtccctatgagctgagcagaagttggctttagagacaggcaaaggctgaagaaggctgaggcaggcccggcacagtggctcactcctgtaatcccagcacttggggagcctgaggcgagaggatcactcgagctcaggaattcgagatcagcctaggcagcacagagagacccgtctctaccaaaaaaaaaattaaataaattaaccaggtgtggtggtgtgtacctgtagttccagctacttaggaggctaagatgggaggatcacttgagcctagaagttggaggctgcagtgagctgtgatggtgcccctgcattccagcctgggcaacagagcaagaccctgtctcaaaaaaaagctgaagcaaagaacaaagagtgtattggtcctttcagaattccttttttttgtaaggcagggacagggaaacagaacaatagaccacaatagactataccacatagaaaagtaaccgattagttaatgtcaggttacttcacactacatttttttctgtaaggattaaagcagtaggaactttgttattgtgccaattgaagttttttcttttcttttcttttctttttttttttttttgagacagagtcttgccctgtgacccaggctggagtgcagtggtgtgattttggctcactgcaacctctgcctcccgggttcaagagatacttctgcctcagccccctgagtagctgggactacaggtgtgtgccaccacgcctggctaatttttgtatttttagtagagacagggtttcaccatgttggtcagactggtctcccaactcctggcctcaggtgatctgcctgcctcagcctcccaaagtgctgggattactggcctgagccaccgtgctcagccaggacagtttaaatcttcaatcaggggctggacgcagtggcacacgccaataatggcagtactttgggaggccgaggcgggtggatcacctgaggccaggggttcgagaccagcctagccagcatggtgaaactgcatctctactaaaaatacaaaaattagttgggcgtggtgacataccccagctacccagtaggctgaggcacaagaatcgcttgaacctcggaggcggaggttgcagtgagccgagatcacaccactgcactccagcctgggtgacggtgagactctgcctcaaaaaataaataaataataaactgtcctgtttgggaaattagctgttatctccttttcttctgatttctaggaaggtcagataacaacttaatttaggtttgggaatgtggaatcttagcagggattactccatttttaattttaacctggtttcctggggcctaatgcaggagtttagtcccaaacaatggcttcctataatttttatttaacaattcttcccttttggtcaggctttcacctaggtaagagtgtaaccaaaacctaggatatccctgctgttctcagttgccatcattttgagtttcccgtttcagcatgccgttgacagggtgttctcattatcgtgtgtttcttttgagtttttgttgttctagccagagagaaccatttgacatctgataggtggctacatggagacacttaacactctgggaggatacagcgtaccagagagactaccattatgactatcatgaggatcacaccaagcatttagagtatgctcctaagccagggtttttatgaaccaaatcaactaaaattgtatagccaaacaaggagtctgccaattttaaccaagttgtccgctctaccatacccaaatcgcaacgagaagtgtcatgaactgcacagattcctccatgtttagtaggcatcccagcattccgtgaccgggctaagtataaagcagggagtgcaagttacccacagaagctactgactgtgaaattttagctacagcatgatcctgccaaactgaaagaggtaggcattagtaaggaaaaattaagaggggcaaaagcattgttatgaagtcttgttattatgacagtcttgggaaaagctgtccatagcatgcagtccacaacttctcgtcctggttcgcagtttgaatgtctctggttgtggcatctggcattctggtgaattctctgtgtggcctacacatcaggcatgagactcgaaatttacatcaagctgtcagctttggtttatagggcttctgaaattgagcagctcattcttcattggcaagttgtagccagatattaaagaaaactagaagaattcagaatctagttcagtcaggaataatcttatcaggtcatttctggaagtcaattctgtgaattaatattttagcagcgttttttgcttctaatttcaaattggaaggtatagggttattcattgtgcccctcaagcctggtccactccgatacccctcaagcaccagacacctacccaggaagagggaggctgttttctttttaaagctagtatttgctttggagccactgttagtgcttagagctctgtagcagtagcagtagtggccttttttggcgtcctagggaatcttggtcatgggatgtagcagggaaacttataatttgaaaacaaggagaaccagttcatgcttttcatgtggtctgtcgtgtaatgacttttactgctgccaccactgggttattttgggcactgttgatttagttttcttaagccagtacttttcaacccttcttgtgcattagaaacatttgtggagtttgaaaaaagcatatttccttcacagtactttcctccctagaggtcctatcttggcgggtctagaaatgtggtgatctcagtacacaccccagatgagaatggctcctagtctgtcttcacttcccccaaagttcttaatttctctcttcttccaattttacttatttttatttatttatttatttttttgagacggagtctcgctctgtcacccaggctggagtgcagtggtgcgatctcagctcactgcaagctctgcctcctgggttcacgccattctcctgcctcagcctcccgagtagctgggactacaagcacccgccaccacgcccggctaattttttgtatttttagtagagatggggtttcaccgtgttagccaggatggtctcaatctcctgacctcatgatctgcccgccttggcctcccaaagtgctgggattacaggcgtgagccaccacgcccggcctatttattttttattgattgagtgattgattgatggggtcttgtcctgttgcccaggatggaaggtagcagcaagaccagagctcactgcagcctggaattcctgggctcaagtatctttccacctcagcctcctgaggtagctgggactataggcgcgcaccaccacacccaactaaagtaacctattttatttatttatgagacggagcctccctctgttggccagcctggagtgcagtggtgccatctcggctcactgcaacccctgcctcccgagttcaagtgattctcctgcctcagcctcccaagtagctgggattacaggcacccgctgccacacccagctaatttttgtatttttagtagagacagggtttcaccgtgttagccaggctggtctcgaactcctgacctcaagtgatccacccgcttcagcctcccaaagtgctgaattacaggtgtggccaccgtgcccggcaaagtaacctattttaaagatgaccccttccccaaatattctaagtttcatagacagctgctactgccactgccactgctgaatattttctccctctctggaactcttcctaggaatgccttagtacccagttcctggcctcctttctctattgggtgaagcacaagttattttggaaatccttttcattgaacaactcttttcatctttttcttttctttcttttttttttttttccaactatctttctctttcattttcttatattgacttttcaggccattaacaaaagtagtaaccactgtaaaaatagttgttacagtcttgtctgttatttaaaatccagtgtctgcattcacatcagtgtcataaatctgataaattaatacaaataggagatggcaaatgaaatccaagacaggcacttcttatattgattgattgaggctgggtcttactttgtagcccaagctgaagtgcagtgtcatgatcatagctcactgtagcctggaacttctgggcttaagcaatcctcccgtcttggcctcccaaagccttgggattataggcatgagtcaccacccccagcctgattatacatatttaaaatattgagaatagactgggcacggtggctcactcctgtaatcccagcactttgggaggcccagctgggtgggatcacctgaggtctggaattcgagactagcctgacgaacatggtgaaaccccgtctctactaaaaatacaaaaaaattagccaggtgtggtggcgcatgcctgtaatcccagctacttgggaggctaaggcaggagaatcacttgaacccaggagacggaggttgcagtgagccaagatggcaccactgcactccagcctgggcaacaaatgagaaactctgccaaaaaaaaaaaaaattgagaataaaactgtatatatgtttgtttatttttagatttcaaaagagaagaaatagaaaaaccggctttcagtattgttgcttctttattccttataaacttttaaatttcttgccagacttatttttgttttggcaataaataatacgggttgatatttagaatacattataaactcgggaagctgaggcaggaaaatggtgtgaacctgggaggcggagcttgcagtgagccgagatcacgccactgcactccatcctgggcgacagagtgagactccgtctcaaaaaaaaaaaatacattataaactgagaatagtagagtgtattttagagattgattgtttgtttttagaattgaggtctcactatcttgcccaagctggtctcagactcctgggttcaagcatcctccttccgaggattccaatctgccttccaaggagctgggattacaggcacacaccaccatacccagctaaagtatatttttcattgtaccaaggactcattatgctattttagaaaagtcaccaaggaaccaagtattttaagtgggttaaacttagagcatagcctggacccatttgcagaaaatataaacttgggtgcaaattaggcctttgtgagagaattataacagtaacatcagccagaatcacaaacacatgtcaggagtttattgtgtgccaggtgctgttccatgcactctgtatgtcaagccatcctttcattgtagaggtgacagggtcagggaggtcaagttacctagacttagtgagtggtacagctgggttgggattaggtagtatagctcctggaatcaaattctacacacactttatcttatagcattgcatgtacttttcacaacagtcctgtgaagcagttgttttctttttttttctttgagacagagttttgctcttgttgcccaggctggagtgcaatggcgtgatctcggctaaccgcaacctccacctccctggttcaagtgattcccctccctcagcctcccgagtagctgggattacaggcacccgccaccacgcccagctaatttttttgtatttttagtagagacagggtttctccatgttggtcaggctggtctggaactcccgacctcaggtgatccacctgcctcagcttcccaaagtgctgggattacaggcgtgagccaccacgccaggccgaagtagctgttttcaaaatctatcttataggtaagtaggttaaagctctcaagattttgtggtttgttcactcatccagtgaataagggactgaactagccttagaacctaaatttataacatcaaatagctttctttgcataagttcccttggagccagtcactcatagtactttccatatgggaaggataacaaaggaaaatatggaaattcagcttgcatgtggtagatacctagtaaaatctgataagttaattttgttagtaccaaattcattttaacactaaattaatttttcctgatgttgctctgattctaggaatcttgaccaccagaaccttgagtttgggagatgggaagattcttagtttgtctttgaaatatttgatcataaaaaacacattattggccaggcatggtggctcaagcctgtaatcccagcactttgggtgaccaaggcaggcagattgctgagctcaggagttcaagaccagcctgggcaacatggcaaaaccctgtctctacatacagaaattagccagatgtggtggtgcgcacctgtagtcctagctacttagggggctgaggctggaggattgcttgagcccgggaggtcgaggctgcagtgaaccatgttcatgccactgcattccagcttgggtgacagagcaagactccttctctaattaaaaaaaaaaaaaagcacacacattgttgctactcttattttacatttttagaaaactgatttgttgtattactcagctaaagctaagcaattttttaaaatttagtttttaatttttattaaatactgactgcatacaaaagaatgttccatgtttagcatataaatatgtatatgagatgagcacccttatactacctgcttcaagaaatagatcttcaaccatacctttaaaccagtcccatattgtgcccctcctcaacctgattccccttcttcattgcccacctactgggtaaacactaacaaggattttgtgttattattttcttgctttgtccgtgtaattttaccacatatggatcactcatcaatgtagtgtaaaggtttttttttgtctgttttttgtttcttttgtgtttgtttgtttgtttgtgactgagtctcgcactgtctcccaggctggagtgcagtagtgcgatctcagctcactgtaacctctgcctcccaagttcaagcgattcttgtgcctcagcctcctgagtagcagggattacaggcgtgcgccaccacacccagctaatttttgtatttttagtagagaccaggtttcaccatgttggccaggccggtcttgaactcctgacctcaagtgatccacccacctcagcctcccaaagtgctggaattacaggcgtgagccaccgcaccccaccaatgtagtgtaaagtttaaaaaattgtataaatggactcatgctatgtgtattctcctattggcttttgctttgcttccttttttttgtttttttgagacggagtttcgctcttgttacccaggctggagtacagtggcgtgatctcagcactgcagcctctgcctcctggattcaagtgattctcctgcctcagcttccaaagtatctgggattacaggtgtgcaccaccacacccagctaatctttgtgtttttagtagagacgggttttcaccacgttggccaggctggtctcgaactcctgacttcaagtgatccacccacctcagcttcccagagtgctgggattacaggtgtgaaccaccatgcccagccgcttttgctttcttttacctacattgtgttccatgttgatgtattttgctgtaattcaccttcactgctatgtccattttcaagaatatgtagtatcccattatgtgaatatgccactctgtatttattctgtgattcagagacatttggattgctttttgtattgcaaacatgactgctgtgaattgtcctctgtgtgtcctggcacacttgtgaagagtttcttaaatatatatacttagaattcttgtatcacagagtctgtctgcacatcctccttcttcattagagaaggccaaattattttcagagcaggtatgctaatttatatttccatcagtagtgtgtaagagagcacaagtaatgtagcatcctcatcaaaatttgattttctctgattttttaaaatttgtgccatcacaggagaattgcttgaacccgggaggtggaggttgcagtgagctgagattgcgccactgcactccagcctggcgacagagcaagactgcatctcaaaaaaacaaaaaaattgtgctatcaatttggtaaatataaaagtgatatttggccaggcatagtggcttcctccttaaattccagcactttgggagcctgagatgggaagatctctccaagccaggagttcaagaaccagcctgggcaacagagcaagactctgtatctacaaaaagattttttttttttttaattatctgggcatggtggcacatagctgtggtctcagataattgggaggctgaggattgattaagcccaggagtttacagctgcggtgagctgtgattgcaccactgcactccagccagggtaacagagcaggagcccctcttaaaaaaaaaaaaaaaaaagaaaagaaaaatctcattatggttttaatgtaacattttcctaattactgatgaggtcatgcattttttcatatttaggttttttgtttcttctgtgaagtacgtattcatcttttgtttaatttctagtggattttttcttagttattttaggatatcattatatatcatggatactattatatatgtggcacacaccttctacttgatggtatatcttcactctcttgatactgtctctcagtgaatagcagaggctcctaattttaaagcagttacatttatcagtctttttttaatatgctttgcactttttatgtcttttttgtttttttgtttttttgtttttgagacggagtttcgctctgtcacccaggctggggtgcagtggcacgatctcggctcactgcaagcttcgcctcccgggttcacgccattctcctgcctcagcctcccgagtagctgggactacaggtgcctgccatcacgcctggctaattttttttgtatttttagtagagacggggtttcaccgtgttatccaggatggtctcgatctcctgacctcgtgatccacccatcttggcttcccaaagtgctggaattacaggtgtgagcccccacgtccggccttttttgtgtcttctttaagaaattcttctctacctggggtcataaacatatttttctctgttgtcttcacatgtttaaagtaatctttaagccaccagcagtcatgtgttacgaggtagggatccagtttcatggtttttcgtatgtataatcacttgctgcctcacctctcctttctttgctgatctgcatcgtggacagagtctccgtgtctaaacacacactttgttcttcagaagtggttattctggttcacttaacaattgccatttgaaaagcaattatttttattttattttcatatttttaaattttatttttaatgataggacaccaaatgataaccagaaccccaaaatacataggtgaaaatctgagctaaattaatagaaacacaggcatgacagagaagactttatcacttaactctcttaggccattcattaattacacagtaagtagggggaaaaggtacatatcttaatatacagcacctccatggccaggtgcggtggctcacacctgtaatcccagcactttgggaggctgaggtgggcggatcatgaggtcaggagattgagaccatcctggtgaacatggtgaagccccgtctctactaaaaaatacaaaaaaattagctgggcgtggtggcgggtgcctgtagtcctagctactggggaggctgaggcaggagaatggtgtgaacccggggggcggagcttgcagtgagcggacatcgtgccactgcagttcagcctgggtgacagagtgagactccgtctcaaaaaaaaaaaaaataacagcacttccattagcccatagtatagctgttttaatccccttttcaggatacataacagctgtgtgctaggatattatcgtcataactattccaatgtgtgatgactatgaggtatattattttctcagagttgggcaatacataacatttgaataagccagactaacatctttctaggctatagttctaatgtagagcaataaaaatagaaccaaacaaaatatacaaacatgtggaacctaaaacacacagaattcttggatcaaagaaaaattgcaaacaaaaattacagtatatctaggaattaatgataataagctgtgtgtcagaacctatgtaatactgctttttggtgctccgggaaatttgtagccttaaacacattattaaacaagaatgacaaggaatgcattaaacattaaactaatagtttagaaaagggaacaaaataaatctcaggaataaataataatgtaaggagtcagtaaagctaaaggcagaaaataatgaatttgaaaacagtagaaatggtaaatccaaaactttggtgggtgtccccccccctcccaccgacaaggaagtgagaagagaggcaatgaaatagataagctactaagtgctgccagggggaagggagagaaaacacagaaaaatgagggggaaataccagatactgaagaatttaaattattataaaggaaccttttctgcaactctgaaaaatgttagaatatccaaagaaattgataattttctaggaaaacatgacttaccaaaattaactctagaaaagaatcgatacacatcagtaacaacagaagttgagaaagtagttaacatattgccaaacctggaattcatgattgaattctttgagatctactgtgagtacatactctgcctctgttcagctgttccagaacttaagaagaggaacttccaaattcttttctcaaattcagaaacaatgctattgaaatatattggaaacaggaacgaaaactacagttcagtttcacttataatatccattctaaaattgggaattaaaaatactagcatataggactaaatactggtacatttatctttgtttccccaaagattcactaaatgatggtaacggaattaaaaaggaggggaaaagagtccaggaattgagtactgaggcattctcaggaagagcaccaagagagggaggagatacccagcggtcacagtggaagtcgtctttgagacttagagcgtttgaggaaggggtcgtctttaaaataggttacctacctagcacttgggagaccagaccagcctgtggcaaccagtgacatcagttcctttgagtctttccagagatactctgtatattaagaagcaaatttttttttccttttttacacaaatgcattttcttgaaaattccttctcatgaactttgccagcctctctgtcttggtttgtctgagagggcctttgatgcactcttccatttaggtgctgtggtagttgaggcaaagggacagtttctgtagagtgatgagggagtgacttaggtggcctggtcttctgtcccttatctgtgtatctggagaagggagcctgaacaccttcattgtgatggtttagatcagttttatgtctgtaacccccgtgttctcttttacatactcattttactttcgtatcggttggtaaaattgtctttttttttttttttttttactagagactaaaattctctctctcttttttttctacttgtcaaaaggtaaaattttatttttccagtggtaatacttgacaacccccaggtcttggctattgggacatgtttctttacttctctgataccgtagatttagtgtccttgatatccccattgccaggattccaaatctttgccttcaaaggtatttattctcctcttgtgtgccagttccatagaggatgtatagatgtgaaaatgtgtggaggatatagattgatcagtaaggagagaattctttcaatttatacgtttccatgtaatttgatttcttttttccaactaacatctatttaagattgaaaagggaatgtggagaaataagttgtattaagatagtagaaataggctgggcgcggtggctcacgcctgtaatcccagcactttgggaggccgaggcgggcggatcacgaggtcaggagatcgagaccatcctggctaacatggtgaaaccccgtctctactaaaaatacaaaaattagctggacatgatggcgggcacctgtagtcccagctactaaggaggctgaggcaggagaatggtgtgaacctgggaggcggagctttcagtgagccaagatggcgccactatactccagcctgggcgacagagcgagactccatttcaaaaaaaaaaagtagaaataaggtgagtttctcttatttaaatggccttttacaattacaaaactttaaaatttttctggtatagtccttatagggactttccttaaagttcacatttgcctttcagtacattattcctatccaaatttaactatctttggtcatcagattctgagattatgaagtctctggcatttttatctcacttgtatgcaaattgtcaacttcgtaaaaagctctgtgccagtacccacctgttgctctggacttttctatatcagcagcttataatttgttgatttttttttttagttaaatttctaaggtagcaatgtggaatcctgagatgaacgtagactttggagtcaggcaacccacaatgagaatcctggctccagcatatattagctgagtctttggatgagtttcctaacctgtctcagtcgtctgtctctgtatactggagatgatcatactcagctgatagagttgtgaaaattaagcttagataagactgtgaatgtgaagcatctggctctatgcgtcagacacagcaggcactagataactgttagcttcctgcttcctccctgtcctgcttgtttaacttagcataaagcttatttacacatttgctgcctgccagtatctacctaatacataattccaatagagaggtgaatacataaagttatttgggctaatatcctgccactacctctcttgggattctttggctgctctttttgcctacggaattaaatttttactagtcttctatctggtcccatttacctgtcctttttgttttcacattgcatccctggtatgacctctgctgtaactcaggagttctcgcattttaatatggtgtctgcagaatattagttatccactgctgcctaacaaattcctccagaacttagcaacttaaagccaaatcttttgaattcctgtaatagtccatctttttcctgctttttggctctaattcactttgtttcatttctgctgtactgttagtagagacttaaaaatgattgccttcatttgacctgctcccctgtcatcagaactgtgacaactctgtaacaagcattgtgctgcggaggatttaaaagctatgtggtcattagaatgctgaggctggctcagaccgcagttgttggtagttagtgctttcatgcaggcatttatcaaacaaatgcatttcagttgtgtgccagccttggtttcaggtatacagtagtgaaaggagacaggcatgctccctgtgggtgacacaaggataacaaacaggtgcacaaaaatgtgtcttcatagcttgaaagacatcccaggaaagaagtgaacagatgggctatgatgtaaaacaaggagacctacttagatacgttttcagagaatctgcctgagacttaaaggatgaaaagggagaagacatttaaaggaatttagtatgttctgtggccaggcgcggtggctcacatctgtaatcccagcactttggaggccaaggcagacaaatcacctgaggtcaggtgttcgagaccagcctggccaacgtggcaaaaccccgtctctgctaaaaatacaaaaattagccaggcatggtgggacctacaatcctagctgctctggaggctgagacagaagaatcccttgaacctgggaggcggaggttgcagtgagccgatattgtgccactgcattccagcctgggcatcagagtaagactccgtctcaaaaataaataaataaacaaacagtatgttctagtaactaaaaggagttggggtgactagaacgtacctttgaggggtatgcagaagttggcaggttgcagggatgccatggccatggtcagggtttcattctcagtgctgtgtatcctgagctatattgatatggcatccaaagtggagattgttgtctttttttttttttttttttttttttgagttggagtcttgctctgtcacccaggctggagtgcagtggcatgatctcagctcactgcaacctccaggaggtgttgtaatttagcagttgggaagtaattgggagatttgaattctagctaccaattcaactataatggattggaaaacaagatttctgtgttagtttaacagaggagagctaaaaaagaactcaggcctgaatggttgtcaggaatttacttgggtgactatcttctcatctcagaacataaaatgtaggaattaccacagttgcaaagggagatgtttatgttggagataaaaatgctcctcccttcaaaaatgagacagtattttagataggaaaggttatttatctgattacatgttttaaaattctgagcgtaaggttatatgtcaaatcctgtccatgggctgggcacagtggcccacacctgtgatcctagcactttggaaggctgagggggaggattgattgagcccaggaggtcaaggctacagtgaactatgatcacaccactgcacttcaacctgggcagcagagcgagaccctgtctcaaaaaataaaaataaattaacaaaaaaatctggtccatgtccatctcctcttagctgctaattcaattttagattagacacagtggacaaggacaagtatggtgagagtcctgtgatttctcaccagcttcctttccacataggccgctgcttctcttcttccaaggtttttccccgcttttgcctcctggaggttgtatcctgggtgttaggagactgggttccggacacattccccacagaaggatagcaggaccttagaagatctttttctttcttttcctggtttcctcttgtttgcaagagggttgaataggatggtctctaaaatcctgttgtttttctgggttatattaacccaggccataatgataagaacctgctctgaattcacaacatgtatttatacaacagcaatttaatatttcttattctgtggaatggctaggaagctctgctggtcttggttggatggttttttgtttgtttttttttgagacagggtctcgctttgtcgcccaggctggagtgcagtgacgccatcagctctctgcaacctccacttcccaggctcaagtgattctcttgctcagcctcccgagtagctgggactacagacacatgctactgcacccagctaatttctgtatttttagtagagatggggtttcaccatgttgcccaggctggtctcgacctcctgagctcaagtgatccacccaccttggtttcccaaagtgctgggattacaggtgtgagccaccgtgctcggctggtttttcttaaggtctcacctgggttcacttgtgtggctgaattcagctggtggtttggcaggggctggatgcagttacaacagaggatctgtctctttaaataactacccttcatccccaaagaggccagaccagctccttcacagtgctccaagagagcaagccatgacgcccaagcattttatccagcctctgcttgcttcagtttgctaaggtcccactggccaaagcagattacatggccaggtctaatgtcaatatgaagggggcactccacaaaagcgtgaacatgtaaggcatgactcatgagggtcactaatgtaatagtcaccacaacctccatgctaagttacctatattctccagtgaggatttctcaaggtggttttgttcatagtcttctaatagaattatttggaattatcagtttaatatgcttatgatgtatttcactggaaccatacaggttttgattcgcagagttgggagccctgggtagatactgaatcagactaagtttaatcacagaaattattcctacgtaagtctgatcttatgttttcaagatagcattgtaaaattcagagtatgttaccatccccctttgagacctctgctgtttttaataaatggaagcatttgggaatactatttggtaatagtttattaaaactacttcagagatattctggactttcatattagtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgcttttttaaatattttggggtctaaatacgtacttgaaattatgtcataaagctaaacacgtattctagaaatggtagagtacacttctagtaaaatatatatacaagttgttgatcatttgtattagctttttgaaattgctgaagacaggttaaaagcttaggtattaaacgttgaatttaaagctttaatctggtagaaacatctgtactctgattataattttctaatttttaagtatattagaaaatataattgtattgcatgagtagatagaagggaattataggaagtcagaattaatattttcaaaggggctgggcacagtggctcatgcctgtaattccagcactttgggaaaccaaggcaggaggattgctggaggtcaggagctcaagaccagcctaagcaacagagcgagaccccgtctctccaaaaaaaaaaaaaaaaaaagtaataataataataaacttaaaaatttgtaaaaagaatatttcagaggtccaatactttttgctgtgtgccctaagaaaatacttatttgaaagatggaatacttgctatctaatggaattgtgataggaattattttataaatcaaagatttgttttctgtgtcctctgtgtgcacaactctgtgctgggtgctagtaggtgtgtttaaagatgaggaaggagcgacatggtcctacccttagagtaactgtagaaacaagaagagaataagcaaatgacttaatactgacccaagaaaaacttttgatcccatatgcattgtaatagggcttttaaaaaattacataactgcttttttgtatagtgatagatcatacaatctaaaaataatatttcaagaatgaaatcactcttaagacagcccataatcagcttaactgtcaacatcagttttaggaaatgaaaggattgatgtttagtatcaaggatagcctatcaagaatgcatcaggcacaagaatagaagagtaacacagaaccaccacaggaagaaagaagcttttacagagagctgcttttttaacaaaaggcgtatgccctatttcatcagtctaaaccaccattactttaaaggtgttcttgtttccttgtttcatatactactaagagaaatgctagcaagccttcatcctgatatcagggatattaattaaaatgtgaaaaaaaaatttagaatcaataagtatggttgaagaaaaaaccacggaacaacttcatagttggattaaaaaaaaatcacaaggaatataatagtgggaagaaaatcttgtttccttgattttcatttcaatcctttggggctagctagccaactctggatttcaaattccaacttttcacacccgtcctcccgccccccacaaaaaaactttatcactgttgcctagaacaagctaacgtaaacatgtttattttgtcttttaattacttaaattgtgacctgattagagttttgtacttaaaacttgacatatctttgataataaattgaacttttaaaaaattcctattgcattaacatagttttcccagaagacccaaagtttcgttggaagattagaagagttttattttcatgcagcttaccaacacatgtgccttaactttctgaagtggcttttcttcacagtctgaacgtatcagagtctagggaatggtatgatagctttattcatcagttcatcaaacatttactgactgctatgttaggcattttgtttggcctgatactctattaaagcctcagaaaattgcttgaaatataaaacactagcataccccccagttttgggtaaacttaaagtaaatattaacataataaagtagatatgcacaatggtgatttgatagcttcagggatttactccagtttcatttttaaagtgtgtgtgtgtgtgtgtgtgtgtgtgtattcctttttttttttttttttttttttgagacagggtctagctctgttgtccaggctggagtgcagtggcatgatctcaggtcactgcaacctccaccacactggctcaggccattctcccacctcagcctcccgagtagctgggactacaggtgcatgccgccatacccagctaatttttggcatttttttgtagagagggaattttgccatgttgccgagggtggtgtccaactcctcagcagaaacgatccacccgcctcagcctcccaaagtgctgggattacaggtgtgagccaccatactcagccaaaaatgtatatatttctaataaggttttatgaattagcagtgatagaaatatttccatctgtaacaaaagactgctgtaggaaaatcaccctgacctactgaaaatgattcttataaaaaagattccccccctcaattaattgcagtataatccctctacttctttccatctttggcatcagaaaagtaacaaaggaaccttgttctttgaaagttgtcataagtttcccaagcaataaaggtctcaaatagaattacatccttaaagccataatcataagcagctagatttgcatttgttggagcagagtagaactgagcagttgctgcaggctgaccacttttcctggggtgctgggagggcagctagccaacacagacatgctgaaggacagtgagggtgacagaggaagtgagctcaggtacaccttgctggactgctgagcacatatggaagtcacactgaacattcagaaattatttttatggaattccatgctttcatagactcttttctgttgttgtggtatttgataaaattccctaaaagcattttttagagggccagctattaaaatctttaacagggaaaaggttgcttttcatagttagagtttatatgtgcatggtttgtgcatacagacatttgtctctttttcttccgtgtcctctcctctcccgcagtgaagttattcgaagtcattgaaactgaaaaaacactctacctaatcatggaatatgcaagtggaggtaagaacatttttatatatattgggttttttttctttctcccttttaaaaaaatacacaaccatactgcccatatgggtcatcattaaggtctcatttaacgtccagagccataatacgctaggatgagagtcggaaaagctgactcttagcacttctaggggttgccatgaagtgtttcactattagcattgttaattggtaatatctaaatacctggatattttttgtggtaaaacatgcatcactgaaaattatcgttaaaatcatttttaggcgcacagttcagtgacattagcatgttcacgttgccctcaccaccacccatgtccagaatgttttcattttctaacacgaaactctatacccattaaacactaactctccatttctccttctcccagtccttggcaaccattctcctttctgtctctatgaatttgactactcttggaacctcatacaagtggaattttacaggatttgtcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctactacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaggatttgtctttttgtgtctggctgattgatgcagcatagtgtcctcaaggttcatccatgctgtagcatgtgtcagaatttcattcctttttaaggccgaataatactccattgtgtgtgtgggacacacacctcacattttgtttatcttgagtatgtggctatttaaacatatgaatgcttagtctgtttgaaacaaatgtgtgctttggtttagatgcttttctttaccagattttaatgtcgctggtgtctgtcttccccaaggccagaaatgatggttacagtacacatcactagagtttccttaaaataaagattaatgactagtaactatttgcctatggttttgtaaaaatgtagacattttctgaaatgcgtgtttatagctgctgtcttttataatgatttgtattttatggttgagattgggctgggtttgtagtttgcgaccacacgtgagtttcattgtctgtgaagggcagaagctttcttgttcatctttttgtgtcccctgcctctagcacactgcctggcacacagcagatactcaacagataagaattagactgcatttaggaattataaactactgggtacacattctgttaaactctatcgtaattttatcattagcactttgatccatgttacaaaacctgaagatagaaagttggattatagtctcatttgagtgagtttaccattgaaaataaaaagattgtaaacctgttgtggaaaacaatgagttgtagtaagcatacctttgacaccacttttttatactcctaattcattattagttgtgtattttatactttatatatgtctagtttgggaatttcattgggattttcaaaacttcaggggtagtagaaagaggggaaggttaatttcaggaccaaaaagctttatggagttctaatactttctgtgggcaaacaacacagagtaatgttcatagccctcacgttgtacagcctctacagtgtacaaggtgctttctcttaccagatctcctttgaccttcacagcgactccatgctgtggccaggcagtgagcgatgggctttttacccatgaggaaatggaggctgggaagtctcactgtgggcgctctgggcctggaccgccagtgctctgacagcagatagcctttctagtttgttggtcagtcacggctttctgttcccatctgttttagctacccaggtcacagagattactcatataggggcaagacaaaaacatctaagagtcatccaggtttagtagaaagaggatgggctctggaagagacagacatggagtgaatccagccagtggccctcattggccatgtgacctggcaagtaacatgtgctgagctgagcttcacggtgagcataggaaccccctctgagggctcagtgcacttggcaacattgtaagagcctttaatcatttaatccaaggtggtggttctgtattaccttgggtttttttttttttctttttggagacagggtctcactctgttgcccaggctcaagtgcagtggcgccatctcagctcactgcaacctctgcttcctgggttcaagcaattctcctgcctcagcttcctgagtagctgggactgcaggcgcacaccacacctggctaatttttctaatttttatagagacaaggttttgccacattggccaggctggtcttgaactcctgacctcaagtgatccacctgccttggcctcccaaattgctgggattataggtgtgagccacagcacctggcctctttaacagtgttttgttgagtttattaaaacaatttccgggacatatgttttattgttgatgtgtttgccattgtgaaaagttttattaaattggccacccattccaccattgcatctcccccacccgccagcctgctgccttttgatttggtaaactcatagaattttagaattgaaaataatcttagaaattttagggcagcggtctaatttttacagatgaaactgaagctcagaaagtttgttctatgccaaggggtccatagctagttagtttcaggacctgaactagaactaagggctttctgaactggcctgtcagtgtccttccatccagccacctgttcctgcccaggcaggagagccactctttgcttcttgcttcttttatctctaataaatagccttagtatttttcagttcagctgcttaacctgaatgttaatacatttttaataaggaaaaaagatctggattgaattcctggtttaaaagttgaactcctgaattataatttagtaattatgagtgtgacatatggttccacaaatctcttaagaggtttatattgaattcaaatttagaaaaaaaaatctgtcaattatattgacagacttggattttatctgtgttactctacaacagctggtaggcttaatcgtttaatttttttaagtgaaaactctcctatatgatattcactcatgtttagttgtttttgcttattaaccacttgttttgacattgtgtgcttttctgcaaataggtcattcgcatagaaaatgctgacactttaccgagctgacatttaacttcataattcatcatagttaagtgaattgtgtcgtgtaaacttgacagtatgtaatgccttttaaaagatcattatgcaggctgggcacggtggctcacgcgtgtaatcccagcactttgggaggccaagacgggcagatcacttgaggccaggagttcgagaccagcctggccaacgtggtgaaacccccatctctactaaaaatacaaaaattagccgggtgtggtgacgcacgcctgtaatcccagctactcaggaggctgaggcacgagaattgcttgaacgttggaggcagaggttgcagtgagccaagatcgggccactgcactacagcctgggcaacagcacaactctgtctcaaaaaaaaaaaaaaaaaagcattatgcaatcaagtaataacatgaaaatatttgtgcccattcattatgtaaaatttattctttcagagttagggttaataagagtttcaaagtcagataattgtgtaattcatgatgactttcaagtatcaaaatattttagtttaatattttcactaagctgatggaggtattccttatttgtatgaagtaaagatgtttcctgaaaacacttatatctaattttctaaattagtattcttttctattgatttcagaggtggtgattctttattctacattgataagcagttgacagtgctaataatatattccttgaagtgtcacctttcttccctaaataattaatgttgtgtaaactgccacctaggcgtgcatcagctggttctgttgttttcacctccattgtatcctgagctcctacttctcaccaccactgtgcttcccactctagtccccgtcactttcatgattggtttgattattgtactgatctccctcttggtcttcctgtcccttcccgtcattggaagcctcttccccgctagcagccagtgatccttttaagaggtcagtcttttttcatctctgcttctcatctcacttgtagtagagccagagtcctcaccacggcctacaggactcttcctagcctcatgaactaccctcttcccctcattcacacttctccagccctgtggccttcttgctctttctcttaattactgtggaatcttaccccagataactacattgtccacaccctcaagtagtcagcaaaacacaagggtgtgcacacacaggctcacttgtctgtctctcctactttttctccacagcacttactgtcctctgatacactatatgtttattcatttattgccccctcccccaactagaatgtaaactctatgaggaaaaggatcttgtgttcactgctgcatctccccagaacctacctagaacagtgccttgcagttagtagacattcaggaaatatttgttgaatgaatgaatatactcaggaaatgctttgttgtcataatcctgcagtgaggatgtcctcttctaacacaaataacttcatccattttaattttctgttttaattgcttagtttttattaaagcctattgaaaacgctctttaaaataagagttatataatttaagtatagggaatttaattttaaggcttttcttcagcttaaagattttgttggtgaatttaaatgcctgtagttaaagccagcttagttcaaattccacatatttctggctaactttatatctatatttaaaaattagagcattgctaaaagtgaaacatcaatttatgggaaaattaatactcagaagtaggatttctacttacttttatttctctcacctataggtgaagtatttgactatttggttgcacatggcaggatgaaggaaaaagaagcaagatctaaatttagacaggtatgaattaatgtgtctttactatgtcaatttgataatttatctcacttaaaccctgaagcaaacaagtgtttgcctccataaatgcttataaggcctgttggatggcaggggttggccattcaattcaacaaaaattgatgaagaacttttcatacctaaggcactgtgctggaggcagccatggttctattcctagctttgtaatgggagcattagtcttatacttaaccttccctttttacaactgagccttaaaaatctagagcctttcaaaaacacctgtgattacattaattaaagccatttcagagtttttagcaagcagaatgtcagaaccccaaaattcattattagctttgtctgacataaaccaaggccaagtgtaactgaaactgttaattagtaactttacttcttgctttgtttttactctgctttttaaagagactcgggttttaataagcaggttttaagcaaacaggttacttgactctcctgtctttattaataataattactgttatctattgaccatgccacacactgagataagtactttaccaacattaaggtaaatcttacagctgccttgtgagttaaggactgttatatccatttgctaaaaaataagacaactgagacatgggaagattaaataacttgcccagaattgcctttctttttttctttttcccccttattgtggagaacggggtctcgctgtattgcccaggcaggtcccagaattgcctttcaagtaggagacctgccatagactcagagtcccaaaccctctgaccccaaaactcagatttgcaatcattatattgtgctattatttagactgggaatcagcaaacttctgtaaagggccagatagtgaacattttaggctttgtgggccacactgtctctgtcgcaactatttaactctcttgttgtagcttagaagcagtcgtaggctgggtgcgatggctcatgcctgtaatcccagcactttgggaggctgaggtgggcggatcacctgagggtcaggagttcgagaccagcctggtcaacatggtgaaaaccctgtctctacaaaaacacaaaaattagccgggcatgatggcaggtgcctgtaatcccagctactggggaggctgaggcaggagaatcgcttgaacctgggaggcggaaattgtagtgagccaagaccgtaccattgcacttcagcctgggtgacagagactccatctcaaaaaaaaaaaaaaaaaaaaaaaagaagcagctgtagacaataccaaatgaatgaacgtgactgtgttccaacaaaactttatttacaaaaacagggatgggccggatgtagccagaggccataatttgccaacccctgatttagacgaaggaaaggagcagtgcttcactgcttttaaattaattctgtattctcacaaggcctacattgaaatggaattatagcctcattttttcttagaacctttatattttgttttattcatatacagggttgtcaagctggacagactattaaagttcaagtctcctttgatttgcttagtctgatgtttacatttgtaagtgataggacttattaagtttcttataaacgttgcttatattttgctgttgcttaaatactaatggtactttgaattcaaatctagtaaaaccaaagtaaaaatcagctttggctatcatttaacttctctgatcctgtttttaaagctataaaaaaaaaagaaattattcttgatgaattccatagttctttgcaattctaatataatttgattgtatggtctattaaaggaaattcagatttttattagaaaaaaagtgtgtggctctttccataactgtactcttaatttttataaattggccacctaaaagggaacctttttttgcttcatacaatttacattccttcctactcagatgaatctgacttgcaaacatgtgtgaagatggcttattgactatgaggaaggggctggtgtcacccagcaagagcttactaacctaaatcttgaggaaattactctaatttttattgtaaattccctgcagaaattctgaagcctttatttgaggagcctgttagttggactaggaaagatggtttgtatgtatgtgttttttcaattagcaaattgatttagagtgctttagaattgaccccttcttccatggtatttgcctaaaacagctccattagacttggaaggatacgcatgatattggtgtttccacttttctgtttcaaatgctgtggtttctttgttttttcgtttttgagatggagtctccctctgtcaccaaggctggagtgcagtggcccgatctcagctcactgcaacctccgcctcccaggttcaagcaattctcctgcctcagcctcccaagtagctgggattacaagtgtgcaccaccacgcccagctaattttttattttttttttttgtgattttagtagagacaaggtttcaccagtgttggccaggctggtctcagactcctgatctcaagtgatctgccctcctcagcctcccaaaatgctgggattacagatgtgagccatcgtaatgtggcctcaatttctgtgctttctaggagcttataagtcataattactttgactaagtaaaacaagtttttctatttatgacaaaaaggaaggtatgccacacacaaagtacactgtgtgtgatcccttttccatattcatcaccagatgggttttccccttctgcttccttcaccatgcccatcctagttactgcttatgacattttaattttttggttgagctcattcttttccaagaaaaagaatagatttccagctccatctttttttttttttttttttttttttttttttgagacaaatctcgctttgtcgcccaggctggagtgcagtggcgcgatctcggctcactgcaagctccgccccctgggttcacgccattcttctgcctcagcctcccaagtagctgggaatacagatgcctgccactacgcccggctaattttttgtatatttagtagagacaggatttcactgtgttagtcaggatggtctcgatctcctgacttcgtgatccacccgcctcggcctcccaaagtgctgggattacaggcgtgagccacgcgcccggcacagctccatcttttttacttacctctttattggtgggctggtaatattgatgatttgacgctcttttatgtatgattgaaagtgaattaggttaaatcatagtttaacctaaataacatctgttagaaatcaccatttctacctggtaatagaatgcaaaaaaagcagtaagttcaagttgagtcttttcagcttattgtggcatcaggttagctttgagctgttttggagctaaagagagagagaaatcctttgatctctttgagaaagggcaggaaatcaaatctgcttcaaaagcagaatttgaaaataacctgtaagagaaatctcaatatgaggaaaaactaatataaattctgaatgagaaaaggaaaaagattagataaaatttacctgtgtcctaggtgacaaagctatgactttgttttgggaaaacaaagctattttacttttcaagttttcatgctgactgaatagaacaatagtgataaatccaaagtaacagatgctctaaaacccgttttttggcattggaatttttgtaccttttgttaattataagtgggtctgatattctgaatgttaattttaaataatgaagctgcttagtaaagtgctgatttttgttatcatctcatcctaaccccagttcaccttgtccttgctgcttattctgaaccaaaatattatacagccctctgagattttatgtccacgggtgggtccatggggcttagagctaagagttgatgatgatttggaggaaccaacagtaattttattataacctcagttttgtgtatatgtaatcatatgtgtctaaatatacatgcagaataccaaagaaaagactagatgcaagtacagcaaaatagcaagacatgttacctctgcttagtggtaatgcaggaatatatttctatagacttttctgtatttcctgaaatttctacaatgaccatataaagctttaatattagaagactttttttaagtgaccgtaagtgtgaaatttcagtaaaacaattgtttaatcataggcatgactgcaagttgactaaataaaagcatactatttactgaaagtgggaggaatccttaatagtgcacgtagtagttttcatagttcacgtacgtcgcaacattcattcctccattttaataaaggaagaggaaactgaccctcagagaagttaactaacttttgctttccatgatccacatcagttagaaggaagactgttgcagggagcaggctgagaagggcacttacagaagagagccaacctggattaacacctgggtatgggcaactctctaaccgctggtttggtttggagttgactctatgggtatggaaaggttgcaccaggccgggcgcagtggctcacacctgtaatcctagcactttgggaggctgagactggcggatcacctgaggtcaggagttcgagaccagcctggccaacgtggtgaaaccccatctctactaaaaatacgaaattggccgggcatggtggtgcacacttgtaatcccagctactcgggagactgaggcaggagaactgcttgaacctgggacggggaggttgcagtgagccaagatcatgccattgcactctagcctgggtgacagaacgagactctgttaaaaaaaaaaaaaaaaaagttgcaccagagccatcggagcctaggggcagccagggtcctccagatctaggcaatttgttgggtcctggcactacactgtaagtggaatgtcaacggatagggtccaaaaagagacttcagttaaaacagtagaaaacggaagaacgtcctcacctatttgtttttgccctcacccatgaatttctccagactggaaagttcaaggcataggaaaattgtttttagaaatccacacggacattcgagcgtatactgagtattcaatatgtgtgaacattaacaaagttattttcatcttaattacgaatctgcaccagtgatgactgactctgcgtctctcctattcagattgtgtctgcagttcaatactgccatcagaaacggatcgtacatcgagacctcaaggtgagtagaagtgcctcactcagtgtatgctctgtctgtttgtgtgcagttctctcagtggtcattacacaaatgaggtatagattagccttattagcattttttaaaatcccacaataattgaatcctcttaatcaagttatgggaaagagcattaaaaataaagaaaaataaaggttattgaaagtattttacatttcagttacggtgactggtggttgatctctggagaacagtcatcacacagccaaacaaatgggggcctccagaaatgtatggtcacgcccacagcatcctcagtgccacccggcattcatttctgctgctttcatcagtattctctcccgttaacagcagtgcctgtttgagacctctttcaaggtcctcagcctctgccctcactctggcataggatgaggtttcgtatcgcacagagaaaatagaaacaccatgcagaaactctcattttctaccaggccctcaaacctagcagcacctacccccatccatcacttctttcctcctgttacaggaaagtggggtgcttctgctctgagctctgggtcctgattccctctgggggctgtgctctgtctgatgcctcttttctctccgtttgtttattcactctccttctctactggcttttcaccagcagcatttacacatgctcaagtctatataccttttttttttttaactaaaaagccatgcctgttcctctttcagatacacgctttttctctcttccctttcatagccatatttctctaaacatttcctagattctgtgtcttaacttggcactcactttcactctccccttacgtaattgccattgacttgcttgttctctgcacccgcccctagagcattcacattcactctctcaactgcagtggccaactgtatgctgatggccccaaatccattcctacggccagagcactcttctgggatccaggacccagctgagcaaagggtgtcttcatataagcatcccttgggtgcagcaggttcaaatcctataaacatgaatgttcacttctcattcaggtgtctgatgtccctcaagtgccttactctcctgtgctacccactcagtcaccaggtccttttgctgctgtgttccaagtatctcttaagctcactcttttatgtccctgttacactatccaaggccagaccaccattatctcataggtgattccgacactactttcttatatgttcttctctgtttctagtgcctcttcctcccatgtatgttttctacactgcacccaaaatggtcttttaaggaaacacaaataagatggtcatttctctgcttgaacaactcttcattggcttcccattgctcttacgatgaaaacccaaacttctcaagtacaatcctttgtgattaagccctgaccatctccccagccccctctacacatctctatctcacatactgtctttcaatttcttgtgtgaaacatactgtgtctcacatgggttctcagactctttattctgcctgaaatacccctcatcaacacatccattatgatcagatgcaccttctggtgctttgatttcacttcatctgggaagccattcacacctttcagtgccaacccacaactccctgtgcctcttcagttatggcattttgtctcaggacagctgcttatcattctccttcttcccttctaaactgtgagctactgagggtagggctttatctgtcttgttcatcattatccatccagacactaatatagcatctgctgtggagtagccacataggaaatgtttcttaaagtgactgtgatttgtctcctttttttttttttttttttttttgagacggagtctcactttgttgccctggctagagtgcagtggtgcgatctctgctcactgcaacctccacctcgcaggttcaagcgattctcctgcctcagcctctcaagtagctgggattacaggcgcccaccaccatgcccagctaattttttgtatttttagtagagatggggcttcaccatgttggccagactggtctcgaactcctgacctcaggtgatccacccgcctcagcctcccaaagtgctgtgattacaggcgtgagccaccgcacccagccatgatttgactcttgaatgaggtttaggattctcccctcctcattaacagccgttttatagctatttagccgtttttatgaaatgcccctttttaaaaaaagttatttatgttttgagacagggttttactctgtcacccaggctggagtgcagtggcacagtcatagctcactgcagcctcaaactcccaggcttaagaggtcctcctacctcagccttccaagtagctgggattgcagatgtgtgccaccatacccagctaatttttaaaaatcttttgtagagaaagggtctcactatgttgcccaagctggtcttgaactcctgggctcaagtgagccactgtacctggccctgccccatattattcttgttttttggttttgagatggagtattgctctgtcgcccaggctggagtgcagtggcacgatcttggctcactgcaacctctgcctcccgagttcaagcaattctcctgcctcagcctcctgagtagctgggattacaggtgtgtaccaccacacccagctgatttttgtatttttagtaaagacagggtatcaccatgttggccaggctggtcttgaactcctggcctcagatgattcgtccacctcggcctcccaaagtgctgggatcataggtgtgagccaccgtgcccagcccccatattattattattaattgaaaaactcaaggcttttcttgatcttgggacattgatgtttaaattagtgctagaattaatctgtacttcatgtttgttattgttaatattataaaataaggagttctgacttgtctcctgtttttttctctagaaagaatgttttcacattaattaggaggtaacttcatatcattacagaaagcttttctaaaatgcctaatcctgtcataattctaattctattttggctaaatttcatttttgtcttgatgttttccctctaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggtataagaagctgcacccatgtacttcactaaactaaaagaagtttcctaatattacatggcttaatatttttaacattatatcagtgcggggggtttcagggggttttttgttgtgttttgttaactaaacctaaaggttgacttactcgttttctttcctctgtacctctccaaaggaactgagagagagagtattaagagggaaatacagaattcccttctacatgtctacagactgtgaaaaccttctcaaacgtttcctggtgctaaatccaattaaacgcggcactctagaggtaatcatgtaggtggaaacaagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaataggtaatcactccatgcctgcatgttcatgtgtttttgtctaagtaacatatttctgttttgactcatgtctgtgcctaaaatgtgaataatggaaagttaagcacaagttatatgaacagtttatctgttctgtcatatttaggaacgtaactacctgcagtttcctataatggcacccagtaactctgaaacaagtgcccatttatgttacaaaatatatgtaatatgtcatcttttaggtcaaatgaaaattattttaccctacaaaagaatgatttctggccgggcgtggtggctcacgcctgtaatcccagcactttgggaggccaaggcgggcagatcacctgaggtcgggaggtcgaggccagcctgaccaacatggagaaaccccatctctactaaaactacaaaattagccaggcacggtggctcatgcctgtaatcccagctactcgggaggctgaggcaggagaattgcttgaatctgggaggtggaggttgcggtgagccaagatcgcgccattgcactccagcctgggcaacaagagtgaaactccgtctcaaaaaaaaaaaaaaaaaaaggatgatttcttacccaaacaaaacacataaactgtattatgcccttcttttagatattatggtgggaatgggatattcacaagaagaaattcaagaatctcttagtaagatgaaatacgatgaaatcacagctacatatttgttattggggagaaaatcttcagaggtaagagtaatcagaaagagctgaaataccctgtatgtaattattagtttatataaactgttttcttagtttttatcttttgaatatttgtaacatttgatacatcattttttagatttacttgcaaatagcaaatctaaatcctatgactattataagctattttaacttaacccttaatgatggatattggccaggcgtggtggctcatgcctgtaatcccagcactttgggaggccaaggcggacagatcacttgagaccaggagttcgagaccagactggccaacatagggaaactctgtctctgctaaaacaaacaaacaaacaaaaaattagctgggcgtgttggcgcttgcctgtaatccctgctccttgggaggctgaggcaagagaactgcttgaccctgagaggcagaggttgcggtgagccaggatcacgccactgcactccagcctgggtgacagagcgagactctgtctcaaaaaaaaaaaaaaaaaaaaaaaagatggatgttgtcataaacctggtctttcataaattaacctgtagtcattaatagcttagaaatgacgtaaagcatcagatgaagtaaatacaacatttaaagttatttgagaaagcctggaaagaaaatcataaataccttacctttagtgtctttccagccgtcagaaaactacttttgcttgagtttagggttgtcatttttgtacgttgtgattcctcctctctctgaatgaacggtttatgagaggtctgtgttaatgaaaagtttaacttcctaataagccatttgggttcgtgttgtggtttgctctgtttttctcattttctcttagctggatgctagtgattccagttctagcagcaatctttcacttgctaaggttaggccgagcagtgatctcaacaacagtactggccagtctcctcaccacaaagtgcagagaagtgtttcttcaagccaaaagcaaagacgctacagtgaccatggtaagttttggagtatcccagtgccttctcttagagtccaggcaagaggtctcctagcactgggaagcattctcttgctcagagcctggcttgatgtcctttcttggcattgctttctttctttcttcttttttttttttttttttttttttttttgagacagagtctcactctgttgcccaggctggagtggagtggcacgattttggctcactgcaacctccacctcccaggttcaagcgattctcctgcctcagcctcctgaatagctgggactacaggtgtgtaccaccatgcctggctaagttttgtatttttagtagagacggggtttcaccacatttggccaggctggtcttcagctcctggccttaagtgatccacctgccttggcctcccagagcgctggaattacaggcatgagccaccgtgcctggccagcattttttcttagtgttcctgcaggtgctgccatgattacatattacttcaaggctcttatcttctttatacatgcagtagatttttgctggataaagcttagttgagtggaaaccttaccatttgcccttctagaacctctgctttaatctgtagttttcctttttttttttttttttaaatggagatgggggtctcgctatgttgcccaagctggtctcaaactcccaagttcaaactattctctcaccacagccttctaaagtgctaggattacagacgtgagccaccatgcccagcgctagaactgggcgctgtaccgaactgaatagaactgctagtctgtagttctattcactctcttcacctctgcattggatttactttgtagagtagcactgtccagtagaactttctgagatgattacagttttgtgtatctgtgctgtccagtcaagaagctactggccacttgtggctatcaagtacttgaactgaggaaatgatttttaccttttttatttctatttattttttattatttttatttatttatttatttatttatttttcagatggaatctggctctgtcgcccaggctggaatgcagtggcatgatcttggctcactgcaacctccacctcccaggtcccagcagttctcctgcctcagcctcctgagtagctgggattacaggcatgcacaaccacacccggctaatttttgtatttttaatagagacagggtttcaccatattggctaggctggtcttgaacttgggagctcaagcaatccactcaccttggcctccaaaagtgatgggattacaggtgtgagccaccgcgcctggccttatttatttgtttattttttgagatggaattttgctcttgttacccaggctggagtgcaatggcatgatctcggctcactgcaacctcagcctccgaagtagctgggactataggcacacaccaccacacctggccaatattgtatttttagtagagacgggatttcaccatgttggccaggctggtctagaactcctgacctcaggtgatccacccaccttggcctcccaaagtgctggattacacgtgtgagtctgtaattggcctggctgatttttacccttttaaaattttcctggccggacatggtggctcatgcctgtaattccagcaccttgggaggccgaggcgtgtggatcactaggtcaggagttcgagactagcctgaccaacgtggtgaaaccccatctctactaaaaataaaaaaattacctgggcatggtggtgtgtgcctgtaattccagctactcaggaggctgaggtaggagaatcgcttgaacctgggaggcagaggttgcagtgagccaagatcgtgtgactgcactccagcctagtgacagagtgagagtccatctcaaaaaaaaaaaaaaaaatttgtacttaagtgtaatatatagccagttgtggccagtaactctcataatagacaggacagccctggagaatatatggaacctcagttttgccttaattggtttaaatgttgtactgtgtcattctcatccatactcttgctgttagtgtggttaagccactctcccttttaaacttcacctagaagccagtcctttatgagacataagactcccagtgggtaggcttaccaggctctacagttgctctgccttcaaggcagcctgtgtgtcagagtcctgaggctagcgtgtgtgtttacttgcccataactataaatgttaacattgcagatatttcctttaattctactattccaggattcaggaactaaatctatttttttttttttttttgagatggagtttcactcttgtcacccaggctggagtgcaatagcgcgatctcggctcactgcaacctccgcctcctgggttctagcaattctcctgcctcagcctcccgagtagctgggactacaggcatgcatcaccatgcccagctaatttttttatttttagtagagacggggtttcaccacatttggccaggctggtcccgaactcctgaactcaggtgatccatccacctcagcctcccaaagtgctcggattacaggcatgagtcactgcgctcggcctcattttatttctcttctctggacattttccatcttaatactttcatcttgagatttgacacttaggactgcacagggcattttaggtgtggacagctttgattttgtactaaaaatgattacacttggcttgatttccatttctcttccttctgttgcttgcctttctacatggtttagactgaagcaacagtgtactaatatcactagtaaaccatctacagtgcctgctattctagggtgtaactgagagctcagaactcattctcacatcaggatttgtgctcctagcatttgtaggtgacgtgttgatctaggtctgccttttttgtgttcatgttagtcactaacaaggggggtttctagtgcttatggaccacatggcaattaaatgcccatatattgccctgaaaccatctggtttaacttgtccctcaatcctagaagaaacctgacaatgggattttcacatttctctaaggaatatgttagtaagttattccttaagcacatagattccatccagattattagtgcctttttccccccagctcaattttagagataaaaagagctttagacatggtattgtacactcaccaaacctctgttttatccctaaatagaccaagagagattaccaagtctcccaaggttacatagtaaatgagaaacacctggggcagagctcaggcctgctggtccaagccctgtgttttttctccactgaagcacctcattggagtagctttttcataatcctcatctttcttggaatttctgaaggcaggcaagcctgtatagccgggctaactttcacctcatcctcctgcctcgtctcacctctcccttcccttttccttgcctgtggatgctgacctctgcatgggtgcctgcttctctaaagctacgatgtaatctgtagctgtccttcctcgtttgagacccacatgtgaacaccccatatgtgtgcactttttctgcgaatggtgatcatctgattttcaaggggttctttagcttgttttttaaaaaatgaaaaaaaaaatcactgtttactaatcaatgagtggtattggggcaatttggtagttctcagaaaaaaaattaatttggatcaatttctcacatcttatacaaggatgaattctaattggagttaagatacaaatatagggctgggcgcagtggctcatgcctgtaatcccagcactttgggagtccgaggcaggtggatcacgaggtcaggagatcgagaccatcctggctaacatggtgaaaccctgtctctactaaaaaatagaaaaaattagccaggcgtggtggtgggcacctatagtcccagctactcaggaggctgaggcaggagaatggatgaacccgggaggcggagcttgcagtgagccgagatcgagccactgcactccagcctgggcgacagagcgagactccgtctcaaaaaaaaaaaaaaaaaagatgtaaataaaactccagaaatattgaaagaaaccttgggattatttgctttgtaacttggactggtgaaggtgtttctgtcaccccaaacaccaaacccatgaaataaaagacttacaaatttgattacataaaaatgaaatttctggccggtcgcataatcccagcactttgggaggccgaggtgggcggatcacgaggtcaggagatcgagaacatcctggctaacacggtgaaaccctgtgtctactaaaaatacaaaaacaaaatcagctgagcttggtgtcaagtgcctgtagtcctagctgctcaggaggctgaggcaggagaatggcgtgaacccgggaggtggagcttgcagtgagccaagatcatgccactgcactccagcctgggccaacagagcgaggctccatctcaaaaaaaaaaaaaaaaaaatgaaatttctgtgtgacacatccataccatggactactactcacaataaaaaggaacaggctgggcgcggtggctcacgcctgtaatcccaacactttgagaggccgaggcaggcagatcacgaggtcaagagatcgagaccatctggccaacatggtgaaaccccgtctctactaaaattacaaaaaattagccgggcatggtggcaggcgcctgtagtcccagctacttgtgaggctgaggcaggagaatcgcttgaacctgggaggtggaggttgcagtgagccaagattgagccactgcactccacagcctggccacagagcgagactccgtctcgaaaaaaaaaaaaaggaacaaactatgatgtgcacaactcagatggatctcaagggaattatactgcgtgaaagtacacaaaaggttacattccatggatgcccattcatataacattcttgaaatgacagaattctagagatggcgagcaggttagcggttgcaggggtttagcaaaagggagagtaagagggaagtggctgtggctatgaaagggtagtctacagggtctttgagatggaaatgttctgaatcttgactgatggtgaccacatgaatctgaacatgtaataaaagagtatagaatgagatacacaaacatacaaattagtgcaagtaaaactggggaaatctgaacgaggtcagtggattagatcaaggtctgtttctcttcagaatctcaaatcttaaaaggttttgtattttctaaacacaaataaaagctggaaagccaatcagtagtaatctgaaagttcacaatgtcagtagacgtctcatggtattgggaagaaagataagcattgaggctaatatcaccctatgcttgattaagtttttgttttatatgttaaaatcactaaaccgaaagcttagttgttgttctcccacaaataaaattaagccctcatttacttttaattcagttccaaataggtttgccatttagatttttgtccaagaactaactcctccccactcccggtttttgtttgtttgttttttaaatttatttattgagacaggttctcactctgtcacccaagccacatgtagcctcaaactcttgagctgaagccatcctcccacctcagtctcccaaagtgttggaattacaagcatgaactaccacacacctcccacctttaatatatctaaaatataaattctcttctgccttagaaaaaacaggctgggcgcagtagctcatgcctgtaatcacagcactttgggaggccaaggtgggtggatcacgaggtcaggagatcgagaccatcctggctaacactgtgaaaccccgtctctactaaaaaaaaaaaaaaaaatacaaaaaaaaaaaattagttggcatgcgcctgtagtttcagctactccggaggctgaggcgggagaatcccttgaacccagtaggcagtggttacagtgagccgcgattgcgccactgcactccagcctgggcgagagagctagactccgtctcgaaaaagaaaaaacaagcatttgactctgtcttttaagattaccactggattatcatatctgaggcatatactagttatcatgttcatttccaagattctttgccctctgaatctcctgtgctgctattggagtctctatatggtttactacaggacattagtctgtcatccacatgtccctaggcacatgtccctggacacactcctcctggagtggcaggaatgactagtgacctccaccgacttcctccctgtcgcttgcatgattcctctgcttctacaccttcccctgtctactcaactacaccttcccctgtctactcaaactccggtttatctagaagattatgagtgcttttaaaaagatccaagataaaacttcaaaagaagtggcccataaaatctatacttttctcttccaaaaggtgatggcatctctcctacaaaagaggatgtaattcactcagatgtacaagatgaactggttcattctgcttgttacgtatgcatctaattagtttgaatctatgcagtaccaccaccttaagatgtttccaaaggacaactctaaactcttactattaaaaaaaaaatgttttaagtagaaaggagtattaagtgaaatttcaatattgaattcattgcataaggcaaacattagatataagtgggaaacatcttagaggattttactgttttacattttttaggtgaatagcaaccttagatcatcttacaaaatatggttactgtcacaaaataaaacttgaaactatattcagtcatttaaaaaatgaactctttattttagctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtgtaagtgttgttgaactatagagtggtcttagggtggtagggttggaaccagctagacaccaggtgttcattttactcctgtggtctctcgtactggaatgccctctctactaggcagccatgcccaatcttaacttacagaaatcctacctgctgcattgtaggtatttattgttgacactctcttagttcattcttgctgctgtaacaaaatacctgagactggctaatttataaagaaaagacatttatttcttacaattctggaggctgagaagtccaagatgaaggcaccaacaagttccgtgtctggcaagggccctgttctctgcttccaacatgatgccttggtgctggcatcctccagaggagacaaatgctgtgttgtcatgtggctgaagggacagaaggggtgaactcaccccctcaagcccttctataaaacactaatctggccgggtgcggtggctcacgcctgtaatctcagcactttgggaggccgaggtgggtagatcacgaggtcaggagttcaagaccagcctggccaagatggtgaaacgccatctctactaaaaatacaaaaattagctgggcgtggtggcaggcacctgtaatcccagctgctcaggaggctgaggtagagaattgcttgaactcaggaggcagaggttacagtgagccgagatcgcatcactgcactctagcctggcgacagagcgagactccttctcaaaaaaaaaaaaaaagatactaatcccttcatgaaggcggagccctcgtggcctaaacacctaaaagactcatctccaaatactgttttctcctatgggagataaagcttaaacatgagttttggaggggacacattcagagcatagcacacccaccatagacactagatggtgataggtcctttatttcaaggcctggttccagttatttcggacacctgctgagccttaggttgtcaggtgctgagacatggaaagacctcacagtctaacaggaagtgaatgaaaacagtgacagtgcagacggaagcctacgtgcacacacggggaggtctgactgccagtgccccaaagatgtggtgttcacactgagtcttcaaagagctctagtgatgaagagtgttggctgagttcttaccatgtgccaaggaccatgctcagtgctttttcatggattagctacattttaaggtgaaaaaaaagttgggtaattgcctaaaattacactgccaacctgaatccagctcttaatccctatctgtaacaaaatctccccagtaagtagataatatttactaaattaaattgaatccattcagcttcagaaacttttttctgtgtattgaagtatgttctatctaacctaacatattaaagaatttgcagagaagtaaacaatcttaagattattctgtaagcacgtttttccctacaaaattaacaatgatgcagccctgcctccaactccagaaaaaccctggactgaggaggctgtggagaaaccctgttgctctctgaaagcccttcattgttccattctggggactgggtgcatgaaggaccccaaggggctttgcatgtttcatcctctgaccttatgcttagtcgaagtaaaccctgtgtgaaaagtttattttggcctccaaatgccatacagtaggattattgtttccatactcctgcagttaaaattccgtctccaacgtttgttgacagttaccagagaagatgagggcattattccctgccttcatgacttctcttcccctttgctcttgtctacacacgctgcccttctgaaagtgaatcatgagtattttcagtccacccatactaaattacttacaaaggaaaaaaggtagttagcaacattattattttctcccatgagtctttgggatttctctgtagatggtctgctcaagctgtagtaaaagtgactgctctatctttgtttaaaaattatctgataaaattccatagctatggccaggcacggtggctcacacccgtaatccctgcactgtgggaggccaaagtgggcggatcacttgaggtcaggagttcaagaacagcctggccaacatggtgaaatcccatctctactaaaaatacaaaaattagccgggtatagtggcgtgctcctgtaatcctagctattcgggaggctgaggcaggagaattgctttaaccgagaagatggaggttgcagtgagctgagattgtgtcattgcactccagcctgggtaacagagcgagactccatctcaaaaaataaaaaaaaaagtccatagctgtgacttgttccttgctttttagttttttgttttggaagttaaattcatgtgaatccacatgacaatgattaaccattttaaagtgggcaatgcggtggcatttggtacactcacagtattgtgcagccaacacctgtctttagtttcagaactttttcagctccccagaaggagcatctgtttaggctgggcacagtggctaacccctataatctcagcgctttgggaggctgaggtgggaggatcacttgagcccaagagtctgagatcagcctgggcaccagagtgagacctcatctctacaaaaaaaattaaaaagaaaatagctgagcgtgatgatgcacacctgtagtaccagctacttgagagcttgagaggctcaggtgggaagatcatttcagcccaagaggttgaggctgcagtgagtcatggtcacatcaccatattccagcctgggcaacagagcaagaccctgtccttaaaaaaaaaaaaaaaagtggccgggcgcagtggctcacgcctgtaatcccagcactttgggaggctgaagtgggcagatcacaaggtcaggcgttcaagaccagcctggccatcatggtgaaaccccatctctactaaaaatacaaaaattagccaggcatggtggcgggcacctgtaatcccagctactcgggaggctaaggcaggagaatcgattgaacccaggacgcagaagttgcagtgagccgagatggtgccactgcactccagcctgggcgaaaaagcgaggctccatctcaaaaaaaaaaaaaaaaagaacacctgtatcccttaagtaatcactttccattcctcctctcccctctgcccccctcccttccccctcattccctggcaaccaccagtctgtgttctgtctctggatttgcctgttctgaatattttatataaatggaaccatttcacatgtatccttttgtgtctacttctttctttgactcagcataatgttttcatggttcatccaatttgtagcatgtattttcttttccctttttttttttttgagatggcatttcgctcctgttgcccagagtgcaatggcacgatcttggctcactgcaaactccacctcccgggttcaagcgattctcctgcctcagcctcctgagtagctgggattacatgcgtgcgccaccatgcctggataattttgtatttttagtagagacggggtttctccatgttggtcagtctggtctcgaactcccgacctcaggtgatccacccgcctcggcctcccaaagcgctgggattacaggcgtgagccactgtgcccagcctgcagcatgtattagtactttgtttcttttgggggtaatattccattctgtatatatactacaatttaactgttcatctgttgatggacatttatattatttccatgtattggttaaaatgaataatgctactataaacaattgtgtacaaatttctatgtggacttaaatgttttaatttctttccttctttcttggggaggagacggtctcactctgtcacctaggctaaagtacaatggtgcaaacacggctcattgcaacttcgacctcccagacccaagtgatcctcccacctcagcctcccaaatagctgataccacaggcatgcatcaccatgcctggcttattttttctgtttgtttgttgtggtagagatgaggtctccctatgtagcccagccaggctggtctcaaactcctaggctcaagcagacatcctgcctcagcctcccaaagtgctgggattataggtgttagcctctgcacctggctgtgttttcatttttcctgggtatatatttaggaataaaattgttgagtaatatggtaactccatgtttaattttttgagaaactgccaaactgttttcctcacaactgtaccattttatccagcaatagtgagagtccctgttttcttcacattctttctaacaattaataattattttattatttaaagctttcctagcaggtatgaagtagtacctcatgcttttgatttgcatttctttaatgaccaatgatattgggcatcttttcatgtgtttcttggccatacgtatagcttttttttttttttttttttttgagactgagttttgctcttgttacacaggctggagtgcaatggtgcgatctcagctcaccgcaacctctacctcccaggtttaagtgattctcctacctcagcctcctggcctcctgagtagctgggattacaggcatgcaccaccacagccagctaattttgtatttttagcagagacgggttttctccatgttggtcaggctggtctcgaactcctcacctcaggagatccgcccacctctgcctcccaaagtattgggattacaggtgtgagctaccgcgcccagccgttgtatagcttttttaaagaaatatctattgaaggtgccgattttaaaattaggttgtcaggccgggcacctcaggaggctgaggcaggagaatcgcttgaacccaggagggggaggttgcagtgagccgagatcgcaccgctgcattccagcatggcgacagagcaacactgcatctcaaaaaagaaaaaaaaaattagccaaatgtggtggcacatgcctgtattcccagctacttgggaggctgtggtgggaggattgcttgatcctgggaggcagagccaagattgctccactgcactccagcctgggtgacagagtaagaccttgcctcaaaaaacaagtaaataaaagactggcattcctatttatgtagataagttcattttttctcattgtactgtatttaccaaataaatttaagacaaaaatgcccttttttatagagtaacacagcatctggtggaatgacacgacgaaatacttatgtttgcagtgagagaactacagctgatagacactcagtgattcagaatggcaaagaaaacaggtaggagattctacctgtttgtaagaaaagttgtttttcccaagagaaatggaagcatgttatttactgctttgttcttataatcattttcaaattaaaactgtaagtattctctgaaggtaagttaaatttgtatactaatttttagcaagatactagaattctaaattctttttgttgtccagagcatcatcctcctgcctggctgtgtatgatgattaaaaggcttgagttaaacccagggggtttcctagaggaagtagatagtaagctgtggttatgttgtagaacagtgaataaggaaatggagattgtcttgtgctcattaataacttgaacaaaagccgaaagtgggggaagataaggacgtgaggcagagagtcatacctcaggagaatgtacagcaccaggtagcattaaaggtccgcagtttaccaaagggtccagatggctgagtctaaatagaaacactggagaagccaagagaagtggaaagtccagccttctgaatgcttttaatttggctacatagcaagcatacataggatgagcgtgactttaaaaagacaatgatgttacatgtcaataaggagagcatcctatcatgcacatgattttcttggggttttgaaataaaataagtagagtcagtaaaatgggattggataggtgtagagactctgaggtggggttagtctgggtggagagaaaagagaagttagattggtagagaatagctaaatatgctatattctgttcagaacaaatttcccaggctggcatggattttccttctttgtttttggaagagcagtaagtgtacatcattcttttaacttgaacattgtttgcatcagaattgttctgacatttactttctgcagttacggtgtgaggttctgtttcttaatcctaacctatgtttgatctcattagtcaaacaaaatgtttgatcactacattttgtgacagcctaatcaaaaattctctcctccttcatccttagttccaaactgcttatcacttccctgttccataggccacttaggattgagttgatatgaggagtaacatttgttctgtaagattatggttattattcgttgaatttttagcaatatttacattctcttgttctcttttatgactcgtgtgtgtgtgtgtgtgtttcaacattgtcttttcttatgattaaaaactactaagaacttgagtatagcagctggggtagatagtttacagataatgattgatataggtatttcttttttttttttttttttttttttttgagacagagtctcactctgtcacccaggctggagtgcagtggcctgatctcggctcactgcaagctccgcctcccgggttcacgccattctcctgcctcagcctcccgagtagctgggactacaggcgcctgccaccactcccaggtaattttttgtatttttagtagagacggggtttcaccatgttagccaggatggtctcgatctcctgaccttgtgatccacccacctcggcctcccaaagtgctgggattacaggcgtgagccaccgtacccagccaggtatttcttaatagtagtctactctctggtagatttgtattatagttcagttcttaactttcaaatttcttctagttcaaaagtgacttaatagaaaatatcaatagaagacttaattagaagtttctggtgttacagattgtagtctacaggactacagaaatgtttcatggtcaggcacagtggctcacacctgtaatcccagcactctgggaggccaaggcaggtggatcacttgaggtcaggagttcgtgaccagcctggccaacatggtgaaaccccgtctctactaaaaatacgaaaattaaccatgtgtggtggcacgcgcctgtagtcccagctaccagggagactgaggcaggagaattacttgaacccaggaggcagagtttgcagtgagctgagatcgcgccactgcagtccagcctggacaacagagcaagactcatctaaaaaaaaaaaaagttgtttcattacctttactacttctaaattctgaaaatgcactacccagctccttctgaactttaggatatgtgactgtctgaggtgcagagtcagtctcctcaagggtgttaagactaagatctgctctctgcttccatcctgtgctacacgtatcatacaccaggcacatgcatatatgcctgtgtcttctgattctcttttcctaaaatttttcgtttcactctttggaaataatatttaagacttctttaatttctttggcaatatttcctttctgcattccccctggagacacctgccttgttggggccaactctttcatatcctgacctgtctcgttgcttctcttagcatcagtcattgaaatactttgcttctgaaggtgtcgtctttctctttagtcaaagagagtctcaccgccaaaccttaaaagacagggcccattgttttaataatatttggactttcctttcctatcttataaatgaattaaaagactggaaaattattgggtttaacttctttagttaaggcactaaatgtgacagctttcccttaaaattgatgcttgagtcttcagtgagatacaattagctttccctgcacagatgacttcttcggcaaattgttccttttccctctcttcacccacccatatatcttatttcttcactaatttaaaatatgagtgagctgtaggatgcctggacctatgttaacttctgaaacaaacatgttaagttccaattttagccttaaatattttcgacatttagccttaaatgttttcttctttatatgagtgttcatacggaatttcaacatgagaataatgatggctgattttttaaaaactgtgtgaaggtttaaaccagagactccacatatcttaagcccttactaccttcaaaatcctactgtaaacaggatattttaaaggcttactaaatgcaaggctttttctcgtcataggcaatataattaattttaattattttttcttttgaaaattagttttattaattggttcttactaggccaatctttgttttatcagctttcctgtgggaacaataaagttaatgacacagggagcataggttagggccagttgttactttggcacaaacacctgtgattcgttttctgagactagttttaaactggtcgtgctgaaggccagcccactttctgctgtaattattctgccttctgatgttattctcgaaaaatggccagattccaggcgtgactaatggttggtgtaaactaggcatgagaaggtttgattacaccttcaattgtatgattctatcatgatggtataggtttgcagtgagtcttaaaccacatagcactgacacgtagtgagtgctcaaacaaatgttagctttcattattaattatagactgttcagacaaggttatgcagaattttcttagtttgcactgactaaacctaatctttcaagttaataatgttgctaaaccacctacatagcagagacactctgctcctacgatttcatatgctttagatacccggacgacactgtttagactacttcatttaaagaccccagagaagtgacgtgctggtgttacagtaatgcaaacagaatcttttctttttttttttttctttttttctttttttttctgcgatggagtctcgctcttttacccaggctagagtgcaatggcacgatctcgggtcactgcaacctccatctcccgggttcatgcagttcttctgcctcagcctcccagtagctgggattacaggcacacaccaccacacctggctgatttttgtatttttaatagaaatggggtttcactaggccaggctggtctcaaattcctgacttcaagtgatccacctgccttggcctcccaaagtgctgtgattacaggcatgagccactgcaccaggcccagaatctttcaaataaattttagatattggatattactgtaaagtttcaaaattgtgaagtggcttattattttatccactttaccctgcatcaagtcacatagagattgagcagagaaggattgaggacacttagcgtatgtatctttggactacatataaaagttgctttttttaggctgggcgcggtggctcccacctgtaatcccagcattttaggaggctgaggcaggtggatcatgaggtcaggagatcaagaccatcctgaccaacatggtgaaaccctgtctaaaaattagctgggcgtggtggcatgcgcctgtagtcccagctacttgggaagctgaggcaggagaatcacttgaacccaggaggcagaggttgcagtgagccgagatagcgccactgcactccagcctggcaacagagcaagactctgtctcaaaaacaaaaaaaaagggctgagcacagtggcttacgcctgtaatcccagcactttgcgaagctgaggtgggcggatcacctgaggtcaggagtttgagaccagcctgaccaacatggagaaaccccatctctactaaaaatacaaaaaaaaaaaaaaaaattagccaggcatggtggcgcatgcctataatcccagctacttgggaggccgaggcaggagaatcgcttgaacccaggaggcagaggttgcggtgagccaagattgcaccattgcactccagcctgggcaacaagagcaaaactccatctcaaagaaaaaaaaaaaaggctgcttttttttttttttttttttttttaagatggatggagtcttgcagtgtggcccaggctgcagtacagtggctagtcacagacatgatcatagtgtactgtagccttgaactcctgggctcaaatgatcctcctgtgttggcttcttgagtagctgggactacaggcatggaccaccacacctggctaattttttattttttgtagagatgaagtcttcccatgttacccaggctggtctcaaattcctggcctcaagggatcctccagtctcagccttccaaaacactaggtttacaggcatgagccaccatgcctgtccttggactatatttttaattctgcttttgcccagtcacttgagtatgcttttaatcagcagccaatacatttcttatcagaatgttctgataggggctagaggtcatagcaacaaattcaaagtgcctatcctttagtaaccttaagtggattaatgttttagaaaagatagtcaagactgggcacagtggctcacaagccctgtcatcccagcacttcgggaggcctagacaggaagatcacttgaggccaagagttcaaggtcagcctggacaaagtagcctgagacccccgtctctataaaaatatatatattttttaattttaaaagatagtcatgaatacaaaacagttgggaagattaataggaactctcttcatgcaacttgaattttaagaaaaacattgctatttctatcaattaaggtttaaatgtagaccaggcatgatggctcacgccaccatgtaatcccagcactttgggaggccatgacaggaggattgcttgaacccaggagttcaagaccagcctgggcaacatggtaaaattccatctctaccaaaaatacaaaaaaattagctgggtgccaggcacagtgcctcacacctataatcccagcactttgggaggccgaggcaagtggatcacctggggtcgggagttcaagaccagcctggccaacatggtgaaaccccatctctactaaaaatacaaaaattagctaggtgtggtggtacatgccggtagtcccagctatttgggaggctgaggcaggaggatggtttgagcctgggagatggaggttgtagtgagccgagatcacaccattgtattccagcctggacggtagagccagacccagtctcaaaaaaataaaaataaaaaaattaatgtaatacagctactatgaacccacaaaaactttaaaaaaattttttaattattaaaaaaatgtaatgctgctactgttttgcttatgtagattgtgggctagaataggaaataaaactatcatttttaacacttttctggggggaaatattattcgaatttcataacaattagcttgatgaccttttagaatatatatgtagaccattgtgatgttggggctgcctgttgtaaataggatttttgtgagcttgattgtacaaaattgaaatttgcaaacatcttactgagtttactgtttccttctgggtgttaggcctactgtagaaatcagaaaaatcggaaatattttgttgcttgctttgtgaaactcatgatgtgacatggattaaatttctaaaaagtttatttaattgcctttaaaattagtatgtcaaaaagtttatttatttatttatttatttattttaatttgaaacagtctctctctgtcacccagactggagtttagtggcatgatctcagctcactgcagctaccacccccgggtttaaacgattcttatacctcagcctcctgagtagctaggattacaggggcccgccaccacacccaactaatttttgtatttttagtagagatgggtttttgccatgttggccaggctggtctggaactcctggcctcaagcaatccacccgcctcagcctcccaaagtgctgggattacaggcgtgggccaccacgccagcctcaagttaataatttataatcccagcactttgggaggccaagacgggcggattgcctaagctcaggagttccagaccagcctgggccatgacgaaaccctatctctacaaaatttttttttttaatttataatgagaaaataaatttacatttccttcttaggtctctagaggatccattttttttctgcaaagcatctgtccacaccctcttaccatgcttgtatgccttaaagatctagcttggcctgtcagcagtgtgcttcattgggaatcgatgcagcaccctcctgcctgcaagctgactaaaagccttttccttctccaaagactttgggaccatttgtattcaccagggaaagggtcaaacaactcctgcatcttcttcccctgcttttcttggcacatctactgatactagctcctaatttgggcaagaaaaaagtcaacaactggaggtagagtgtgttgaccctggactcaccctgaaaggtaagggcacaagagatagttgtatttagctgtatcttgttagaaaaatacatttgtgtagccaggcgcggtggctcacacctgtaatcccagcactttgggaggctgagccgggtggatcacgaggtcaggagttcaagaccaccctggctaacatggtgaaatcccgtctctacgaaaaatacaaaaaattagccgggcgtggtggtgggtgcctgtagtcccagctacttgggagactgaggcaggagaatggcgtgaacccaggaggcagagcttgcagtgagcagagatcacactgcactccagcctgggcgacagagtgagactccgtctcaaaaaaaaaaaaataaataacacttgtgtgcattcatgtgtacgtgtgtctgtacacatgtacaagaaacaaccgagcatttctttaaaaaccttagtcagttagaactgtctctgttgcaggtgacagaaaacccagtctaaacaggcttaaatataaaagggctgttagttcatataactaaaaaaagtccagggctagagttacggtccatctgcttctgcctccttggccgtagttccatgattgggctcggcaccatcagacataacttcttcccacacacagctgtgctcaagcagaagccctcaggtggtctccttgatctgtgtggggcctagagttgcttccaccacagcaaaatctcattattgttgctgcaggaaaagaatggatactgagtggcagaaatacgaaactggataaatttttgcctttataagacatttgtttccagtccttctcagactgtataaattctcccaagtcagagagcagaattctcaaacaaaaatgcagggacagaaccaggcacagtggctcacaaggcctataatcccagcactttgggaggctgaggcagaaggatcagttgaacccaggagttcaagaccagcctagccatcatagtgagacaccatctctacaaaaaatttaaaaattagccaggcatagtggcacactcctgtggctgagataggaggatcgcttgaccccaggaggttgaggctgcagcaagctgtgatagtgccactgcactctagcctgggtgaatacagcaagaccctgtctccaaaaataaaaatttaaataaaaatgttttaattcagggacaagcagttcttgattttaaagacgtatctgccttatgttggggctatcagaattccagttgctaattgattaatctgctctgttaggagaacgtttgttgaatacctgccctgccaggctttctgcttacactggtggggggcacattgacaagattttgggctgtgttttcagggacctccagcagagaagggtcactaggatacaatgtggcatgcatgagctaaaaacagaagtgatttaactctcagagggaaaatggatcagataacacttcatggagatgacgacatctggttcatttttgaagagtgaatagaaagatcccagccctccataccaagagaataactcctgcaaacattttctgacctggtgcctgaccaatggaccacacatcatcaggaaggctagaaagttgagttccaggagggaatgatagaaggcaaagcctagagagatggcaggggccagacttcaggggcctggggatgtgtacttgcactccaagtcgaggagactgaactttttaccaaagacttggtgttctgtagaagtatgagcagatgagtgacaagatctggtttatatgttaagaagttctcagctgtaaggtgaatagattggaggtgttggggcaaaggcaggggacccagtgaagacaaggagcgaggctctatactgaggccctggtagaagtggagcagatgggccacctgaagagctactaggaagttgacaccaataagatgtcgttagtctgtgtatggggagtgagggaaaggaagaacttgccagtttccaggttttaatccttccaaaggatttctgcagaaagacactggaagagctgtattcctacttatccttaaaggaaagaaactgcccttgaattccaaggacatgattactgagctggaattccaaataatgtgtcccagtgagactcctgggggtagttttgtccggtaactgtgtgtgttagatgaaactgcagacttccagccactctatcttaccatgtctgttaacagttaatttgctctgatgaatttgcccatcttggagaagggggctctgctgactgttttttatcttggagtaaatgtcctttgattaggaaggttctagactatattgttaaaacaacattggaaggctgggcatggtggctcatgcctgtaatcccaacactttgggaggccaaggcaggcgtatcgtttgagcccaggagttcaagaccagcctgggcaacatgacaaaactctctctactaaaaatacaaaattagccaggcatggtggagtgcgcctgtattcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttactaattcatttaaaatacatcagtgcgggccgggtgtggtggctcacacttataatcccaacactttggaaggccaaggcgggaggatcacttgaagccacaaatttaagaccagcctggataatatagcgagaccctgtctctacaaaaaaaataaataaagaaaaaataaaatatgtcagtgtgttttgggaacaggttgagagcatagcatgctcatattatatattcattttaccacttagatttgaattgaggcatctcttagaataggttttattttgtgcataccctcagaggacattgtccctctcatagaaacagatattcaaacatgtaatctgctattttattttaaggtaatagatttttatgattactgtttggaaaaaaaaaaagcaactataggttagcagttgctccagaatctccaaaacaagcttaggagatttttattctttaccagaaatgagatggcttgggaggaaggtgtgtgcattacacacaggttgctctgtggtcactgctccttcatactgtgtttctgcctctgcctgaacccaaacccctcccagcctgacagaaatgttcgcttacgcagctagccctgcctcagtttgtacatctacctgtcggctgagacatcagaagtcgatgtccatgtcagcctctgggcaccccaagatgatgttacctccaatagacagtgaaggagataacttcaaggctatgtaagaaaaatgcacattctttgtgaaactaatgtgtacccactgcttcttaattttgtgctgtggattttatagtctgagattttgttacagttgtccacaaggcgtccttcctccatgtgattttagttaagcacatcttttgtcatgatgtcctcggttgtgtattgtgtgtcttcgtgccttcgcgtactacaaaatgtataagaagttcctgctcctcccaagttgctttcagcatgtggaattttatacatatatcatttgtttacttccaaaactttttagttgcctgttcttcagttacgccagcatatcctttatttctttcgtattggcacagttctctatgtaagcaatttgagagggaagcaaaggggaaaagtttgagttagctgttctctgtcctagaatttccctgcattaatcttgtccttgaaaatatatataatactggtcccttaaactccatgaggctttgtctcattatgtattgttcttttggtaccctttcccacttaacttaccttttgctcctaagtcctataaaataccccttggatctggattttttatacccgattttctccactgtgtataaaaggtatattgtgactgtaaatttttgtatatcatgttctgagagcttcttactttctgatctcatagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggtaagtgctaggtgctggttgttttggagtgaacacatagagcaaaaggaaagatgtcttttttgttgtgtgaagccactgctacctggatgcttttcagtctgccttcagctcatggttttctggttttatatatatctaactttatactttaaaacctttaaagtagaaattgtagagctcagagtcttcataacactaaaagttaactagcatttaggaggtttttgttactgttctttaattattgttccttttgctcacgtatctgtctgcatggcatgttcgttgttgttgagcaggcagacctcgagttctggtgtggggtggggggctggcactctgtaacaatcagcaggaaagaccatgcatgtctttcataatcatctccagccccagaggaaagagacagcttctcttttctcactttattgttgttaaggagcagtaaatttcttaagagtccaaatcttgaaagtttctctctcagtcttagtaatttatattgagagcaaggtaatgtccttaaatggtatagttttggagataaaatctctggtttattatcaaaaaataatgttactattattaagttatttttattaaatgctgcatgattcttggctgatggtcctggaaattttttaaaatgttccatgtgtctagtaggctagcatctggggcctcagtaaactctcaagggtcctttgagattaacttcatttccgtaaccttgttacctgttacaaaagcccagaaatactggctgcttcaagaggaaaaagaaaggataccactttgaaccgtaaacaatagtgaaaggcacctttccgagaaggagcccaggaaacccaagagcccctgcagtttcaggacatccttggagaaatgttttgaaattaagcctagctgtggatgagtctgtctgtggtatcttgcaggtttgcctaggacggaccctcttatttgtcatctgtagcttacaggacagcagtaggagtctttcccgagtctgaaatgatcagtaccctcctctgtttttctgcattccctatggcctatagcctattacttcatttcactccatctccattatttaaactaagctaaatgtaatcttgtattcgatcatctgaaacttcggtgagtcacattaaagtctgatctacttattattaggacatggaatagattagggagtattcctttttttttttttttttaattttttttttttttttgagacggagtctcactgtcgccaaggctggagtgcagtggtgcaatcttggctaacttcaacctccgcctagattagggaggatctctgacatccattagcattaactagaagtcagacgcgtcagaaggtttctatttaccctcttactcacttcttagcccctttattaagccacctcattttaaactgggcaaaacagaatcagccaaagagctttgccaggtttgggacacccattcatgaccagccagcaagagagacagtgagttcaatctgagaagagtctggtgactcccagaataaaccattccttcctggccagccgtggtggttcatgcttgtaatcccagcactttgggaggccaaggcgggtggatctcctgaagtcaggagtttgagaccagcctgaccaatatggtgaaaccccatctctactaaaaatacaaaaattagccaggcatggtggtgggcgcctggagtcccagctacccaggaggctgagacaggagaattgcttgaacccggaaggcagaggttgcagtgagccgagatcgtaccactgcactctagtctgggtgacaaagtgagactgtgtctcaaaaaaaaaaaaaaaaaaactttgagtttatttttcttctttgtactcttttttcagtcattttaagactagtattgggctgggccggatggctcatgcctgtaatctcagcactttgggaggccaagaggggcggatcacctggggtcaggagtttgagacaggcctggccaacatggcaaaaccccatctctactaaaaatacaaaaattagccaggggtggtggcgctcgcctgtagtcccagctactctggaggctgagccaggagaatcgcttgaacctgggaggcggaggttgcatctagccaagatcgcgccgctgcactccagcctgggtgatgacagagcgagactccatctcaaaaaaaaaaaaaaaaaaagactagcattgattggccaggcatggtggctcacgcctgtaatcccagcactttgggaggccgaggcaggtggatcacctgaggtcgggaatttgagaccatcctagccaacatggagaaacccagtctctactaaaaatacaaaattagccgggcatggtggcacatgcctgtaatcccagggagactgaggcaggagaatcacttgaacctgggaggcagaggttgtggtgagccgaggtcacgccattgcactccagcctgggcaacaacagtgaaactctgtctcaaaaaaaaaaaaaaaaaaaagactagcattgattttattacatgtatataatggaaaaaaggaaacaagattatcattgataaaaatatcagctacctctttttttttccccacagagtctcactttatcgcccaggctggagtgcagtggcatgatctcagcccacggcaatcttcgccttccaggttcaagtgattcctgtgcttcagcctcccgagtggctgggactacaggcgcccaccatcgcgcctggctaatttttgtatttttagtagagacccggttttatcatgttggccaggctggtcttgaactgctgacctcaagtgatccaccgcgcccagccaaagctaccattatttgaatgcttattatgtgctaaggtagatgtctatatacatagatacagtcatattcattttatacatataaatatgtatgtacattatatatatgcatattttatgtataaaatgagtatcatatatatacacttatatgtgtgaaatgagtatatttatacacatgtacaagtgtgcacacacactcatttaatttaatctccatagtccaccccattttgtaaaagaaactgaaggtgaagtttggagagattaaggcacatattttaaaaagtatcagggcctggtgcagtggcttacgcctgtaatcccagcactttgggaggccaaggcaggtagatcaggtagatcactcaaggtcaggagttcaagaccagcctggccaacatggtgaaaccccatctctactaaaaatacaaaaattagcttgatgttgtggcacatgcttgtaattccagctatttggaagggtgaggcaagaggatggcttgaacccaggaggcgtaggttgcagagagccaagatcacaccattgcactccagcctgggcgacagattgacactccatctcaaaaaaaaaaaaaagtatcaggctgagccaggtctatctgaccagactctgcccttttagccactacactgtgctccctttagaaaaaacagttgcaggcgtgacagttgcattacatttatttcatatatttgaattaaaattggagactcaggcttgttgtttaaaaaaattctaagtggtcatcttgtttacaatttccaggctatttccacacccccagatttttgcagaaagatagtcttttatcctgtcttgttaaagtttattaactgaggtctgttgtctcccttagtgctatacttaatcagctactgacagtttgttcttaaaaacaatcaaaatccttgctagagtggttgaaagttcttatcctcctttagcaataattggtaggattaaaattgcattgcctgaaaggctgaggtgtttgcacttagatgctgcaagggagacctggtgtggccaggtctggagagggctgcagtcaggaagcctgcactctgcttggagagcacatggctttggagagctatgggctatttgtagtcgggagcaaaactctctctccttaggatcaggcctggccttgctcagagactgcagagtcacccataccctgcaggcagaacagccaggcacacgcaagtgcctctgccctcaggttgatccatgttgccatgggcagtgtgaaggcctcctcctgcagctgcctccttcctctttatacctcaagggattataggaggaaaagttaagaaaaacacttctatagtaattgaccagtaaccctgatttttccggtggaagattaggaaatgtccaggcaccatggctcatgcctataatcccagcactttgggaggctgagccacatggatcacttgagcccaggagttcaagaccagcctggacaacataatgagaccccatctctactttttttttttttgagacggagtctcgctctgtcacccaggctggagtgcagtggcacgatcttggttcactgcagtgtctgcctcctgggttcaagcgattatcctgcctcagcctccccagtagctgggactacaggtgcatgtcaccacgcccagctaatttttgtatttttagtagagacagggtttcaccatgttggccaggctggtcacaaactcctgacctcaagtgatccgcccacctcagcctcccaaagtgctgggattacaggcatgagccaccacacccagccttttatttttttaataaaaagaaaaaaagttgggaaatgggccaggcactgtacatggctcatgccagtaatcctgacactttgggggaaggtgaggcaggaggatcatttgaagccaggagttcaaggctgacctgggcaacataatgagacccccatctctacaaaaacattttttaattagccaggagtggtggtgcatgcctgtagtcccagctacttgagaggctgaggcaggaggattgctcaaacccaggagtttgaggttacagtgagctatgatcacaccactgtactccagcctgggtgattgagcaagaccttgtctctaaataaataaatatttaaaagtaaaagaaaattaggaaacgaaaatatatcttaaagacttttaatcattttcaactaaaatattttggataatactgccttatatttaggcagtatatattaaagattttcacatgcatgattgtactgtcgatgaccctgctgtatactactgatctgattatgaagtggttggcagttatttatagtagttagactttttttaaattggtagattaatacctaaagcaatgccaaagttatcccaaccaaggatttcattaatttagtcattcagcagatatagatgactgcctgctatgtacagttacagaactggactttacaaatagaaattaacaaactcagcctatttttgcccagggaagctgatcgcattgatcataaaaacctcattcgtagtttgaaaaatattttgtcagattattttcagcacaacctgcacatctccttaaatttttttaatgaccagagttaccccttttaaatagaattcttcgtgtttattacataaaagtaaaattcatactgttgtcttgacacttagtttttattcattttgagatctaagactgaaaagtctacttgtttaaatccccaatcacctatttttttcttaaaaagtgatttatgtcataccactgtagcaaataatatgttaatgtttgtttcattttcctgaaagaagtaatgatttttacttagtggttaaatattttataatgaaatttttaatgtttatgtaataaggcaagatttttgttcataaggtattctgaagaaaattgaaaaatgttttattactagtacattgcaaatgtcttgtcacttctttaacataagacataaattttatcttagaaagtgtatctggccattgcagtggctcatgcctgtaatcccaacactctgggaggccgaggtgggctgatcacttgaggccaggagttcgagaccagactggccaacatggcaaaaccctatctctactgaaaatatagaaattaactgggcatggtggcgcgcgcctgtgattccagctactcaggagactgaggcacaagaattgcttcaacccgggaggcataggttgcattgagctgagattgcaccactgcactgtgacagagtgagactctgtctttaaaaaaaaaaaaaagtgtgtccatctgaagaacttttaattacagctaatgtcaatatgtactgctaaaccttttcttacttttttttgatatattaaaagatcacatactcatttaattacctgtaataattttactttttcaacaaatgtcagcatttctttgttcattggccagagaaggaaccctgctttgttttttttctttctctctgtaattgattagattttctgtttaatttgtgcgagttatttttgttaatttttttttttttttacttaatttcttttagaaacatgtcattcaggtttatcaaaaggtaggatttatatatacacatttatttttcaatcctcactcccaaatggctcctgcaattaacattaggtttggctttctggccctgttttttccttataaactaaactttctgctgataactaaatacttaattccttgaaaggaaattgaaaagaaatagattaactctgtcaggcattttaaagggactatggtacccatgcaacaaaaggctgatgcatgctctgtgtattttctttctttggtagaattatttagcatccaaataattctgtcttcatactaataacacttagcatgctcctgtttgaagaatgagatgctcagtaatgttaatgtacaattaatgattatccacaggcatgcaaaaggtaagtattagttgtgttatttttatttcactgaggatggaattagcaaaaggctttaaaatgacaggaaaattagctaatacagaaaacaagcataaaattcaaagctacagcctcatttgatttggctttttcagaaattaaaatgtgaacagctgcgtagcagaaatgttttaatattttcagagttgaaagccactttccagcaaccactgaagaaagagtatctcattatttttacttaaagcactacagaaagtggtgttctgattttattaatattttttaggccaggcatggtggcttatgcctgtaatcccagcactttgggcggatcacttgagcccaggagttcaagaccatcctggacaacatggcaaaaccccgcctctacaaataatataaaaattagccgggcatggtggcacgcatctgtggtcccagctactcaggaggctgaggcaggaggatcacctgagccctgggaggtcaaggttgcagtgagccatgatcatgccactgtgctccagcctaggggagtgagaccctgcctcaaaaaagaaaaacatattttttgatggtgataatcaagaaaccaaaaatattgctttcttaatgcacacatgaggcaggaaatctttcctgaagggctacattgtacctgtgcctctcaagtcaccagaaggccaagctgcaggtcaaaactgcgggaaaagcactttcttcctgttggcagttccattctattattattttttaattgatcttcccacttgtctgatttttccttggacagaacaggtaataactgaatatagaatccagctgatagcctcattggcttttaattggaaacccattatactgtgtggcacaattagaaagtgagaataaccccattctgaggccgagtgtgctcaggctgaagagccagcaggagtgcccgctgtgcgtgcgtggtgtgcggtgtgtgcagcagtgtgtgcagtgtgcagcgtgcagcggtatggcatgcaatgtgtgtgatgtatgcagtgtgcagcatggagctggcccctgtgcacacccctgcagccttgtggaagaaggtagcgctggctcagtcaaatgagaggaagagttttcataagcccggctggtgtttaaaacgtgttttggctttgttcattttatggtgttggtgttggtattggtggtcatgtactggcatgtaagatttcttttctctttccctcttctctctgcttctacattctgttcattgaggcttccaactgaatatgagaggaacgggagatatgagggctcaaggtgagggaaatgatttttacttaaaatttttttcaggtgtttacttcatttctgtggcagaggcgactattttctgaatgttccctactgtattcctgctgtctctgtaggagttacgtagagagggtggccacaagggggcgccagcctgccatgagcaccgtccagatccagcttggcctccgctctacatttgtgtttgtgttcaaagcacggcgaggccttcagccttcctgcctgggcgttaacagcctttggaggtctgggttgggtagcagtgctcagagaaataagccctcagttcatcactgacccctcacatggttctcttcacaaggaataaaagcaaagtacttaatagaatgtccatatttcaaactagatatgttttcttctaagaatggtgattatatagttgagtgttttgcttttcttttttttttttctgagacacggtgtcgctctgtcacccagtctggagtgtagtggcgtgatcagggcttactcgagttcccaggcttatgcgatcctcccacctcagcctcctgagtatctggaaccacaggcactgccaccatgctggctaatttttgtattttctgtagagatgggggtctcgccatgttggccgggctggtctcaaactcctaggctcaagtgaacctcccacctcaacctcccaaagtgctgggatgacagacatgagcccccgcacccagccttgcttttccattttgtatagttatcattgcatggatttgaggggaggcaatcaccaggtagccttaggactctatgtcccttgttctaggtctcttccacttgtgccctttttttatgccagtcaccagcaggctatttcaggtcctcattcaccgtttgtccttttggtctttctaaaagcccgcttctggtcatatgacctttctgaattaaaaccttcagtgacctccactatttcacctggccacgtccctgcgaggccctgagtggcgtggtccaggctgccccagcagccccagctctgctgccccatcaaggcagagcactagggtgagtgccaggcagcattccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatcccacagacacatcctgtactttcctacctcccctttggctgtgatcccctctactcaaaacaaacactcttccctatcttcattgcattttgttgaaatcccatggctcttcatagctctcctcagatgcaggcccacccccacccgtgctgtttcctccttgtctcatcctgcctgtcacgttctcctgctcggcgggctccacctcttctgctgccctctaggagatggccagcctttcctgtgctgccactgttgtctcaccttacagtcttcctggctccagatgagtttgagagcttttgcttatctttgtaacccatttagtatctaacgtggcattttatacataggaagcttctctcatcagtattggtggatgtgaaccaaattgaatactggcaggttggtgacacggagagctatgtgcatatgcaaaagctgtagcccctcacctctggttagttggccataggatggagtgtacttaaggtacatagactattttactcccaagaatgctaggcactcactgtcttaattgaggccaccagatacacacatgagaatataaataacggcttgtggcaataatgactaaatgccaaggagtggctggtaaaccgcggtgttccctagagaccccggcctgggctctacttaggctgcctcttggacatcagaccaaggcttacattctgaatccacagggcatccacatgggtggtgtcagtcccccacagacagagaagtgtcccgttgcatttttccatctattccagtagtaagattgtgtcatttgagattttctttaactgtataattggacgtttaattaacaaaccagagaggaggaaaaacaatgaggtgggtagagcatcatgttcagcctcagggctgtacagcaaagcaattttagactgcggatgttgagtctccagttaccctgagtgccagttacagtgattcacatctgaaagaacagtactgcaggagagggacagcccagggtggatgggtggggtgggcaggagctggctgccaactccttccctgagctgggcctgcagagccctgaggagtggggcatgctgtcctttttgcctgatttccaaggattctgcttaacgaattacttcgttcattttagtaagcacaggtggctggtgaagattttccagctaggtagatctttttgtgtgtggcttatgacttttagggggtgagggaagaaaatagacgaaaatagacttagttacaaatgtgagtctgtgcaggaaaatgtggaggtcagtcgttagttgtgttgtatcaaagacgtgaatgaggaactagctgaagtgtaagaggttgattttcctgtacgattaaaaataaacctgcctctatgcatttcagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggcgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaatcttgcattgtctcctaatgctgtatttaacacatcctcaagttgagcagaagtaatgtgtatgaaggcttggggccacgtggaccttcgcaggggtcccagcattttgtgattaccagcatattttttctcccaaggcaataaagagagaagatggccctcatggtgacccaagaaggaagggaatccagagcagctgcagcttaaccctgggagttgtggcacagccctatggagaaacaccaggtcttgacagttctgggttggttctctgtgaagtatgtaaatttcctttctcctttcttgtgattcagtacatgaatcagacctgcagcttttttccaacacctacatggttgtgtaggggtaatgagctcataactcattgtgttgctttattctcacagggaagttgtcacactgattggtgtgctattctgggttctgggtttgttgttggtcagagtatgaaagtctggaggccggacacagtggctcacacctgtgaacccagcacttttgggaggctgaggctggaggaacattgagtctggtagttcaggaccagcttggacaacatggtaagaccccatgtcttcaaaaaataaaaacatgggccaggggcggtggctcacgcctgtaatcccagcaatttgggaggctgaggcaggcggatcacaaggtaaggagatcaagaccaacttggctaacacggtgaaaccccgtctctactaaaaatacaaaaaaattagccgggcatggtggcgggcacctgtagttccagctacttgggaggctgaggcaggagaatggcgtgaacccgggaggggagcttgcggtgagccgagatcgcgccactgcactccagcctgggcgctagagcaagactccgtctcaaaaaaataataataataaaataaataaataataaaaacatcagccaagtgtggtggcacacctgtggtcccagctcttcgggatgctgaggtgggaggcttgagcccaggaggttgaagctgcagtgaactgtgattgtgcacagcactccagcttgggcaacagaatgagaccctgtctcaaaaaaaaaagaaagaaaaaggaaaaagtctggacagtcaatcagaaatattgttgtctctctctagcgtgggcaaggcactgttgtgattgagatcctcagcaaaacagacacctctctccttgagcctgacattctaggcagtggataaacaagtaagttacctagtatggagcacagcagcacgtgtgagagagcgcagagcaggcacgggtttcatcagcactctgggtgtgaagagtgctgcttgggcagaggcctgggtgggcacgttcacacagatttctggggaagagcactgcttgggcctgaggcctgagtgcatggcgtgcctggagcagagtgtagagatgcttctcctacatggcagcagctgaggggatgacaagggccttgtggccttgggctttcagaggatcaccaggcagctatgtttggaactcactgaaatggggcaaggagaagctgggaaagccgcctggaggctctcagcagtaatacaggcaagaggtagtgcagccttgggtgaggatgggccttggcgctgatggtggttgggttttggacatgttttgaaataagaggcaactgcattttccctggagttggatatgaggtgagtagagccaaggacagcttcatgatttttgatctgaacagcaaaaaggccggaattgctgtttgttgagatgcggaatgtggctggggagatgtttgggaacaggaggggaagaagatgaagagagcaagctggaatgtgctgagtttgaagtccctttaaacactgagtggcaacgtctagtgggcagttggataaacatgtgaggggttcggccaggcgcagtggctcactcctgtaatcccagcacgttgggaggccgaggtgggtggatcacgaggtgaggagatcgagaccat

SEQ ID NO: 12086 - DNA, 152582 bp, Human
  misc_feature (1)...(152582): n = A,T,C or G
cccatcgcctgtgttaccacctgagctctgcctcctgtcagatcaccagcaccgttagatccattagattcttttttttaaattgctgctgcacaaattaaggcattagattctcataggaacatgaaccctatcatgaactgcacactccttatgagaatctaatgcctgatgacctgtcactgtctcccgtcactcccagatgagaacatctagttgcaggaaaacaagctcagggctcccactgattcctacattatgttgagctgtataattatttcattatatattgcaatgtaataataatagaaataaagtgcacaataaatgtaatgcacttgaatcatcccaaaaccacccccacagctgggtctgtggaaaaattgtcttccacaatattggtccctgatgccaaaaagattggggaccactgagctagtgggttctggaacttcacctcttatgagcgatgtaaccttgggcaagttacttctctgagatactctataaattaaatcacttaatacgttgaaggcacttggcccagtgcctggcacataggagatgctgaataaacattcactatttttaatataatcttaatgcatagtaaaattatattaaaaagagtgagctagttcaatacagcaagtgtgaaaaactggactctgaaggttgacaggcccaggtccattcccaggtcaatttctggaagcaatttgctgaacaaacagttcgctgaaatagtgaggtttttttttaagttttgaaacatggtccctgccccacccctgccctgtccctgcctctgacaaagaaagaactatggcatttcatgacttgatttctggggattttcctttcagttttctactaatcaatgcattggaaaattgacctgctagtcctgggtttgaatttgttttacctttttttttttttgagatagggtctcgtgctgtcacccaggctggagtgtagtggtgcagtctctgctcactgcagtcctgggttcaagtgattcttgtgcctcggcctcctaagtagctaggactgcaggcacgagccaccacacctggctaatttttgtatttttagtagagattgggtttcgctgtgttggccaggctggtctcaaactcttggcctcaagtgatgtgcccaccttggcctcccaaagtggtgggattacaggtgtgagtcaccacacctggacttttttaactttttaaataaatttaaattttttttttgtagaaacgaggccttgctgtgtggaccaggctggtttcaaacttctggcatcaagcaatccttctatctaggcctcctaaagcactaggattgcagacatgagccatggcacctagacttgaccctgggtttgaattctggctctgacacttgctaactgtgtgtgaccttgggcaggccactgacccttcctgagccttatgggaatgtgggaataatattaggtaatggagcaagttaatataggtaaagaatttagaatagggcctggcacatggcctcagtctagtaccagagtccaagcccataaccactgtgccaacactcttgtaataaatgtatgtgggagacagggaggctgggaggctggatatgtgatgctactttatgtcaactacacatgaattttatatgtataatttatataaactaattgatgccatctactattattagactgaacaaatattgttacttggaactctcagatatgtaatagcttttttttattcaaatccaaaatgtaaaatgtgactatgagtaattgataatgaacttaactgataagaaacttcaggatagatttttctcaagttttccattcagtcttacagtgattaaagtgatgaaaaattccaactatgcatgccctgctcggagcgtccaagaagagcctaccaacgggggctacttaagctctcaaaggccaaacacacaaacggcattttgagtgcaagtggtctgtttgaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctgggtgagtggtggtgctcacccccaaaagtgggcaggtgggggtggtttggggagggctcagggacagggattggtgactgtttgagaagctttcctttccctgggtccttgttggatgtgctgggcctggggtcctcactggtggtgaatgcatccggagttgagcacgtggttgcacacgagttttcaaaataaacttttctttgaagcctttaattgaatctgaggcttatggcttttctccaatattcagggcaagatttctcatctgaaaatgtccttgttgttggacctatctgggcaaaggtgttatgaaaattttttattgggtttgcccagctagatctgttaataatgcttccctgcatggcagcagggaagtaagagctgggccagaagagaggtggggacattgtgagctgaatcgaggtattaggaatggaaaatgccaggggtctattcatctgatccagtgaacatttttcctagaaaaaggaaatgtcatgaaaacacacggaaaacatgtaaatcagctgattctaaacaagggcattggtaagcctggcatgtggaggttataggaaggttgggcagtgccaagagaatgagttttggcattgacctgggttcaagtcctgcctctgctactttccagatgtgatataacctccctgaggctatagatgtgatataacgtaggtgatataacttccctgaggctcagttttatcatctgtaaaatggaagtgtgaatgccaaccttggaacatttctgagaaataaatgaggtaatatacatacattctaggtactcagtaagtaaaagctttaccacaactgtcattctattaagttctttgaaactgtatttgacatttataccttgttggccagccactcgaatctgaccccctgcaaaggctactaagagaactgcccagtgacctggtagcctcagtggcatccgaaattacaatcagggaccacagggacctaaagagccctgttttcagaggtcagaatctttattgatgttaactaagtgaggaccccagtgataggtcttccaggttcctgaaagtccttgtttccatagtgatgggggacaacacttttgcaaatgtgaaaaggagtgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaccaacatggtgaaaccctgtctctactaaaaatacaaaaattagctgggcatggtggcgggtgcctgtaatcccagctactcgggaggctgaggcaggagaatcgcttgaacccaggaagtggaggttgcagtgagctaagatcgtgccactgcactctagcctgggtgacagagtgagactctgtctcaaaaaaaaaaaaaaaagaaaatagtggagtgacaatcgtgaaaccagaaagcaaacactatagctgtggcctggattctcaagtgcaatctgcttttttttttctcattttgatggggaacaaaaatggaaaagcatgctcattggtagtccttgccccgagggtatgaccttctcttcattcttagaataatgtagtgttttgtattttatgcatgtttgcttctcttggctcttggactatttgttcagaatatggcccaggccacatttcactttttaatggcaaatcattttggctgaagttatggcatccactggcatgatggattttactggttatttgcttgcaagtatgttcctgaaagtttaacagagtagaaacagcagaattgtttcttaggttaattttttttgaactttctgggttttaaaaatgtttatcttttatgtttaaattcaggtcagagtctcagtaacaacttgagtcagtttgaaaaaataacgcatgtatatatccaccatcctgtgaacatctgtgggctgttcactcggcagcctgtgatgtctgtccacatgggcttatctcttacctcattcatttatctggaatttctactctgtgccagatgccggttgggggtgtgggggtagtgtttaagatgaatagacaccatcaggaggtgcacagagtagtggaagagacaggcatgtgaaaagatcattaatttggtagaatcggtgtgcaaaagtagaggcatagctacattatagctcaactctgcctgctgagcaggcttagtgtaaggcagtggttctcaagctttggtctcaggatccttccttttacgctaaaaattatttttattttattattttattttattttattttgagatagggtctcactgtctcccaggctggagtgcagtggcatgatcatggctcgctgcagccttgacctcttgtgcttaagcaatcctccaacctcagcatctcaagtagctgagactacaggcacatgacactacgcctggctaatttttgtattttttgtagagacagggtttcgccatgttgtccaggctgatcttgaactcctgggctcaagcgatcctcccccctcagtctcccaaagtgctgggattctaggcgtgagccactgtgcccagccaaaaattattaaggatcccaaataacttttgtttgttttttaagaatcctgaggacaatcaagggagctttgtttatgtgggttagatctattggtatctacctgatcagaaatttaaaaataacaataataaaatcagaatgtgttaacaaactatatatgtataaaaaactatattttctggccaggtgcagtggctcatgcctgtaattccagtactttgggaggctgaggtggaaggatcacttgagcccaggagtttgagaccagtctgggcaacatagggataccttgtctctacaaaaataaaaaaatgaggccgtgcacagtggctcacacctgtaatcccagcactttgggaggctgaggtgggcagatcacttgaggtcaggagtttgagaccagcctggccaacatggtgaaaaactgtctctactaaaaatacaaaaattagcctggtttggtggtgtgcacctgtaatcccagctactccggaggctgaggcaggagaatcacttgaacccgggaggcggaggttgcagtgagccgagatcacaccactgcacttcagcctgggtgacaagagtgaaactgtctcaaaaaaaaaaaagaaagaaaaaaaaaaattagccgggtgtggtggtacacacctatagtcccagctaattgaaatgcttaggctgcaggatcacttgagccccagaggtcgaggctgcatgagtgagccgtgatggtgccactgcactccagcctgggtgacagagtgagaccctgtctcaaaaaaaaaaaaaaaaaaaaaaaagaagagtagcaccgttttacagttttgcaaatcttgtaacggtctggcttcgtagaagacagctagattgtcatttcttgaccattcaatctgtcatgaaatgttttcgttagattatatgaaaatgcatggatatgtagttggaaaagggaagagcatttaaatagccttttcatataattgtgaatgttctttgatactacaccaaaacttgacaaagagtagtttcttaaagtttagttgcaatgtgaaatctaaaatcagatcaataaactttttgttctctatatacccacaagagaatgagagtatgaaaggcaaacattcatgttattatggaaatagttctgacctcatggatcctctgaaaaggcctcagggacccctagaattccccaaactacacttgagaatggctggtttaagagaattgttcccagtgaaggtcctgcccacggagagccctgtgggacagcaggtggcagaggcatgaggatggagtgtggcagtggggctccgatgtggcgctgggtctgccagacaggtggtctgagctggagataaggcagcaataatttaggacctcgagggctccaaggaaggagttttgagcttcattttgcaggggtaggagctgtggagggctttaagcagtcaacagtgggtgtcgctttgtctttgcacccactgtactctccggacagacttgaccttcctgggttgtggcaaagagcagggatctaaatagcaggctgcaacaggagaaggaacgagcacctgctctagcccaaagacccctccaggccacaacgctggcaggtagagtcggagaatctgactgtgctgtacccagaaccctttggacttggattcttccccttgaccagccttatcagtggcacccatccccttccacactcctcgctaggccctcctcaagggggcgctaactggaaggcatgctgccccactgctaatggccgcctgcttcgtttgtgcacactttttctctttgttaccccactttcctatgaggaggtggacctgtctccagaacaaccagtggggtatatcagcctttttggaaaccttaaccctccttgcccaaactcccagagtattcttatttatttatttatttatttatttatttatttatttatgatagagtcttgctgtgtcaccaggctggagtgcagtggtgggatctcggctcactgcaacctccgcctcccaggttcaagtgattctcctgcctcagcctccagagtagctgggattacaggtgcctgccaccacgcccggttaatttttgtatttttagtagagacagggtttcaccatgttggccgcctgcctcggcctcccaaagtgctgggattactggcgtgagccgccgcacccggcccccagtgtattcttgattccctccactccacaaactactctacagtcagccagcttgtggtctctggtggtggtctgtcttatgaggtcttgttgacatatgcattcttttctaaatttaccaaactggctcattttatttctgctaactaaacttgaaagccttttcttttcctattatagactctcctttggatcaatactacacactcagaagttatgtttgtgttttaagagagcattttgtggcaatatggcatcaattctagaagtgggagacaaagatttaaaaggaagttggccctgcagtctggtcaggggatggtagggcctgagctccctcccaccccacaccccaccacacacactgctggaagaattccagaggtgttccagggtagacaccacagcatttagtaaaatttactcataacagttaatttactacttaaaaactaatgaagaaaatctaagaattcaccttttttttttttttttttttttttagacaggatcttattctgttgcccaggctggagtgcagtggcactatcatagctcactgcagcctgagctcaagcgatcctcccaagtcagcttcccaactaactgggactacagtcatgtactaccacgcccaactaattgtttaatttttttgcagagacagggtcttactatgttgcacagactggtttcaaattcttggccttatgcaatcctcctgccttggcctcccaaagtgttgggattacaagtgtgaaccattcctcctggcagaattcaccttacacagccccaaattctgctcttggggaatcacagtgtattaagagacacttattttcatttttgcatgtatctctaaacctgacatcaaaatattcataaaattgcaatacgtttcatataatgagctgaaacctcctaagtgagcaatgtgaagttgttggctgcctggagaattaaatgtaagcatggcctgctctgtgttgctaatggaaatttttacctaggttgatatttattaacccccccttttttttttgagacagagtcttgctctgtcacccaggctggagtgcagtggcgtgatcttggctcactgcaacctccgcctcccgggttcaagcaattcttctgccttggcctcctgagtagctgagattgcaggcgcccgccaccatgcccggctaatttttgtatttttagtagagacggggtttcatcatgttggccaggttggtctcaaattcctgacctcatgtgatctgcccacctaggcctcacaaaatgctggaattacaggcgtgagccaccgtgtctggctccaacctacatttttaaggcttagctgccactcaatggatttctacatcccaaaacaatacctttaattgacttttattggcctcctctgtgaaggacggaaagcagatgccagaagccatgagaggctctggctctccgaccaacccgtggaagccactagtcttaaatttcctgaagccattttgccatgattaaaacttttgtctccttccctgagctttccagagctttgtccattctcttccttctacctggaatatccttccccagacaagacccattctcatccagggccaggtcaaatgccacctcctccctctccaggcaagacctccattgagggaccacacacattgcaggccctctgccaaagtgccaaccctctctgccttacattccaaggggtaatagtgatacttacctcagagggattcacattttagctatttttgcacttgtctcattttactactagactgtctcttcaagatagggactgaatatttttcatttctcatagcacctatgaaaggcaactctcatttactgagcccctgctgtgggttgggacgtgttatctcacctaatccatagcaggagcaaacactgtaaggtaattcttgttatattctattttcagacaaggaagctgaggctcagataggttaagcagttttggcaaatttgtcaagacttctgcaaacctagacagaaaaggtgctcaacccccagcccctttatggaaaggatgcatggcttaggggcagatatgcgttggagcaaagagaaagacacacgtactcttgaatgtactattttagcccctgcttgctccttgacccagagtttttgtgtagaccatagaatgccctgcccatctgtatttggaggtgctgctgcagccggtcacacctgggttctactgacctccagccctggctgtggtcctgcccagggctcagtgtgtattgaacaagtaagtgaatgagacatgcagaaggctgatttcattcttatttgaatgatttcaatcttgattaaccttcttagcaagaggttattttcttctcctggacctcagttcattcatctctaaaagaaggaagttgaagtcaatgatctctcaggtctcatctcagatgtggtgatgtcaccaattcccctgacatcccttctatgtgggaaccctgatgaaatccgcagctttccctcactgtgtccaggtaggaaagccaaggaggaaccatattctggaagccaaggaaggagaagttttgagacacagggtggtcagtaggatcaggcaggacaacagggatggggcagtgggatcaggtaacacagcagggctgggcagtgggttcaggcagaacagtgggctgggcaggggatcaggcaacacagcaaggttaggcagtgggatcagataatgcagggctaggcaatgggatcaggcaacacaacagggctaggcagtgggatcaggtaacacagcagggctgggcagtgggatcaggcaacataacagggctgggcagagggatcaggtaacacagcaaggctgggcagtgggatcaggcaacacagtagggctgggcagtgggatcaggcaacatagtagggctggacagtgggatcaggcaacacaacagggctgggcagtgggatcaggtaacacagcaaggctgggcagtgggatcaggcaacacagtagggctgggcagtgggatctggcaacacgacagggctgggcagtgggatcaggcaacacagtagggctgggcattgggatatggcaacatgacagggctgggcagtgggatcaggcaacacaacagggctaggcagtgggatcaggcaatatggccgggctgggcagtgggattaggcagtgaagcaggggttgttaaacttcattgtgcatcaaaagctcctggaaggcttgttagaacacagattactgggccctgtgctcaaagtgtctgattcagtaggtctgggttggagcctgataagtggtattcctggaaacctcagtttgagaactattactgtagagaaacctacaaggttgggtgggaatgggcaggaggaaaagatactagaagaagatgctgtggggcatgagccggaaagacaatacaagatgagtaacatctgcagagaattgcagctgcagagtataaactaactgtaatctaggtccagcccttctgaagctttacaaataagctgctagcattgtccagccttatagggaattggcaaaaggtgagtttcaggcctacatgggagccagcctcttacagcacagcagttagcaatacacatctaaagaactaagtagctggcatgtgtctttatcatcagaatagattatacaaatgaaggtcgatgcattgagcttatcaaattgttttaaatatagcaacgtttgttttaaaatttttttttaaacctttgaagtaaaactgcctctttttcagtgctcagctgcagtgcatcacgggcagtacaatgacagctggaaacatggaccccatggaggcgctgtcatggccgccctcagcacagacctgctgttccctatcaaattcatcctctgtgcctatgctctgtttaatatagatttttataaactgtatgaagtaaaattcttcattcctatcttgtgattaacgctggaagaatccaaaaagcacagcgtctgacctccaataagccataaagttaaaagcttttctaggcaatgaatatataacctgatttttttctcctacagatcctctctctccccttctttctccctttctcctttgtgtgaaactctttctttatccctttccttttctataaacttccttgatctttccctctccagtactccccttcctcattcccttcttcagttccaggatgttctctcctcagcttgcccatatattttgcacctgcaactcatgtgtgtgtcagggagtagaggtgagggattatcccttccgtgagtgacagtcacctttcttttctttgctggctggtgcttttaggagacaaggtgtacaaccttacccctaaggagccagtcctgtccttcgtctctctatctaatgctaataatgataacaatagtagtgatgacggccgggtgcggtggctcatgcctgtaatcccagcacttggggaggccaaggtgggtgaatcacctgagatgaggagtttgagaccagcctggccaacatggtgaaaccttgtgtctactaaaaatacaaaaaattagccaggtgtggtggtgggcacctgtaatcccagctactcgggaggccgaggcaggaaaattacttgaacctcggaggcggaggttgcagtgagctgagatcacaccactacactccagcctgggcaacaagagtgaaactccttctcaaaaaaaaaaaaaaaaaatagtagtgatgacaagccaccatgtgccaggcactgtggtaggcagctcacacttcactctgcatgtactattatcccttaaatgtctcatacaaggtcattcaactactgagcagccagaggtagaattcaagaagcgaacttgctgttttctctacttaaactcttttatcacccaggctgcagtgcagtggtgcgatcatggctcactgcagcctcgacctccaggcccaggtgatcctcctatctcaacctcccaagtagctgggattacaagcacgcaccaccatatccagcaattttttttttcatatttttttgtaaagacagggtttcaccatgttggccaggctgttctcgaactcctgagctcaagcgatcctcctgctgtggcctcccaaagtgttaggattacaggcataaaccaccacaccccgccttcttgaactcttttctataaccccacccaccctgttttatccagttgaattggactcatctttcaggtctcagtggaagcgcttctaatcttctaggttgggatttaataccccaactattgcattcccatggagtgctgtatgtccccaaaactgcacttagcctgtacagcaattgcctgcttaattgtctgtgtagttcgtcactgtaccagcatagctgagcaaggtgcctggtacacagcaggtattccataaatgcctataggaaaagtaaattaacggactcttcctcaataaatatatatatgttctagaaatttgagttgtatattagtttcctagggctgctataacaatataccacaaagtgggtggttaaacaacagaaatgtattgtctcacagttctggagctagaagtctgagctcaaggtgtcggctgtgttggtttcttctgagccctctctccttggctcataggtggctgtcttctccctgtgtctccacgtggtcttttccctctgtacctgtgagtgtccagacttcctcttcttataaggacaccagtcacattgaattaggctcgccctaataacctcattttaacttaatcacatctttgaagaccctaactccaaatccggttacctcctgaaggcctgggggtgaggacttcaacatatgaatcgcgggcagggagagggacagaagtcagcccatgacaagctgctttgcttttcactttcccagtttgtggaggacagtgtgtcatctttcaacatgtttctaaatagcctctttttcctttctgattcactttatgttcccacttcagggtgatatgagaaacgctggggaagcatgttcaaagacttgagcagtgggtcacttattactttaccatggcatatttcagagtcattaaagcagctccagcaagcgcagtgggctgtgcagccggaatcccagggctgaagatgggacaggagtgcaatctaaccaggatgtgaaaccaagtccaagtaaggtttttcaaaagccaagaattagaacgactaactcagtcctgtttcagtatatccaggggaggctgatttatagggaaagatgaaaggaggacaatgtgtatattttggctgctcagaagaccatggggctagacatgggggaggaggaagttattataagcctacagccagccaatgagtaagaacatcaaagaggaaggctggttggccagatggaccaagagctggggcacaggcaggatctttgggagaaacaagatgaatggatgcttcggacaacctaagttcagagcccggaggggcctttagaaaggcatgatggattatgtgtactgtgggtcattgcgccatgagaagtcccatgggggatgagccccagaggcccttaaagtcagggtggaccattaagtaaactgcggaggaatttcttccaggagggctcagacttggcaaaggctgggaagggctgctttccatctccggctcttaatcccccagccctgacactggggctcgcttgttccagcctacttgatccatttattgaataaagatatactgagaaccagccgggcgtggtgactcacgcctgtaatcccagcactttgggaggccgaggtgggcggatcacgaggtcaggagattgaggccgtcctggctaacacggtgaaactccgtctctgctaaaaatacaaaaaattagacgggtgtggtggcgggcacctgtagtcccacctactctggaggctgaggcaggagaatggcgtgaacccagaaggcggagcttgcagtgagccgagatagcgccactgcactccagcctgggcaacagagcgagactctgtccccgcccccccaaaaaaagatatactgagaacccttttattccaaggtctgcattaggcccagtgaaagatgaggaatccttaaatctttgggacttggtggggtcaccggggatacatcctcctctcctaggtaccgttcatctgtttgcacccagatgtggcctgtcccatgtgattgtcccaccactgaccgaagcaggcctctccattctcctcttccagttaaagctgaatttgtctccaaagtgaagaagaataggaaaaccatcaattttatggagctttttaactatgccaaaatggtttcattctgatacactttttttttttctttttgagatggagtcttgctctgttgcctgggctggagtgcagtggtgtgttctgggttcactgtaacctccgccttttgggttccagcgattctgctgcctcagcctgctgaatagctgggattacaggcacgcaccaccacaccaggctactttttgtatgtttagtagagatggggtttcgccatgttggccaggctggtcttgaactcctgacctcaggtgatccacccaccttgacctcccaaagtgctgtgattacaggcgtgagccactgcacccggccctgatatactattttgtttcataatttgcttgggtaatcattgattcatccattcaacaaatacgtatgaagaagctacagtgtacaaggctttgctttgggtgccaaggatactgcagggtcaggccagggtcacatctggctcaccaccagtcaggctttagggtttggtacaaattccacggcctcaggcaccatgggtgcataggatcagcaaaataagtccttaaagagatggaaaactcactcataaaaccatctgggcttgatgccttttgtagaggggatatatttgacaacaaattaaatatcttcaaaatccatttgtgcattcaggtttttcatttcttcttaagtctattttggtcattgatatctttctgaaaagttttctcatttgtctacattttcaaatctgttgttataaattatagctcataatactgagttacgttttaatagggaacatgtattttataaatacatgtttataaaaaatagggtcccactatgttgcccaggctggtctcgaactcctgggctcaagcaatcctcctgcctcagcctcccaaagtgctgggattagagatatgagccactgtgcctggccaggggacatgtatttgttttttttttttttaacaaaaagtacccagtgttaggccgggtgtggtggctcacacctgtaatcccagcactttgggaggccgtggtgggcagatcacttgaggtcaggagtctgagaccagtctggccaacatggtgaaaccccgtctctactaaaaatacaaaaaattagctgggtgtggtggcgggcacctgtaatcccagctacttgggaggctgaggcaggagaactgcttgaacccaggaggtggaggttgcagtgagccgagatcgcaccattgcactccagcccaggcaacaagaacgaaactccgtctcaaaaaaaaaaaaaagaataaaaaaaaagacaaagaaaaaaagcaaaaagtgcccagtgttttattctcatagatcacaaagctcttagcaaaaattctgaagaaacactgagacctgggggatgggtgtgtgttgccgggagaggagtcgctattgcctcttgggtttctccgataacacctggcttttgtagaagatcttcacagtttttcaaagcacccatcccttgccttacctctcctgtctcccttgtctgcctgatgcctccaacttctcagaagtgccagggccagggcactgctgggcccatggtgtgggtctacattgcagtaaaaggctcgttacccactcccctcaacacaggagtctcctgtttttaggcagcttaagaaagcagtcttgtctgtggaggaatgcccagccttcttggtgcagatgctgggtttggggacccagctgtttgcaggagttgtctaggaacgtcagtacccagggactgtgagactcctgggatgttatagtccccatgctagcagagggaagacactgggcccatgagaagttgagtttaggtagccagtcctgctgggagaaaggaaagcctcagatgccagcaagcttgctgtccagccattttctgacaaccctgcttattgcaccatgtacagtaatcaacacagacttgcatctgctctgaggggtgcaggtggtgctccatggaacacacacatgcacgccttcacccaccctttcctgtacctttggaattcgtggcataggaacactatatctattgcacttgggtgtggttataatgccagggtaaagataagtttctctgtggagtacctgaatgacaagatcatattttgtgtcagttccacatggaagggctcttcctcacagacattggaagggtaacagtagaatctaagctctaggaaggcagggtttttttgttttttgttttgtttttgtctgcacatgatagacacttagcaaatatttgctggatgggtggacaaatggaaactggaatgaaatggagatgcctaggtgagtgtgggaaggactctgcctctcctggtctttgccctgtagatgccaaatatcctaggcgggaactgggaagttggcagatgctgctgtgtagagagtcagtggagcaaagactggaaaaacatccagcctgtgtcagctagcaaaagaggggttttgggtctattttggggtcagaatattagaggaggtaacctgtaccctcaggcttcagagtgtggttgactaggaggctccaaagagtaagtgaaacccaaggggacggagataggaccacttgatccatccttgtaggttcagagctatgtcttatcaaatgttttcccttcatgtagtagcatgataatgaactcttcctactttggtttgataatgcaatggattatatggatagattttctagtgttgaaccaatccttgcattattgaggtaaactttacttgatcataatgtactttttaataccttactagaattattttgctaatctgtttttgtatttagattcataaattaaactggcagatattccctctaattttcattttttgcactctctggttttggtatcaaagttaagttagcttcatgaaaataagttgtttttgtaaagtaggtattagctattccttaaagagctggcaaatttgttcataaaaccatctgggttgaatcccttctgtaggggaaatatgtttgaaactaatttaatttctttaaaagccattagtctatttgacttttctatttcttttgagtctattttagtaattgatattttccttgaatgttagccatttgtctacattttcaaatctgttggcataaatgacagttcataatactgagctgtgttttaataggggacatgtgattctttaaccaaaggtgcccagtgctttgtttctgtaggtcacaaagttcttaggaaaaattctaaagaaacattgagacctgggggatgggtgtgtgtgctgcagggaggggagtctggattgactcttgagtttctctgataatatctcgcatatgtgaaaaagccgtacagtttttcaacacacgtattgcttgccttatctcttttgtcttctcaaagtccttgaaatgtagattttataatcagtctcaatttgtagataaggaaaggccaatcagacataccagtttatctataatatagatgagatcagaagccactcctagatcacaccattttaattagaagagagtttagagatcatctcattgagaaactcttaacctgggatccatgtccctcaaagtgctcttgggtagacttcagtggctccataatttggatgagaacaaaattacattatttttcactaaactctaagtgcagtttagcattcccttctattatgattgcaagcaacaaacaccagagtagtagcagtactgtgtctccagtagcaatcacagatattttcatggcacattgtagccatcagagataactcaaaatactgtttacactcatcactacttcaaaattacactagttagtagacccgcctcttgatcttgacatgttgtttttaaaagtacatgttactctataccaaatttttaaaaatattttgataactgcagttcaaataattggcctcctttctaatcctttgcattcatttacttgtttattgtgataaaatatacataagataaaattgactattttaaccgtttatagtacatgtttgatggtattgagaaaatttacaatgttgtgtaaccatcaccactatttccagagcttttcatcatcccaaatagaaactctgtaaataatgaagcaataactcctcattcttcccttccccaccccccagtaacttctattctacttttttctctatgaatttgcctaaatacctcatacaaatgaaattctatcatatttatcctttggttgttagcttttttcatttagcttagtgttttcaaggttcatccatgttgtagcatgtatcagaacttcattctttttgtggttcaaaaatacgctacattttactccattcacctgtcaacggccacaggttgttttcacctttggactactgtgggtttttttgttttgttttgttttttgtttttttgagacagggtcttattcctatcacccaggctgcagagcagtggcgtgatccgggctcactgcaaccttgacttccctggctcaggtgatctttccacctcagcctcccaagtagttgggactacaggcacacaccatgcctggctaattttttgtattttaagtagagacagggtttcatcatgttgcccaggctggtcttgaactcctgggctcaagcaatccacctgccatggcctctcaaaatgctgggattataggtgtgaaccactgtgcctggccacctttgagctattgtgaataaggctgctatgaacattagcacacaagtatcttcttgagttcctgctttcaattcttttggatatatactaaggagtagaattgctgggaaatatggtaattctatgtttaactttctaggaactgctaaactgtgttcaacagtggctgcagcatgttacattcccaccagcagtacacgagggttccaatttctccacatcctcaccaatacttgttattttcattaaaaaatattaattaccatcctagtgggtgttgcattttattttaggcatgtaaaaactttattctgagaaggagtcatgggcttctccagactgccatgggggtccctgatacaaataaaggttaggaagctaggatgagggaactcaagagctcagagatattgtcacatgtccaaggtgaggtgatggactagcagcagcccaggcattagaactaagtttcctgggtctcaaaggagcccttttccctcctaccagatggtctgttctcatgtacatgatccaccccagccagtggtcagaactgagtcagagctggagctaagccattgaccaaccagctactgaagctgaggccagcaccagacacagactagatagacataattaatccctgtttgcaaatcactgcaatgtagaactaccatgcaccaccacagctgctaaatccttatccagcctacaaacatccactgaatgcctgtgtgcagatcaaactccatattcagttggagtgtttgggggacacttacggggacatcaacggacaatttggtttataggtataaagttcaggagggagaaataaccctgtgtatgtttcatttaattacagaataggtgtcttgatctctcgtttctttgtggggaccctctatttccgcagaggcaggttcagatggcctcttgagtctcatcgcccattttcttactgagctctgtcagccttggctcctgaacctttccacacttgtcagctcagtttttaaaataaccatagctgactttttttttttttttttttttgagacagagtcttgctctgtcgcccaggctggagtgcagtggtgcaatctcggctcactgcaacctccatctcctgggttcaagtgattctcttgcctcagcctcccaagtagctgggataataggagcctgccaccacacccaactaatttttgtatttttggtagagacggggtttcaccatgttggccaggctgatctcgatctcctgaccttaggtgatctgcctgcctcggccccttaaactgctgggattacagaagtgagccaccatgcccagtcatcatagctcacttttttttttttttttgagatggagtctcgctctttcctccaggctggagtgcagtggcgcaatcttggctcactgcaagctccacttcccaggttcatgccattctcctgcctcagcctcccaagtagctgggactacaggcgcccgccaccacagctggctaatttttttttttttttttgtatttttagtagagatggggtttcactgtgttagccaggatggcctcgatctcctgacctcgtgatccacccgcctcggcctcccaaagtgctgggattacaggcgtgagccatggtgcccagcccatagctgacttttaatgagttttaattctagctctccactgtgcaaccatgaataagtaacttaaccaccctgaagttcagttgtcttgtttgtaaaatgaggataataatgatacctccctcatagagtggttatgaggatggaataagacaatacacatagagggcttggcacagagcctggcacagaggaagcatttcattagcgctgttattgttgattttaaaatttattattaaaagtcactttgacgcctataatcccagcactttgggaggctgaggcaggtggataacctgaggcgaggagtttgagaccagcctgaccaatctggtgaaaccttgtctctactaaaaatacaaaaaattagctgggcgtggtggcagacgcctgtaaccccagctactcgggaggtgccttgtggtaaaagatgggccaaggagtttttggttttaaagcgaaagcctgtaatcactgtgcctgctcacagggggattgctatggctaagttcatagataattgggtagttggctgaggcaggagaatcgcttgaacccgggaggtggaggttgcagtgagccaagattgtgccgttgcattccagcctgggcaacaagagtgaaactctatctcaaaaaaaaaaaagtcactttgtaagttgcaaagtatgactctactatgagatctttacaactaggaattaagccagttacgatggcccatgcctataatcccagaactttgggaggctgaagtgggaggattgcttgagcccaggagttccagaccagcctgggcaacatggtgagagcccatctcaaagaaaacctaggaatcagagcttctcatctctgggcctaaaacatctggtggagtagcttctcaggaactgtatactgaatgaatgagtgagatgacatttactaacagttttattaacttttatcttttatttacctatttgaccatctactgtactgacttaaatataaaatagcagtttttctctttcaacctttttttttgaggcagagtctcactttgccacccagactggagtgtggtgatgcaatctcggctcactgcaacctccgcctcctggtttcaagtgattttcctgcctcagtctcccaagtagctgggactataggtgcgccaccgtgcctggctaattttgtgtttttagtagagacagggttttgccatgttggccaggccagtcttgaactcctgacctcaggtgatccaccggccttggcctcccaaagtgttgggattataggtgtaagccaccatgcctgcaccagcccctccccgcccccttttttttttgagacagggtctcactctgttgcccaggctggagggcagtgccctgatcttggcttacttcagcctctgcctcccatgctcaagtgatcctcccatctcagcctcccaagtagctggggccacaggtgtgcaccaccatgcccagataattttttgtatttcttgtggtagagatggggttgcccaggctggtctcaaactcctcaactcaagcgatccacctaccttggcctcccaaattgctgggattataggtgtgagacaccatgcccagcctctttcaactttaaatcaagtatcagtcttagaatcaattctctgtagaatttgtcatatgagtcagtctgctctctatttctatgagtttggcttttttaaattccacatataagtgaggtcatgcagtatttgtcattctgtgcctggtttctttcatttagcataccatggggccaaggacattttttcttttgttttctttttcttttctttttccctgctccagctcaaaggatggggctggggaatctttagatgagtcgggggaaggcctcagtgagaaggtgactcttcttcacatacctgaaggcagtgacaggatgaggcaccagaataatgttgcaggcagagagaacagcaggcaggagtatgcttgaattgttcagtacagcagggaggccagtgtggctcttgccgagtgagtgaggggcccacggtaggagatgagatcagagaagtaacaagggggcctttagtggggccattgaaacagcttaggattttctctgagagagatgggagccattggtaagggaattacatgatttcactttttttttttttttgagacggagtctcgctctgtcgccccggctggagtacagtggcgtgatcttggctcactgcaagctccgcctcccgggttcaggccattctcctgcctcagcctcctgagtagctgggactacaggtgcctgcaaccatgcctggctaattttttgtatttttagtagagacggggtttcaccgtgttagccaggacggtcttgatctcctgacctcgtgatccgctcacctcggcctcccaaagtgctgggattacaggcgacttttttttttttttgagatggggtcttgctctgttgcccaggctggagtgcagtggtgcaatctcagctcactgcaacctccgcctcccaggttcaagcgattttcccacctcagcctccccagtagctgggactacaggggcgtgccaccacacctggctaatttttgtattttttggtagagacggggttttgccatgttggctggtctcgaactcctgacctcaggtgatccacctgccttggcctcccaaagtgctgggattacaggtatgagccaccatgcctggccgatttggtttttaaagaatcacttcttctgctggattgggaatagtctgcagagaggcgaaggcaagcagtgcttaggaggctaatgccatcatccaggggagggatgatggtagggttgagtaatccctggagtgtaacaaacactaaggattattttattttgtggcaaatgtcctaaagctttcttgaacagtaccaggttgctgggaatgtatagagacagcttacagagcaccctacagttttagcaagggaactttcacgtaatataaaggcatgcaggttgtactcttgtatagttgtgtgtacattggttgtttcctgtagcaaaatcatgaagagtatgaattctagagttagagtccctacattcaaatcatggctccaccagttactaactgtgtgaccttgggcaaataaattaccctaacttctctgagccttcagttttccctctagtaaaatggggacagtgggttgctatgaggagtaatgagttagtgcgtgtacaacatttagcattatactgatatataaccatggctcaataacatagtagctatcattatggatatgaatataaccatttgtaaaggtcaaggaacatctctatttaacttagtttatttatttattttttattttttgagacgtagtctagctctcttgcccatgctggagtgcaagggagtgaccttggctcactgcaacctccacctcccgccttcaagcgtttctcctgcctcagcctccagagtagctggcattacaggcatgcgccaccaggcccagctaatttttttttgtattttcggtagagacggggtctcaccatattggccaggctgctctcgaactcctgacctccagtgatccgcccgcctcagcctccaaagtgctgggattacatgtgtgaactaattaacttagtttatttagagccatagcatatggggctgaaaaagaactaagacacttcatttagtctaaccctctcattttacaggggagaataaaaactagagatagaaaattccatagccaaaataaaataaaataaagttatggtccgggtgccgtggctcacacctgtaatcccagcactttgggaggccaaggcaggcggatcacgaggtcaagatatcgagaccatcctggccaacatggtgacgccccgtctctactaaaaatgcaaaaaatagctgggcatggtggcgtgtgcctgtagtcccagctactcgggaggctgaggaaggagaatctcttgaacttgggaggcagaggttgtagtgagccgagatcacaccactgtactccagcctggtgacagagtgagactctgtctcaaaaaaaaaataaaataaaaaataaagttatgcggccagtgtcacctagctggtagcagagtggggactggaacacaggtctctggactcccagtctggtgctttctctgctatgccacattgcttccatagaaccctcagtgcagcaccaggtgggaataataataacaacaataaaggcttatttgactcttactttgcgccaggcactattctaagtacacatatttgctcattttatcctcatgacaaccctatgaggcaggtacaattattgtccccatcttgcggaagaggaaactgaaggagagagggataaagccacttgcccagggtggagaatgagtgtggtgtgggagacatgggcaggaggctgctgccccgttacactgcacgacctgcttctccctttatgtaacagggaaattgaatccagtcgttcaagtcctttttcagccttcaaatttgcagaccctaaatgcttttctattatcgggtcttgaataaataccattccacttcattaaaactgctgtctttttaacttgtcttcatcttaatgatcatctacaagaaagactatttgcagaagagcctagaaaccaagtcaccaagcctgtgagagattcctgaaatgttatttctggcttccatagcaaccctaacatagggcgttaagcttaacggagtcagcgagagcagctggagccgggcattgaagcgctgagagcgctgaggaaacaaatcgttggctcaatagttttccttttgtgtaatatactgtcccagtgtgtttagggagttacgacttctgccaagtaagaatggaggaaatgaagcattgtatcaaagtgtacagagtttccaagcaaattggaggatgagtacaagtctgtgtctaggggagtctctgcagaagatgagggtgggcctgcagagacgtaggggtggggaggaggggcagctctgctttccccaaccttgggtgactaggccttcaggtcagctttgtgaagaggactgagcatgcctggttgccttttctgttccaccccgtttgccgacctcagtagagagtgggggtgatacgtgagtgaggcatcaaagaggccaagatgctgaggatgacagaggcagatatgctgaggctgacggagccaccagggccagtgcaggaaacagagctctctaggtatttcaggaagaaaaagatttaacacggggaattcggttatatagttgttggaagggctggaggagtgggagcccagggaccaccacgcaagagcacctcactgggatcaggatggtgctgccaccagaactgacgtctgtgcagctgctgagcagacaccagaacacgaagtctggctgccgcaactaactggctttctaaaaccttgcttgctggcagagccaccatccaccccacttcatcctttgtgaatatattgaattggggttccccaattcttacccagaaccctagctgcctgaaagatagtctgggaaatatttgttttgtccttttagcttctgcaacgctggaagactcatggggagagttgggagttcatgccaagtgccaatggacatggacagcaatcgattttttttttttttttttgagatggagtcttgctttgttgcctaggttggagtgcagtggcacgatcttggctcactgcagcctctgcctcccgggttcaagtgattctcttgcctcagcctcccaagtagctgggattacaggtgcacaccaccacacccagctaaattttgtatttttagtagagacggggtttcgccatgttggccaggctggtcttgaactcctgacctcaggtgatctgccttcctcggcctctcagagtgctaggattacaggtatatgccactgcaccctgccatttttttttttttttttgagatggagtctcactgtgtcgcccaggctggattgcagtggtacaatctcggctcactgcaacctctgcctcccgggttcaagcaattctcctgccttagtctaccaagtagctgggactacaggcacgtgccaccacgcccagctaatgtttgtattcttagtacagatggggttttgccatgttggccaggctggcctcgaactcctgacctcagccgatccgcccgccttggccttctaaagtgctgggattacaggcatgggccaccttgctcagcctgatatttatttcatttgaaatttggattaaataggtagaggagttgaacaccaaatagagatgagttgaaagggcccatcgttgacctaaactatttgctccaccatctgaaagtcctttgggattaagtccagggttagataacagaggggcagaaactcaactcccagagacaaaggagtggccttaacattctctctggtgccttctctattagtatatacataaggaaacattaatttacacccaagagtaggctgggagcttggatgggaggggaagcagggttgggggtcaggcctggagagattggctttgggctgggccatagatggagaagactgaagtctgggctgtcaggaacccttagaataagcctaaaataggaagggcacatctaaaacccttcagtgctcctcgtttgtcctaataaaatccagaccttttttttttttttttttttttttttggaacagggtcttgctctgtggcccaagctggagagcagtggcacaataatggcttactgcatcctcaccctccagggctcaagccatcctcctgcttcagcctcccatgtagcgaggactacaggcctgcaccattacacccggctacttttttttttttaatctattgtagagagggggtctcaaactcctgagctcaagtgatcctcttgcctcagcctcccaaagtgctgagattacatgtgtgagccactgtgccctgcctgaagtccagacttcttatgcaggaggcacatgccatccacccacatggccctgtcttccccaacttgtcctttaggacccagccttgccacatcacctgtggttacctgggtgcgtgtgcatcccactctgttctggcctccagcttttgcatacgctgcccttttacctaaatgcacaccccagcttgttgcctggtcaacacctgctcaccttataataacatcatcctattataatactcatcaccttgtccagggatcttcccccaccccctatcttgggactggtgatctactccaggctctagtcactcgtccttttttgttgttgctttgttttttgtttttagagacagagtctctctctgttgcccaggataaagtgcagtggtgtaatcatagctcacggcaaccttgacctcttgggctcaagcgatcctcccgcctcagcctcccaagtaactgggactacaggcgcacgccatcatgcttggcttgtgaaaaaacttttttttttgtagtgatgtggtatcaccatgttgcccaggctggtctctaactgctgggctcaggcagtcctcctgccttagccacccaaagtgctgggactataggtgtgagccatcgtgcctggcctgctcatattttttatgaatcttaatgaatctgtcttctctacagggttgtaagctcctcccaggctgagactggttctcatactctatccctagcacccagcacaaagaggggattcctgcaatgtttgtacaactcaaccaaaccaaaatgatgatagaattgtctccgaagacaaattttgcctttgctggcacagggctgtggaaccttgtgccctgttatctaactggccccttcctccttgtgtacctacacctcctcccctcctccttccagggaaaggccctgaggcgctgtgttttggggcctccacctccttcctctcctctcttgcagcccagccctgtgttgctatttattcacaggtctctgctctgctctggctttcacttgctgaattctcagaaagcagatgaagcaatttattcagttaaagtgcccctgtgggtcaaatgccagcttgctttttaaaaccttcctatgctgctttttactttgcagagagcagaaattacctgttttgtttcctggtgctttctgcactctcttgtattgagggatggttgtgtgtctgtgtgtgtgtgtgtgtctgtgtgtgtattacaattttaacgtacatgtcatttctcaatttgagaaaggaagaaagatagtgagggggtttgatagagaatatcaaaattattttgtatgtattcagtcagctcattttttaaaagaaaatgttttaatatcactggctatggtttttattttattttattttattttattttattttattttttgagacagagtctcactcagttacccaggctggagtgtagtggcgcaatctcggctcactgcaacctccacctcctgggtttaagcaattctcatgcctcagcgtcccaagtagctggaattgcaggcacgcgctacaacacctggctaatttttgtatttttagtagagacggggtttcgccatgttggccaggctggtctcgaactcctggcctcacgtgatctgcccaccttggtctcccaaagtgctgagattacaggcatgagccactgtgcctgacctgactattgtttttaattttaactttaattttaagttcaggggtacatgtgcaggtttgttatgtaggtaaactcaggtgtcacaggggctggttgtacagattatttcatcatccaggtattaaatctattacccattagttatttttcctgatcctctccctcctcccaccctctgatgggccccagtgtgtgttgttcccctctatgtgtccgtgtgttcccatcatttagctcccacttataaaaaccactgtttcacagcttatttgtacttctctttatcaattaagaaaaagactgtttgtatagcaaactccgagagaggacgtgaggggtattttttggtgagacttgagcaaactgctttacgttgcaaggaaattcaattcattggaaactttttcctccaggactaaactggggcagctttcattttggctctctcacaaagaaaattgtccagggtctggaaaccacagttgttgaacctcatatgacgtctcttttctttcagctcatgcaacatttactagaggagactggtgtgatgtggcgtgtttttcctttccttttttttcctttccattttgctggctcgttggtgcacacttcctgagggcctgagagggctgtcttcctggaggaatttatgacagtcagcagggacaactgaaatttgagctggtgtgaacccataatccctcagggccctactggctggagtctctttagggagcatccttgctacccaaagatgcacacccattccccagcaccttcataaaacaacaacaaaatcttaccatggcattgccaagcatattttgcatacaaacttcccaggatggattctatctccatgggcagatggaatccatcccgaaagcatctttctctgccagcacactcacctgtctctgctctgcaaatgcccttcttggtagtagcttgttcaagggtacgcagagcaaatttggcaattctgaaatttcagcttttgtttgtgaacttcggctctgctcaggaagaacttgtcagaatgaaggttgacattcagcctgtatgtcgagcattcttgagagaagcacacggtgcctggcatcttgaatggcatcagctgcttgctacccagttctttgggacaagtgggtccatgagagaaaatatacagagcagggataagactgcacccgctctggcaggacagggagcctggctaccccaacttccttttcccaagccatctgctacttttcttcttctgcaaccaggcattcaaagcagggtgtatgtgggggaagaccctggaaatcacctccatctgggtgtacattgttacttttatcctcagtagttggtcaagaagtagagtgtattctctatatatctttattgggttcatccccacttattcagaagtagaatctctaggccgggcatggtggctcacacctgtaatcccagcactttgggagactgaagctggtggattgtctgagctcaggagtttgagaccagcctgggcaacatggcgaaaccctgtctctttcaaaaatacaaaaaattagtcgggtgtggtgggtgtgcctgtagtctcagctactctggaggctacgttgggaggatcacttgagcctgggaggcggaggttgtagtgagctgagactgcaccactgcactctagcctgggtgaggctttgtttgagacccagtctcaaaaaaaggaaaaagtttttagaaagttttagaaatactaatttttaaaaaagaagaatctctagcgaccgttcagtgtgatctggagttaggctgttctggttaaacgtagattgtgcctatcgaataataatttctcttaccctgcctagctctacagtcgcctctatacttgtctcaatgacccctgcactgtgagcttcttgaggccaggacctgacgatacagcactaaccattgtattttgcctgtggtgccttcagtacagtgccttctatgtgccggccctgagccaggcatcgatgaaagatgaataagtccaagtcatgacctcaaaggtggcttatagattgatgggacttgcaggccagtaaataccataagtatttgtggggtgacatcactgcacattaagttactcattgggcttactgtcatcacgacctggtgctgagaaggcacatttgaactccggtaggtgcagcagatgaatcactggggcctgagcgatgcctcccagggcactggcctgggcagagggtgaagtggggagatttgcacttaggcgactgtgtcttgagttgagctttatctcctgggtcacattccaggctcagctgccagtcaatgtgttatctggtgatggggagggtaacagggctcttcactcttggccacctactgggagcagtgggtaaaaatgcaggtatgagagtcagaccaacttggggtttaaatccctgttctgccaccactcattaatcccctgactgtgcacttgtcacttaacctccctgagcctcagcttcctcatctacaagtggagggtaacagtgcctatcttctttattttctgaacctaattgaatgccagatatatctgtcatgcatatgatctgacaatggaacagaatatttgcatcaggagacaaaagagactccaggctgtatgattgccatattttcaaggccactcctggtttgggggaagaagatggcaggacatcagaatggggtgccctgccactatcttcttttctagacccttggcagatggtctctcaggctcacataaccctagagacagagttctcaaatttgttgtgcttaagaatcacttgtagcaattacaaatgcagattcctgggccttaatcccagagattctgattccctgggtctagggtacagctggagtgcagtggtgcgaccacagctcgctgcagcctctgcctctcaagttcaagcgattctcctgcctcagcctcccgagtagctgggattacaggtgcccgccaccatgcctgctaatttttgtgtttttagtagaggcagggtttcactatgttggccaggctggtctcgaactcttgacctcaagtgatccacccacctcggcctcccaaagtgctgggattacaggcatgagccacggtgcccagccgtccccacctctttctgatgttatcgagctgtcgagtatcccagctgcaacctgttctttattgtgtctctgctgaccagcgttcccagcccattccagctcatggcagggtatctgcaatctttctcttccctgccctcccaaccccccacccacaagctttacctggaagctcatgtacacaccaaagggaataagcaaggacccagacaggcagccaggtgcctggcactaggccgggtactagggattcatagaagatactgcttgtggccaggtagctgcatgtgtgagatactggtggaagacactcagacagaggtaagcagggagtgttggggctcagaggaaggccactgaggccagtggagaatggcccattaaggaaaggttttcaaaataggtgaccacagggctgagtcttaagctgaacagggagcagagggcatgcctagcagagagggcgctgtgtagggactacagacaggcagtgtgacattgtataaggtatagggcagggagtggtggctggtggagaaggctgagttcatgagttcattctcccctgaacatcagcaaccttgccattagtgacccttgggatggtggcttttgaagaaattgctttgatggaatagctccccaagactcatggatactgggagtttatgtatgtatgtatgtatttatttatgagacagagttttgctctgttgcccaggctgtagtgtaggggcgtgatctcgactcactgcaacctctgctttccatgttcaagtgattctcctgcctcagcctcctgagtagctgggattagaggggcacgccaccatgcctggctaatttttgcatttttagtagagatggggttttgccatattggccaggctggtcttgaactcctgacctcagatgatctgcccacctcagcctcccaaagtgctgagattataggcgtgagccactgcacccagcccgatactaggagtttaaagctgtcatttctggttcttgggactcagatcaatgaaactcactaaaatattcattcatgggaaagttctggtagaaaggggaagattaaagtccatttttgtcaggagagtctctctctgggaaagtcattgatgagatgactggggcataaggtggtgtggtggtgtgtgcctgtagtcccagctactctggaggctaacttgggaggatcacttgagcctgggaggcggagtgattgggagtaattggaaagtgacatctggaagacaaatcggtttattttcataagctccctccagtctatgggtgatgggaaattggggtgctgtgtcaagaggaatcctgtggttggactttgattctgagaccaggactgattaggggtgtcggtcacagatgccagggctggggacatgggggtgacatgcaaggcttggacttgccatcctggctccatattttatcatgggaccagctgtctcccttcctttggtttatgcagttgatttcgaaccctacgtgcagggcttgacatttttaccaattacacttcatcttactagtttctactcattattccatccctcagaaaccctttctgggcctgtctgtgttactcagcttattaacagttcctcccagcatcgtatgcagtggtgtagggagaaccataaatgcctccagaatttgcaaaaatgtttggaaaatgttaccaagtgggaaatgatttgctaatgagttcacaatatgtcttagacccattaagtaatccagggtgtctccctaatatagtagaagcaagttttcagaatattccccagcggttttttcagaaaatgtgaatagagcacgactgagtcaaagaaagccctagctcatcaactgcattctacagtgtcaggcctcatgtgatgccgcagctggcgactgactaataagggaattggagaggggaaaattgattatttcctggacaaggaccatggtgccttaatcaagtgccctaaatgcaggggactgcaggggaagtcgcactgtggtaaaaaaaaacaaatatagtctaaattacatctgaagtagcctttcaattacccttaagcactgagagctggtcacagtctggaggcacacagggacagaagcacctgaggaggctcaggggccgcatctcaggtgtctgtggacatgcccctgagggagcacagtggtgggtgggatcccactgctgtgtcgcacggtcgtctttgctctcagtccatctgtctctctgtctctctttgacaagcccatgtagttcaagtctcataaataaaatgcgtacagccggggttcccaagccccatgctgtggaccgatctcagtccgtggcctgttaggaaccaggccgcacagcaggaaatgaatggcaggtgagcattaccacctgagctccacctcctgtgagatcagtggcgacattccgttctcacacaagcgcaaaccctattgtgaattgtgcatgcaagggatctaggttgcacactccttatgaaaatctaactaatgcctgatgatctgaggtgaaacagtccccctcttccccactctgtccctggaacatttgtcttccattaaaccagtgcctggtaccaaaaaggttggggactgctggcttatcggatgcaatttccttgtattctgatgtgctagttttatattcttatagtggaggatccataccgctttcacggttttatgagaaatatctcttacaatctttctatttgttttgctctgaccccatgcccacctggcagccctccgtcatgagtgcagttttacctggaagctcatgtgctgacccttcacatagccagccttgtctgcctgcccttatttctcactgaaaaagaatgttagcctttatagtcagacggtgtctcatatgattagctagtttacctttattcattttttcagacgtgggtaaaattgagtacttcaatctttgtcgcagagcaccaggctctaagaccaggttggtagaaggattctatttcatgtgccagttctgacaaattgtttattggtactcaaagtgccatgttgaaaggatccaggctgagggggacagggccagaattgattaacaatgtctgccagggactgaaaaaaatggcattgttaagcttgccttagagcctgagacagtcaaccattccctctctcctctaccaaaaggtagtcaaccactccctcactgtccttctctctctcagcatgtatcattagagacctccttccagactggcttgatctgtttatatttatcaacaacagcacactgtatctttttggtctgcctgcttcattgtatcccgttattgtgtccttttcacagtcaggagtcttttccttcctctgtatccccaggccctggcatacaataggtatgttgaatgactggctcacaacctaagagttctacctaattgttctgcatgcagggaatctgccttattagggtcagtcgtttgccttgctgagatccatactacagagttccgtggatcctcttggtctgttccatctaggaataaaacgtacattttgcatgcccttttttttttctttcttaaactcctgctagctcattacgatcatggcttgctgtctctctctctctgttcttctctcatcataaaacagcttcaacttttctccccagtgtccctttgaaactgttggtgagctagttttttctctgtccctttaggaaattttaatcatgtttttaatcatgcttcatagtgttttgggtcacccttcggtaatttttaaaatcctctggttattcctagttctaagaacaattttagctcttggcttactgctactctgtccagcattacccttgtcataattgttggtgatttcaagatccacatgaatcatgaatcatcctttaatagctttgagattcttttctccaatattcttgtcttccaccagatctcagccactcacttctctctctctctctctctctgtctctctttttttttgagacggagccttgctttgttgcccagattggagtatagtggcacaatctcggctcactgctatgtctagcctcccaggttcaagcgattctcctgcctcagcctcccaagtagctgggataacaggcacctgccaccacggccggctaatatttgtatttttagtagagacggggtttcaccatattggccaggctgatctcaaactcctaacctcaggtgatccaaccgccttggcctcccaaagtgcggggattacaggcatgagctactgttcccagctagatttcagccaccttcttctcttatcttgaccctataattacagtaactttaatcctgccataatctcagtttaaacctcctatcttcccagcttacctgtactagtattccaactccaacaattctgtgaccttatctggacttccagttaattgatcctgctattttttcactgtctttcacctcaattcctctatttcctgcttccccagctttaattctatagggaatcactatagtcactgtcaactacctttgcccctttcctgattcatcgttctcgtttggccacatgataacccttgttaaattcaacttttaccagccttccccccatatctgtgtagctgaatgtggctgtagcaaaacatgcaaccacctggattggtctcatgtaaatttcataattgcagcctttaagtaggcctttaatgtggcctggaaatcatactctagttccctaatcccttcactcttccactgtcctagaaactgttacagttttttttcacttgtgttattacatttttcatggttctcttgttaagtgcccacaaaccatctgctcgtgggaactttgctgggaattgatatggaacatcacattttctgaaatcaattttcctgggtatttgactactgtccagactgtagtccttctattccccacagcccctcaaagatcggtgacctctctctttccgtcacacctgtcccgtccttcattctccccctggcccttgaccgtactgaactctccgtaagcgcttgtcgaggagtaagaatgggaaccatcagtggcttgacttactgggctgctgctatccaggcaggcaacatctgttttcatcatattattaagtgtttttttttttttcagcacttggcaggaggtaggcaagtttgggccatagctttcaggccctgagtccaggcaaggaaagaactgaccccagagagccaatccagccctggtgcatcttgagtattctggaaatggcagatctaaaaggacaaaatcatttcatattcatcatgagtatagcttggtggttaagagtgcagactacggagccatcacgatgggttcagatcccagctcctctacttcctagtgataaaagaaaaaactcaaccaaattaaatttaaaggagtttaactgagcaatgaacaatttgtgaatcgggcagcacccagaatcacagcagattcacagagactccagtacagccacgtggtggaagatttatagacaaaaaaagggaaatgatgtacagaaatcaaaagtgaggtacacagcgggtggattggctacaggctggcatttgtcttatttgaacacagtttgaacactcagtagtgtatgaatggttgaagtacggccgctgggattggccaagactcagctattgttacaggtgcatactcctaagttaggttttcaatcttgtgtacttataagcttggttgcagtttttccacaaagactgaaatatagaagcatggagtcattctcaggccatatatacttcacttttatactagataggagaactcaagcaagttatctaacctctctagactcactgtcctcatctattaaagaacagtaacaacacctactttctaaggtgtgttctttcctactttctaaggtgtgtgtgaagaataaacaagccaacacctgtaaaccattcagaacaaggcctggcactaattaagtgctcagtaaatattagctataaattacgattattttctcttttgagtctcacaacagtattgtaaggtattattatccctattttgcagaggaagagactgagggtcacacaggttaaggagaggctcaagatcatttggacagaaagtggcagaggctgggcttgcatgggatcataggactctaatactgtttcacttaggatttcagagccccctttggtctccagatgaaatgattttacccttgtcatggagattcatattcattccttctccaaatgtgtcctaacttccccatgcagatggcaccaaatatttacagtatgattacacggccatgattgaatttagccagaacgggagagaggctgattagtgacaaggctgcaatcttgagaggaggaaatagttctgacgttgcacattgtcattctgctggagtaggaatgttgcttaaaattgtcctggctcagttccctttctctggaagagtaaaagacacgcatttgcccaatacatggactttggagtcaagctgacagtactggaagagctgttaacagagtccagattatcactttatggttagagggatgatgttttattatgggcccacaaactgtcctccaactgtggctgaaaaccctgtcatgagaggccagaaggaagatcattgtatgttcttctcccaggccaaggagacaggatgtccttcatcagaaccagttgtcagcataagaagaacacacaccaaggaaatccatttcctggaaacatctctcaacagttcccatgtggagaaactgtgaagcttttcacagcaaatgttttagagtgttcccaggtatttgcaaagctcctatcataatgctggctgtactgataatttcctaagggtgcctgccatgagacgatggaaagggcatcaggtctgaccatggtgagccatgagggccttgcagagatagagtcaactctctgggcctcagttttcctttctataaaatgagtgacttggactctgttgggacccctctgcctctaagattctactagtctgtgattccatgagtcaaacttcagaagtggttatggtccctcataaaatggcaaagatttgggtcctagaatctatgactccattagcaggaccacatctcctctagaacattttggcttcgtgcttgtcatcatctttttgtactaactgctctgattcaatctctttccctgaagacttgcttccaccagaattccatttaattccacagatgttgaatgaagactttctgtgtttccaactgcatgcctacaaagataaatgagactagtttcctaaccttggggaattcccagtgagatagcaaggtcaagactttatagaacttcttttctccagagagctctctatttctttgacctgtgtgtgtccctagaccagtaatattgacttcaccagggagcttgttagaaatggaaacctacagaatcagaagctctggggttgtggtgcactggtcttagttttgttctgttttgttttgtttttgtttttgtttttgttttcgtttttgagatggagttccactcttgttgcccaggctgcagtgcaatggcatgatcttggctcacagcaacctccagctcccaggttcaagcgattctcctgcctcagcctcctgaatagctgagattatgggcatgcaccaccacacccagctaattttgtattattattattatttttttttttagtagagatggggtttctccatgttgatcaggctggtcttgaactcccaacctcaggtgatctgcctgcctcggcctcccaaagtgctgggattacaggcatgagccactgtgcatttggcctggtcttagtttttaacaagtcctctagagagttgagatgcacacttgagtttgagaaccattgaactagccctttcagggacaagctatgagactgtggttctgagccctcaagggacccaaggacacattttgaagaaaattcagttacttgggctgccaggacttggtgttttcaactcagaattacagctttcttggaacctccaacaacattttgaacctttgtggcgtttttgtacatgtgcaggtgttgtggaaactacccatttgttttgaagggaaagaatccagtttagcacacaattctccatggaacttccaggcttccctttaaattgattgtgatgcttggatagatattgacaccatgactaagacccataataaaggcccaatccaaggaggctctgctacttccaaagatctccaaaggaagagagttctcagagtgcgagtcttgtgtgaatttccctcccttcaaaggtgccttaattaatatcctcctccatggcagggtctaagcctggcccctcttctcagcaggtaaagattattgggtcacactctccctgcagtaagttcagacatgaagggtcgggcaggtgtggctcttggagagggcctgcctgggtcttgggaatgctcccccttgtcctccttcctgggatctgcagatccatcatctactgccccaacccagggctatatgctaaaccacaggagccttcatgaaaattagaaaagcactcctgcctttttttttttttttttttttctgagatggagtcttgcactgtcacctgggctggagtgcagtggcgccatctcagctcactgcaacctccgcctcctgggttcaagtgattctcccgcctcagcctcccaagtagctgggactacaggtgcgtgccaccatgcctgactaattttttgtatttttagtagatttggcgcttcaccatgttagccaagatggtctcaatctcctgaccttgtgatcctcccgcctcggcctcccaaagtgctgggattacaggcgtgagccactgcacctggctgaaaagcaccccccttaaggtgcctcttagggtggctcagcccctggggctcagggcttggctggattccagttcctctcacctccttgagcaggtgcctgtgtgcagcaccaaccacatagccatagctgtaaccctgcccctacccagcctggggctggacatgagtgagggctgatggaggggtggggagagcctgtacatgcagccagcacacgtcgggagttcccaagtgctggatccttcattacatcatttccttaaattcttacagctgcccaacgaggtggatattggttgcacctctgtatatttttttctttttctaaattatgaaagatttcaaactctcagtgctcccatgttctcatctatgcaatgggtatgatgcttcttgatcctttctcaaaaacttgttctgaaaatcaaatcacaccaagtgacaaagtgctctggaaatgttaggtttcatatagatcttatcgctgaaccctcaaaggctcactttctggggcctctgttttgagacactcaccctggactcacccagccctcagcgttatgcatgggtatgtcagaacgttggtttcttgccaggctactggtatttgtgggtgcctcctcccctaaaatcattagacttgtgaggcggcaaggatgagttgtgtgtgcaggcactcagggacgagtcacagcctggcaagctggcctggacaggatgacttcacgggcctttcccacttctcatttttatgactagctttactgtttcattttggctttctctctctttcttgcagctgtggtgattaggatttagggcaagcatttgggatcccttttctaatccctttcaaatcctgattcagctgcaaagtccgggaagggagtagagaatgggggaggagggactcaccctggtgaaaggcagtagctcagaatatccgagaaactcccaacaggaatgcccagcctccacccactaaagctggagacctctcatctcatccaatatcaccctcgtactagaaacgcaaaagggatgagtttgtctatggactcaaacctttacagtcttcttgcttagaagcttaaggcataattatggtagtcatggtggtaagggacttaacatttgcctttttccaatttaactgtgtcctttgttgaaatatttcttagtcaggtccccttttctctatttccactactgtcctaggattagatctgagtccccctctcaatgagattagtccagaaattatgtataccatccatcttgcaaaccactgccagactctgttgacttttcattatgtaacttccctatgggagaggtgagttacataatatgatgctaagatgcccctcactggtggcatcatgtacatatttctcagtctgaaaggaaaggtctttttaaactggcttcaggccatctgtccaactaattcctgcctgcaactcctagtataccctctactacaaggtctcatcacttattctgttacccaccacattcattccgtcttgggctttggttcatgtgatccactccatgtgctccttctctctaatccaaacaccatgcatctataaggtcagctcacgtcccatttccttgaccccagcccattcatatccctattctcttagcagctattgtcaggatgacacagttttcatgccagttattctttcatggttttattagttaattctccccaggtagattagaagctccttaactttggaccctgtcctaagcttctgttatattctctgcagtgcccagccaagcttatgtgtcatgcagtaaagaataaaataattttgaccctgatcaggtgtttggttacataaaaactgcattggcaactttctagaaactaatatattcatttatcttgcaaaaaggattgctatctgattatagccagtagtcatgatcttccagccatgcacaaatatacccttataactttcatgagtggggaggaaaattgatgaaggaggtttcaaaggtgatcatcagccccaggatttccaacaatagccagtctgccctgggtccttaactctcttttaatgtttttattcttatttttatttttttaatgcagtctcactcttgttgcccaggctggagttcaatggcactctcttggctcactgcaacctgtgcttgctggattcaagtgattctcctacctcagcctctcaagtagctgggaatacaggtgccgccaccacacccggctaatttttgtatttttagtagagacagggttttacagtgttgaccaggctggtcttgaattcctgacctcaggtgatccacccgccttccaaagtgctgggattacaggtgtgagccaccacacctggcctctcttctaatgtatttgacctctcctctttccccagagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcagtaagtcctgctcctttgtcactcttctagaggaaccactagaattcattcattcatcttcaagtgttcattctgtgttactatgtcccaggtactgtgctggcaataggttttcaacaaaggccaagataaacacaacgtgctccaggggcttacactttggccaagagacacatgtttttatttatttatcttttagagacagggtcatgctctgtcacccaggctgtagtgcagtggcatgatcacagctcactgtaacctcaaactcctgggcttaggtgatcctcttgccttagcctcatgagtagctgggactacaggtgtgcaccaccatgcctggcttattttttaactatttgtagagacaacgtttcgccatgttgcccaggctgatctgaaactcctggcttcaagcgatcctcctgcctcaacctcccaaagtgctgggattataggcatgagcacccagctaagacagacattaaatatataattatacaaataagtaactatagttgtcacagtgtaatggaggaagaattcaggacatgaaggagtgtgcaaccccaggaccttatctaggcctggatgctcagggagattgccctggggaagggacacgtaagcccaaaccacagaatgaggaagagtagatagacagagtttttcttcagcacatggagctgccctggaattccctaagttggaattcatgagttggagtacggataggaatggaagggcagaaaaagtaacataatctctccttggatggtgtggaataccaaggcatttttgccccatggtggtgctggcaggggatgttttctcagctgacaaagaggtccagcgtatacagaggaccaaggtgtggtcctggcagctccccacctgttaagattgtaggggccactcctcacctgccaactctttctgcaggaagatgcctctcggagcccctgagctgcattcttctatgttggaagctttctttcctcttttgctttctaaccctcttttcacagggcttctctctcccttccttcccacgcactttccagttatctctacccctgctgctgcccccactcttctcagcaggtcagcctgcattctccccagtttcctgcctctgcggctgcctttttgttccttcctcctccgggagggcagggggccagccgcccaatccaggaaactcgcatcctgatttggtaaacaatgtcccaccctgacttgtccattcccagtggtccctgtcccctccagctaccatgaatctttggtggggaaataaagggaaataatctatttttaaatatctatttgtaaattatctatatgtaaatatctatttgtaaaatgtaaaatatcttcctagagcagagtggagaatgagctttagagccagactcagcaccaactccccaggagagggcacccaggagggggttctcagaatgtgacatattctagacctctaagatatagcccccagcgaagaacaatgtgcttttgatgtgtattaaacaaaatcccctgctgagaactaacttcaaaaagcacagagatctcatttgttcttgactccagaatcaaaagatttacttaagaaatcaatgccatgaagaaaaaaagaacctttttccttgccatgccacttggaaagtgttcagaagtgccatttccctggcactgcagaggctgtgttgttgtggtgtgttgtggcctaagtcagctggaacacttcaatcagcagaacacactgcaaacattttcaaggtttatgactttaaatgacttctgcagaatttatgtttcccctttcctgaaaatattaaaagggaaattggttctgtaaccattttgacagcttattcatttgtgttggaaaattttaatggaggggttctttttataagccttctgtatttatcagaaaatggaaagataacatgataaggctgaggagctacacaatgggactgaccgcccccctccccccacccccgcaatcctggtgtcgaataggatataccaatgtggacttgtctgtggaaaaaccatctctgtgtgctttctggcaaggcagcaaaatgaaaaggcagtttggacttttcctcccttcatcttctttgttataatctggaagctctaagaaaacattagcgttatcccgcttgttcctgtgcctgagaaatgaatcccctgtgagtccccccatccactctgcaggagacagggctgctgtctctcactgcactgcactgcccggctttgctcagcagactcagcagccgtcttgaaaggctgaagaggccccagggcctctttatcaacttcatggtaaagactgtagtaactaacatttataaagcactttcccttatgttatcgcagaaagccccaggaggcaggcagcacactcttgccactctctttttacaggttaaggaacttgctaagtgaatcacctgaaaaacaaatagccaagagatagttggatgctaattccaaacctcttgctcatttcactcctctgcatgttgggaattacaaattcctcttttaaggtaaaccattttctggtggccacctccacagtccagcctggccaggtaaacctactttgcaattggcattcacctaaaataggtgaaactctgaaggcagccttcgtaggaggaagaggagctgactctagttgtacaatcttgagcaaatcctttgtgctctctgagcctcagttgcctcatctgtaaaatggggattttatatgcagaaagtagatgagtgaacaggtgttgtaaatggtagagccctattcagtgtgcactgtgttatgtattattacaatcaaatacactgaggaccgatgggctaggcagatggcctcagttttgatctgcactcaaatgatcagacaaaaatggtgagcattttccaagttgcagatgacatctctgaggtttgggaagtctcatttgttccttaaacattcattgaacctgtaaaccaaaaagtatctgagacaagtcccaatcaatgtaaaagtttattttgccaaggttaaggacatgcctggagaaaaggaacacaaaatcacaggaacaatctgtggtctgtgcctttttccaaagatgattttgagagcttcagtatttaaaagggagagagggagggcatggtcacattactgaatccacatgttgcaagagaaaaggagcaggtaggggaacagtcaattatgtattcctctagtgctcagtaaatcaacactttacataagataaggtgaacatagagtagctacttatgcagatatttaaccttttatctgtagctatctgcttaggaacaaaagcaaaggcagtttcttgcattactcagcttttagcttaatttttttccttttggcatagtgatttgggatcctgagattttattttcctttcacaaactgtaccccaataatagctaatcttgtcctgtgctaggtactttcaaatacagtattccacttaatacttaaaatagccgtttgagataggtactatcattatcttttttttttctttctaagagataaggtctcactatgttgtccaggctggcctcgaactcctgggctcaagcaaccctctcacatcagcctcccaagtagctgggactacatgtcactatacctggctctattatccctattttacacaactggaaattgtcagggtctgcctgggggctccaggagagctttaaagatgaggtgatactaataatcactaacatttcttgatattaatgtatgcatgtgttgtttcaggctattagtgtatgttaactcactttattcacacaacaaacctgtcaagtagatgctcttatagttcccattttatggaagaggaaattgagaaccaaagaggttaaataacttgtccaaggtcacaaacctgtaagtgctggagcttgtttttttgtttttatttgtttgttttattttgttttttgagatagggtctcactctgtcacccaggctagagtgcagtggcatgatcatagctcactaccgcctcaaagttccatctcagcttggactacaggtgtgcgccgccatgactgaataatttttactttttaaaaaagaaacaatgtcttactatgttgcctaggctggtcttgaactcctgggctcaagcagctctcctgcctctgcctcccaaagtgctgggactacagacatgagccactgtgcctggcctgtaagtggtagagttgagacgtgagcctaggcattctgcaggcagaactgaaaatcaatgctacatctgcagattgggacaggttctgtctgggtgtgatcaaggcaggacctttatcatacagtgaggaattgattagactctgcagccagacctcgctgggtgagagtcctggcttttttctctttggctgtctggctgtacaatcttgagcacagtggaggctttatacttgcaggcagggacttcccataccagccacagcaaggggaatcctgaggttgcattctcaggccacccttgagaccaccagggagaggccaggtgccctgtgaattgaggtcctgtctacaagatgaccaaaccccacacatcctggagtctgccatttttgccacccagtaagagaaaacatggaatctatgggctgaaaacgctgtccccagtgttctggtgattcttgccacctgggcgagattgcttttaattaacctctaggtgctgactttatcagcctcatctggtattttggagcagggagccaggctgttcctaccctaatagccccaccccacccaggccaggcacaatttaaggccctaatagtattcctaggacacacccttcatgaactggcctgggcagtctacactgatggcacccctttgaggtcctgatgtgaagtggggaggctggactgacttcacaaacgttgagtctactgtgcccagtaatacaagacctccagcccacctccctacactgaccactcctttagtcattcatacaatcattaaaaaaaggactgttcttatttcctagtcaacaaatccaatcccaccaatgacttaggctgctgattagttattcctccccgctgaacacaaggccttggctgagtgtaaacccagagggccttctgagaaatgaggctcataggactgtttccagcaggccggtggaggaggcaaggctgtggtctccccttggctctcaccgcaaaggcccatcccacagagggcaaggcatgaggcctggatgctctgaaagtcactcagcactcacccacagcattctacagatgggaaagttttattctagtttagtgaaggtgtttgagattcttttggttgaaagtgtcaggaattccatttttttctaaaaggaggggggagtgcattatattatctatggaaataaggatggcagttgtgagagtcctgctttcactgcatctcccctccactcctctccttctccagtccacagtcaggaagcatggccccaccagcccctgaggctcacttgttctcagtttgagcctccttttattcagttctggttcctaaatgccagtaaaggactctgattgtcaaaccctgtaccaaccaacagtggccaggagtgagactacctcagaccaccacggcagctccccgatgcaaggtgtctggagtgagaaggaagggcagtttctagaaaaaccaggtaccagattaaataataggtgtctgtactgaggtccctagaggctgtccatgcctttactctacaggtaaagaaatagcctacaagagctacctgatttcccagaacttccctcacttgttcgaggtagaggggaactagagcacagtcttctagctcccaatccagtgccttttccattacaccaagttataatcttttttagttccagtttctcttatggcacatggccaaaataagccttagtaacaagctgtcattctgaaacccaatgcaatagttcttttaattccccctccccactaacttttttttttttttttttttttttgagatggagtcactctctgtcacccaggctggagtgcagtggcacgacctcagctcactgcaacctctgcctcccggtttcaagcaattctcctgcctcagcctcccaagtagctgagcccaccaccatgcctagcttatctttatgtttttagtagagatgggattttgccatgttggccaggctggtttcaaactcctggactcaagtgatctgctcacctcagcctcccaaagtgctggtattacaggcatgagccaccatgcctggcctaatttccgcaattgataggtgaagaaagtggagttcagagaaaccaagtcatttgcacaaggtcatagggagtggcgaagctgagccttcaggtggtctatttccggtagccatcctctccccacgatgctgcctgctgcccgccagatattttctctgcctcacatctcctgtcttcttattttgtctgttagggtctcaccaagaagacaggcaccaggtacatcacttgggcctcccactcatgacagtgggtgactgccgtgtagttggttgcctacacactacacttccttaattatggagagagacagtgacatgctgtgagtgccttagaaatgtcctctgcccgtgggtaatttgactccagcagtccaggaaaagaagagagtctttcaggatgcaaagcaaatgcaaattaaaagtgggataatgattacccctcaccatacgattgtcaaaacttgaagtttgataacaccaagtactgaagttttgaggggatgggaatcgttaggaccatcgttgctgacatgagctgtcttggaaggcaatcaggccatatctgtttaaagtgagacccagtcctagagaaaacatcgtacatgaattcaaggggacgtgttcaggaatgttcatcacaacactgtgaaagtgaaaacttggaaaccacccaaatgcttaccaatggggaaatggccaaataaaatgaggaaagtcatatgaccaatggataaaacaattgggagggataaactagatctaaggttttgattaaatctttaaatctaaaatacagctagttttcattattcacaataattatgttttataaagtcactgcaaacactgagttagagaatactaaaccattgctccatatattcctgatggaatatagggttaggttcctgcaatcctctggtgacaatattttttgtcaactaatcaatacatagccttgttttatgtgtgtttctgtttaaaaacatcttattttttgtttgtttgtttattttttgagacagagtctcgctgtgtctgcagtggcacaatctcagctcactgcaacctctgcctcccggtttcaagcaattctcccgcctcagcctcccgagtagctgggattacaggcacctgccaccattcctgactactttttgtattttttttttttagtagagacagggtttcaccatgttggccaggctggtcttaaactcctgacctcaactgatccacccaccttggcctcccaaagtgctgagattacaggtgtgagccaccatgcctggccgaaaacatcgtatttgatatataccattgattcattaacatcagacccacagccaacggtaactcctgactgaatgaaacttacctaacacatgttttccctgtaaggcacatcgcagcctttctgcactgaggaacactagacggcgcatcaccattttaaaccgcaaaatcacttacagaaagcacagaaatgaaaaaacaaacaaacaaacaaaaaaaccacggtgctaagtagactgtgaaaaggatgcttgttcacagaatgaaagctgaaaaagaaggcagagtggctccttgttcaacctcagctgagaacatctgcaccaggcaacacatttttttgtagtctcagctacttgggaggctgaggctgaggcaggaggatcactggagccccggagattgaggctgcagcaagctgtgactgtgccactgtactccagcctaggtgacagagcaagagcctgtctcacaaaataaactaaatttagagatattttaaattgagtgctcatgcactctgagcatgtccactagtgaccgtgaaaacgctgtgagtattggtttgggcttacaaatacattttagtgagtaggcaaattcacaaatatggaatctgtgaagaatgaggatcaactgaacatgtcttcacagtttgatatctctgaaactggggtgcattttagattccatgaaatacagtacatgtatcaacattgatagaatctgtgattaacgttgagtgaaaactgaggtgaaggtcaatgtatataggatgaacctacagatgtaaaataagacaaaatgccaccataattctcctttgctataaaatggttagcaggtatcttcagcattccccaggcactattctcaacactctaccatctccattaatttaacctttttgaggttcttatgaggtaggtgctatttttattctcatgtcttataaagaagttaagaaaattgcacaaagggctgggtgtggtggctcatgtctgtgatcctaacactttgggaggctgatgtaggagaatcgcttcagctcaggagtttgagaccagcctgggcaacatagtaagacatcatctctatttttaaaaatgagaaaacttctattttatttaaaaataatgataacaataaaagaaacttgtacaaggtcacaaaaaaagctgtttgtttcaccctgaagtaaaaatgactgattggatctacaaactttcctagtgatatttgtatcctaacaggaaccaaaacacagacaatcaaactcagaacagtacattctaaattgtattgttgtgaaatgaaacagctttacttccctagttcatttattgcccaccatatttcttactccaatgtaaagagacataaacttcagatggatttaatcacagctgagttttcacaagtgctggattaatggaattgttctaagcttttgagagctccttttattttagcttcataaaaatatatttctacatatagacatcttttttgtttatgagaacacttgcataacttgttatgtttgtactgttgcttgttaattttaaatacaatcaagttacattgagtaaagtcataaattaggacattaaaaaaagagaatttttatgagctacagacagacttatgcaggaaccaatgtaccagaaagctgaggtacttcaagaactaaatgcagagggcaggcgtggtggcttatgcctgtaatcccagcactttgggaggccaaactgggaggattgcttgagcccaggagtttgagaccagcctgggcaacatagtgaaaccctgtctctacaaaaaaaattttaaaaattagccgggcatggtggcacacgcccatagtcccagctactcaggaagctgaggtgggaggatggctttagcccaggagtttgaggctgcagtgagccatgattgtgccactgctctccagcctggaagacagagcaagaccttgtctcaaaaaaaaaaaaaaaaaaaaagaaagaaagaaaagatgctaaataggtatcttaaattgagacataaagattacagaaacatgaaacgtgtgagtgcattttttactccaaaattgtgtgtatacttttgcatattaaaaatttacgttactcttgaaacatgattttgagaaactgttggttctttaacacattcttgcttatttaatagcttttcctccagccccattgctgcttcctaaaaatccacacttaagtcaaagtcccctctgatgctggcaaacttttctgattccccagcccaccacatgggtattattaagttgaattggaaatttcttgcttttttttgtagatcaaaaccaatcaagtatcagcaatttcatatagttcagcctaacactgtttctctttgattttccatggccctttatctggccctgtcttgtccaccttggactgtgagcccccttgagggtagggactgcagcttatttctctgagtcctgcccagaggagagagtaggcactgaataaatgcttgctggctggaatggagtgagaaagggcatcactgttgacttaccttcctgtgtcttccctttcagcggcccacatgtgcagcaccctggagcataactgtgcccacttctgcatcaacatccctggctcatacgtctgcaggtgcaaacaaggctacattctcaactcggatcagacgacttgcagaagtaagattgctttgctgatgtatttgtggtttcttcctattccctcatcctctcccttcttttatctgggctcattttattcatctgtgatgcctcacccaccccagttatcatcccttggggacagaaataaagtttggtattttctgttgaccccatcacagtgcctagtccagagctgggcacatagtaggccatcaggaagagttggagagataggtagaagcaccatctcagaaatagcctctttggatgtgtgaactggtctcctttacttccaagcttgttctttagcagggactactgaagagccttttcatccactgtctttattaactgtaccctaaggaactgtttccatattttattatcttctataaagtgtggatttaggaagagttgttaacctcggctgggagtgattattcaagttctgttttagaggggtgcagggacccagttgctttggtgtgggacactttataggtgtcctagattttaaaaagggggtaaacagatgtaagatattagaactcgcattctcttttttggctaagtgccaaagactagacagtatactgatatttgagccagcacgaggtagtctaccccttaaaggacagaattactcatacactgagtaccgtgtccttactttttaaagttatggataaagccactgagttaacctacagatgaccaggctaccaaaaacaagtcatgaggaagaccagcccacatggaagcaaataaaactcagctaatctgacacttagttcgtgcagtgcataactgttgccatgtgtaattgttgcagtgtgtcattgttgcaatgtataattgttgttatacctcatggcaagcaattaagcattaatggaaagcagtttgcacaaatggctgtaattagtgtcacatttatagaggccaaccacctttttcatgtttcttctcactgtttttcagttttggggttgagtggttggctggagttctccctgcccctcaagattaggtaacatctacttgaccctccgcttctgtgtggcctgtggaaacccaaagccctctggactctgaatcgcaggggtggggtgggcggtatgtgttcttaggctcctctaagaccccaggatcccaagttgagtgcagcctgaatcatcctcatcttccggttgaagatctgacgcttcctcaaaatccataacaaaaactcactcccaccgaatactcatgggtttcatagagtttcctaaagaactgggggagcctgggaaaggtcatctcacacactgctcagcaaacaacctagagatctctttagacacccccctctagacacctccacctcttcaggtgttctacctccccacaaccatcctctggaggcacccttcctcctcttcaggcatcctcccctctgcccggatgcttctctgtcccatctcagcttcccaccatcttgcccactcccttcctgccctttctccttctccttctctgtctccttctccttctccttctccttctcctcctcctccacctcctcctcctcctccttcttcttcttttcctttgtttttttaagacagggtcttgctctgtcgtccaggctgtagtgcagtggcacaattatggctcactgtaccctcaaccttccgggttcaagcagtcctcccacctcagcctcctgagtatcagggaccacagctgcatgccaccatgcctggctaatttttgtagagatgaggttgctcaggctgctctcgaactcctgagctcaagtgctccatctgcctcaacccccaaagtgctgagatttacaggattgagccgctgtgcctggtgcccttctcttcttaggagcacaaggaattcctctccttgtctcatgtcccactgagtgactgggatctgggaatctgctgatatttattttccgtgggctggcctagccaagccagaggaattctgacaccagcaaataaaaaataaagtgttctttccctaattttatgagcaaggccttcccccacacagcagagtttgccagacccctgcctggtcctgccacaggccctgatgtcccccagatctcaagtactgctctggccttggattcctcctgcctagggatgtgccacaggagaatatgaagcagaccctgcctggacttcagacagactgaccagggggaggggcagggaggtccaggcggaggagggctaggagctcagggcaggctttctcaaacttcagtgactaagaatgagccaggaaactgacttctgggctcacccgcagagatgcagagtcaacaggtctggattttcaatgaaccgacgaatgactgccacactttgagattcactggcctcaggcagtgaggggtcccagggaagggcttagcagagctctgctgtcccgtctgacccagctctccagtcaccctgaagcagttaaaccatcttaaccttcagccagacttagcttaataaatgtgcagtgataaagaacagctctctctctttcagaaggggataatactaataactcttttgctttcccaaaattggtgtaccaggggccttggtggaagaacaaggccttcactgtctgcagatctgggcttgaacccgaccttatcacttaccaactatggctgtctcactctgagctggttatttaaacttcttgactctcagtttcctcgcccataagaggggacgggtggtaacaaatcaatacctgtctcactgattatgtccttgttaggccctgtttttggtctaggggacagttaaaagctgtgccaagtgaaggctgtgccatctactgacccctgctgatgagcagggacctgtgcctgccaacactgagagaaactcacagtgggcctggagaggaggcatgtactccacttctggaagctgtttccacttaatttccatgtcctgggcgtagctggataatctcccagatgaaaagccatgtgggtgacacctcctccccaaagcacctcttactctctaagaagtgcttgccattcattcttccatacaatcattgattggttcatttattttttcatttaacaattgtttttgagcataaaaatgtgccaggcagcatgcaaagtactggaaataaaatagtgaataacacagcaatattctttcttttttggagctcacatttttgcatgggagtgaatcaaataaacaaccagggtaattgcaaccaaaagtgactgcaatccacgtccacctcagtgtgcaacacatgaggtcaagcctaactatagccacttgttaggtgtttaccatgtgccaggagctttcctgagtgttttatatctgctgtctcatttaattctcacaatgagctcttaaagtgggttttatcactctcattttacagataagcaaaataaggaacaaaaagtttagacgatttacccaagctcacatggctagcaatgtgatcaaaccagaatccaaatcctgttatgtcctcgctcttggccatcatttgagactgtcccatgaccctagaggaccccgacatggcagcaggacaacccttcaatcagaaaaccttctccaagccgggaagacagataggttcctcagcccactaatccaggggagacttagaactaattcaggactaacattcaacagattgttacttccccaagtccactgctaattgctgtggtactgtcatcacacaaaataatagtgggagggcctcttcagcaactgccttcaaatacacacacacatacacactatagaaaaaaaaaaaaaatatatatatatatatataatctccccaccattgtatatttgtaatttgtgtggagagggaaagcagacacagttgatccacacattctttgaatggtgatggaccttggctattagacttctggcttcctctcttatggaacttcagaattctgtcccctcccagtgtcccagaggggtgatggttcttacagaatcaggttattacaaaacacctgaatcccatattcagacagcttggatcagcggttgagctgaaatcctacttgtctataatttccacttttatcctatttctgctatctgaagccatataccaaaaagttatttccttatccaaataaatagagaaagcccttcaattattatacagtgttattcccacacactgaccccattcctatcaattttctcttcttcaggggagaaacacatcttttgatgacctagttttgggtctcttcactgtccaggtaaccctcttctgggtggatattagttgtctaaaaagggcctttccattcgaagactagatcaaatgcattaaagaattttagcttccatcacttcttggccttttggctaagatcaaggtgtagaattttatcttccaagttgtgtctatatgggcaattttgaacatactggacctcaacattgtggattccttctgcctttcaaaaagtcttccctgtcaaataccattatatgagatatatgcaagagcatcagcataatactagaacaatggaattttatgttccttccttttcccatttaaaaaaaatggggggaaagaaaacctcatgaagtgtgcccgtcttcacatgctatttccccttatccttccccttcccagaattcctgtcctactaagaaagaactttatcttgtttctttttcttgatatattttcaaaataaggaattttccctttcttctggaacatttaatctatctggaagctgatgataatgcagcatttagaaaactccatttggcagaaaatgtagactttcttatccagcttaaattttttttcttctctcaagaacgataccaaatgcattttactgctttcattctttggaaatgttcccaacattatttttcccaagctacataagtgatttaatagatttatgttagagtttaaacaaggagcatgacccagaaaaaccactgaattattagagagagataactataaccaacattctttgtgaatttagatgtgaaaattcttaaaaatttagcaaatagaattcaacaatatatagaaagaacaatacatcaagaccaaatggagtttattccaagaatgcaagtttggtttaacattcaaaaatcaatcaatataattaatcatagtggcgaggtgtggtggctcatgcctgcaatcctagcactttgggagactgagttgggcgtatcacctgaggtcaggagtttgagaccaacctagctaacatggcaaaaccctgtctctactaaaaatacaaaaattaccctggtgtggtggtgcatgcctgtaatcccaattactcaggaggctgaggcaggagaatcacttgaacctgggaggtgtaggttgtgagccaagattgcaccactgcactccagcaacagagcgagactccgtctcaaaacaacaacaacaacaaaaagccactaaaactaataaatgagtttagcaatgttgcaagataaaaagtcaatatacttaaaaaattacttcattgtatttctgtacactggcaacaaaagtcagaaattgagattttaaaataccaggtataatggcatcaaaaatatgtaaattagggataaattttaaagatgtgtatgatttacacattgaaaaatataaaagatttctgagattaatttaaaaaaaacctaaataaatggagagatataccctatcatggattggaagacttaatatggccaagatgtcaattctttccaaattgatccatagattcaaagcaatccccttcaaaatcctagcagacctatttttttagaaatcgacaactgattttaaaatatacatgaacatgcaaaaaaactagaatagtcaaacccagtcagttctcattattcccagtagttatcatccataaaatatccataaacactaaattgcaaattctgaatcattgctcctagatgaaatacagagttgggttcctgagagcttccaatcacaacattcatcaatcaatacataaacttgtttgatgttctgtttaaacacacgtttttgagtatatactgttaattcattaacattgaaagctatcgttcatattttgaatgaagtacttaggaacaatagacagcagatcagcattactcttgggggccattttcaacagcaaaatctccaacaagaagtacaaaaaggcaaaaaatgtggcactgcatagaccacagaaaggatgcttgttcatgggatgagagctgaaataagaagacagaacgttgccttgtttgaccttacctgggaatatgtgtcctgggtgactcaaattttttgccactctgtgtatgtccatgaatggctgagaaagtgtcatgggtattgacttggggttacaagcaaattttagcaagtaggcagattcacaaatatggaatctgtgaatcatgcacattaaacaaagctttgaaaaagataaagttcatctttaaattttgtttaaactacctgatttcaagactaagtataaaacaacagtaatcaagacagtgtggcattggtataaagatgaacatatagagcaatggaacagaacagaatcgagaaataacccatatgtatgtggtgaaatgattttttgacggagtgggaaggcaattcaatgaggaaacaataatgtcttcaacaaatggtgttgcagcaattgaactgccatgtgcaaaaaagcaagcaaacaaacaaaaggaacataaatcttgtctttacctcataacatgtataaaaattaattgaaaatgtattctaagcctaaatgcaagagcagacactattaaataccatgatgaaatggtagaagaaaaatcttgatgacctcaggttggcaaagatttcttaaatagtacacaaaaagctacaaaacataaaagaaaaaaatcaatatatttaatcacaatgaaaacatttgctcttcagtactctgctactaaaatgaaagggcaagccacagattggaataaaacatttgcaaaacatatgtccaacaaaggactttagaatataaggaattcttagctcagtaccaagtaccaagtattcagtaccaagaagacaaacaccaccataaaaatgggcaaaatatttgaacagacactaaaccatggaagacatatgggtagtgaagaagcacatgaagagatgctcaatgttatcagacaggagatatcactatacctccactagaatggatttttttttttttttttgagacagagtcttgctctgtcgcccaggctggagtgcagtggcgtgatctcagctcactgcaacctctgcctcctgggccaagcaattcccctgcctcaacctccaagtagctggatctacaggcacgcaccaccaagcctggctaattttttttttgtatttactagtagagatggggtttcaccatgttggccaggctggtcttgaacttctgaactcagatcatctgtccacctcagcctcccaaagtgctgggattacagtcttgagccactgtgcctgaccagagtggataaattttaaaagattgactataccatgtgttcgcaaaattgggaactggaatgctcatacatcaccagtggtcatgtaaaatggttcagccactctggaaaacagcttagcggtttcttacaaagttagatatttacctatcatgtgacccagccattccacttttaagtatttactcaaaagaaataaaagtttatgtctaaaaaaagatttgaacacaaatgttcacatcagctttacttgtaatagccccaaactgaaaacaactcacatgttgattaacagatgaatgggtgatacactgcaatacacgcatcctgtataatactcctctgcagtgaaaagaatgcactattgaaacatgcagtagcctggatgcatctccaaatcactatgctgaatgaaagaaaccagacccaaaaaaaccagaacataccatgtggttccatttgtataaaatttttggaaatggtgcctactcagtaatgacagagagcagattagtgggtgcttggggccaaggagtggggagcagcagggagagggattacaaagcagcatcaggaaacttgggggggtgatgactatgctcattatcttgattgtggtgatgatatattgataagcccgatttatcaaactgtacacttgaagtatgtacagtttattgtatgccagttgtcactcaataaagctgacattcattaatcagaacaaggtttcggaagtaagtagtggcgctggaccagactgcctttctggaatagtttgtttgtggcatcagtggaggatgagagaaggaatgtaagcagggataaagtatggagcaatttgattctcaagctaagttccaacagtgtcctttgttgagtaggggaattgaacacagggtgtcaagggcaaaaccaggtcattttagtaaattggggctggcaataatgtatgtgctgtattagaggtagagagtggggcagggatgccttcactcatccgctcattcattcaatacctgtggattcccctctatgggcctgatactcttatggggtatttttcttacatattagggacccaagaaacattcagatcttggcttcccttttaccccccacacagagagcagaatataaaagatggaatcagagaacaattctaatcagtccagtcaattcagtgtatgtttcttacgcccgcagaattaagtaggagaccacggcaaccatcccagccccagggaggagtttatgacatcagataggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaaggtcaggttgtgagctctggggcagcccacagtcagaggatgggtcaaagctagaagggcgagcaggccgcacgcacacacacgcaaagcagctgccttcactgacaatcaatggcagccacctgagctgtggctgagctgctgtgagccgaagcagtgggcttgctaaatgccgtcatccagcttccccttgaccctggctgtcaggcctgggtctgggagcttagggatcattttgtgcagtctgctcaccctctggctgtgccagggcacaggattttctacaaaagaaggaatctggggtgagtagagccccatgggagaactgagctgactaaatgtgagtggagaaatgccaattatgaaaaaaatgtacatatcaggggaacatgagcttgaaccttgcacagcttttcctccgcttggctgtttttatgaggacccaggcaagtggttctcaaagtgtggtccccccggaaaacaatatcagctttgcccggaacttactagaaatgcaggttcccaggcttaccctagacccactgaatcaggacctctggaactggggcccaggaatgtgggttttcccaagccctccaggggatgtcgatgtatgctgcagtttaaggactactgacttagatgttttaaataagatctctccctggcagcatccactcaaaagggggtttatattaagaacataatgtgacaacggtttggaaattgaaaagcactctacaggagtaggacattatttttgtttgtttattatttttgtcaacctcattcactcagatttcactgtattttagaacttgtttcagagattccccccttcctccttttcccttccccgaggaaaaccaaaatcttgttagtgaacaggagaattgattgaaaaaaaattcaactgctgcgggaaaggaggagactaggcacagctggagtttgcctgaaaggataattttctcagtgacattgggtttgttttgtttctttcagtgtagaagcacgaggctgatgactcatttaccattggaagacttcaaatccaaactgcagttgtcaaaataagattagtgctttcagacatgatgaaagagagggcatggtctcgaaaaggcaagcttgggttttgcctgcatttgtggagccctaactcatagcaagctttcctgtgggagtgggcagagaccccatcgtttacccagttgagtgaaatggcagccctaataacccacttctccttctctcttgctgtgataaacaatttctgatttctacatctcagattaaataacagcaagagctataaaaagtagagggtgtctcctaaaggtgttcatttgctttaactccaaagatgagattaaactgtcattggtgtcaacagcgtgcagtgcagcttgtctaaaattctgaaacgttggtgaaaccctttgatttagccctggatgatggccatagcctttgccccatgctccgtgctcccccctcagttctgcctccttccggtgtaagcagatgaaagtttccaagttctctggactgagatgcaggcaccagggtttctaaaggaaggcacttacatctagggtgcatgggagtctctggggaaactgtggttgggtttgagcacagctttggggctcttggcagcaaatcttcactaattagtttcacctgggaagactgagttatccctcttaaaattctccaggcactgaaacaagcgagcagattttgctgactgtcagatacatgctaatggtagctccctggcaaggtgtatctcaaatttggccaggtctttttgttatgaaattccaaattacctactttgctgtatcacttcaatttagcatagaactcaaaaaccaaacttggccagagataaattttagaacgttaggatctaatattcatgtttgtagggatttttttttttttttttttttttttgagacaggatctcgctctgtctcccaggctggagtgcagtggcgcaatcatagcttactgcgacctggaactccctggctgaaatgatcttcctacctcagcctccctagtagctgggactacaggtgtgtgccactgtgcctggctaattttttaattttctgtagagacaagatgtcgttctgttgcccaggctggtcttgatcctcctgcgttggcctcccaaagtgctgggattataggtgtgacccatcgtgccggcccatgtttgcagcttttataggtacccaataaagtgaaactattagaattgggatgtgagcaaaatttggttgaagttcaactctctgccatgcttaaataggtatgtgccactgacacttttcttttcccccttgatttaggaaaggagaaggatgctaacatttgttgaatacttactgtcagccctgcacttcgggaggccagggcgggtagatcgcttgagctcatgagttcaagaccagcctgtccaacatggtgaaaccctgtctctacaaataatacaaaagttagctggtattttgctgagcgtggtggctcacgcctgtaatcccagcactttgggaggccaaggcgggcagatcacctgaggtcaggagttcgagatcagcctgggcaacacggtgaaaccctgtctctacttaaaatacaaaattaggtgggcatggtggcacatgcctgtaatcccagctactcagcatgagtactgaggcatgagaatcgcttgaacctaggaggcggagaatgcggtgagccaagatagcgccattgcactccagcctgggcaacaagagtaaatctccatctcaccaaaaaaaaaaaaaaaaaaagttagctgggtatggtggtgcgtacctttagtcccagctactcgggaggctgaggtggaaggattgcttgagctcgggaagcagaggttgcagtgagcctagattgtgccattgcactctagcctgggtgacagagccagaccttgtctcaaaaaaattaaaaataaaaaaataaaataaaaatatcttctgtgagacagatgctttgcccatctagattatctcactcaaccctacaaataagatatttaacctttttatgaaaactgaatctctcaaaagtcccttacttgaagtcgttacccagctggggccaagtctggctccaaagtcgatattcttttcacctgcctgcctcacccctaccctttctgaggagacgtaactgacatcctgccctcccccagtggtggctctcttcatcatttttcatgtcacctctttcaggtccaaataaaaatttggagaaggtcaaaatcatcttttcagttcacactgttaaaaatggaagcctgctctctcaccacgctcaactcccctttcctgcttataacgtatcacagatttttacctatttgctttgtttactatcaatcttctatcaggtatgtgctgctaaatgtttaacaatcaggtctccaggagacaaaagctctgatttgtagatttgccaatttccatggtgtaaatactcccaccgtggacatttcaagctaccaacgtggcctctttgaatgcagctgtgggaagagatgcacatcattgtgtgagtcagtacgagctgcctctagcacatgactggcccctcactggaccatcagctctataagggtaggaatttttctgttgttgtccactgattcactgttgttttcccagcactccgaaccattccatcgttgaatagatttattaattcagtcatccacaaatcagccacatggcagatgctagatatttgaactagcatgctgagcaagacaagcactgtggctgccctatgtggcaggtgaaatagacatgaaataattagttgcaaattaagcattaaattataattgtgttgaggattacaaatggaaactctgagggaggacttcacccctagtggcaggtcagagcttcctgagaaagcagactttcaggtgagtactaaaggaggtatgagagttaggtaggggaaaaggaggtcaggaagaggcttgagcattctaggcagaaggaatgacctttgcaaaggtcccaagacatgaagaagcttgatttgaaaatggagagggccatgtaaatggagcagagaaaataagaggaggcttgagataagactggagaggtgaaggggtgggtcttgtagcccccttgaccatcacattagagtttttggactccatcctaaagcagtgataagccattaagggttttaagcagaagagaggcaggagcagattactctggctacaggaggatgctaggctgggatgaatacaggaaaaccagttaagaggttgccatggctgttcagccaacagatgatagtggctccatggtggcaggggagatgaagagaagtaaatccaggattgactgggtctgaggggtacaggagagggaggaatcccatgactttcaagtttctgttcccatcttcgaccccagggtaaaagttagctattctaaaaattcatctttgctaaagagaaattaaagaatacttcagaatcatccccagctgtcccatttctgcccagtgacatttattaattgagacagagctctaggctgcccagcaagggaggctgtcaagtcaacaatagatggctactaagcaccaactgtgtgaagtgcatggcattatacaggcaccgtaaggaacaccaagacttagagacatggctctgtccttcacagagcttacaagagtaggtaagagagatgagttaggaacacctgacaaccctgtgcttgtgtcacatgagcatgagttcattcatccattcaacaagtacttgttgagcaaggacaaagtgccaggcactgtgctagataccgggatgcagtggatagcagggcacacaggttccctaactgtcatgacagcttttctggtgtccatagctgggggctggctctgagatgtcattgtgttcttgatgcaggacaagtgagccccaaagtggggcttagcccatgagggttcttggctttatccaggagagaattcaagggcaagcagaggtagatgtaaacagctttattgaagagacggtgttacagccctggcagtgttacgcctccgtgactgctcctgcagagcagggctatccttataggcagagagtaggtagtagctcagggcagttttacagtcatatttatacccacttttttttttttgagatggagtttcccaggctggagtgcagtggcgcgatctcagctcactgcaacatctgcctcctaggttcaagtgattctcctgcctcagcctcccaagtaactgggattacaggcacctgccaccacatctggctaattttgtatttttaatagagatggggtttcaccatgttggccaggctgctcttgaactcttgacctcacatgatccacctgcctcggtctccgaaaatgctgggattatgggtgtgatcccagtggcctatacccacttttaactgcatgcagattaagaggcagtttatgcaggaatttctagggaagggatagtagctcttggtttgtcaggtcattgacacggagggggtggttactcccaggtgttgccatggcaatggtaaactgacatgtcacactggtgggtgtgtcttatggaaagctgcttctgccccagccctcaatttgatcctgtgtccaagccctgcctctggagttaagctctgcctctggagttgagtcctgcctcctacctcactctgagccctcttctggtgtgtgaatacctcttgctgaggatgaggagaggcagagagacttggagagaattttgttcccatctcagtcatcttctgaggaccccacatctaatggaggagggtattcttaggactttagggccattcctcctgggaggcagggcatctgggcctttttcattgttcattcagcaaatgaactcttatggagaccaaatacatgtgctaggacactgtgctagactctggagagtcaaaactgacccgcttataatggggcagatagccgtgatcaagtccttccaataccatgggatcagtgccgaaatgctagagcggagccatgtctatagtgctgtgggggcccaggggaagaagccttaactccagccaacttgaaggaggcttcccacaggaggtgacatttgactggggttgtgagccattcatgggggtcaccaggtggagaaggtggaaggctgtgccggggcagggggagctctggacacagtgcttcttatccttcagtgaaatcctcctggcctcagagagaaagaagggctgtttttcaaaagcataaggaatcatccaaaaaacatctgtatttgtttcaaaaggaaatggccactgccagaaaaacagcaaagttgttttgtcagaacccagtctgtatttattcctttgtctttgtttaattagattaatccctgaatggtttcccttgggtcggtacaaatcgctcgtggccataaatccccaacaattctaaaaacagtaagaaaggacaatccgcatgaagccaactggcaagcttgctgtttgtgggacagttctgggatgcgagcagtaatcttgcacccgcacataggtgtttggggttcttttagcctcttggagaggggagcaaggacaacaatcactcagatttgtttagaagaggaaagctgaaccgtagggtctcatcattaaagggggagactgactcctggatctgggcaccttccccagggaggattgtggggactttttatctgttaggttcaatgacattcagcctggctgcacactggggctacctgggagctttgacaaacaccactgcccaaatcccaccccctgccagtctgatttaattgtggtggggagtaccttggcatcaagattttcaaaggtccctgctgcttctgtagatgggagcttgcagttactcacagactcttctgcggatatcccagtctgtcctgaaaggaacaagcatatccttgcctttctctacctaccctgtgcagggaagccttttagaaaaaaagattgttccttcaaggtcctggttccttgcttttgaaatggtactttcaaaagggttcttttgtaacaggttgatttttttgtcttcctccattattataaaagttcctgttagaaaatttgaaatcagacaattataaataaaagaatgaaaaatcacctgtattcacaccactacttggtaaccatggtaggtagagttcctgccagacccctgatggggcaaggcagcatctgcagtagagattgggaggacccaggtggagaagctgctgccacccttccagagctggttccagcatgctggagcgtcacctcccagccatcaggacttcatgcagggacactgcccacccacttagggagcttagagtctagtaagagagacacagtacatccatcgctctataaatacatacgtagttaacattatgattcatgccaggagggaaaagtgcaggggtgggctgacagctgatgggtgaggccaaaagtgtaaagaatgtttaaaggtcctcatagcaagaggttaattttctcatcaccattcaggcaacccaaagctacttcagcccggaactcagaaacctactgctgttcccaagaaagcaatgcttttcattgaactttgctagaggtgcttaaattttcccaggcctgagaggatctgtggtgctgccagacttatccttccgaagcacaacttgggtgaaattgctggtctccctttttaaagtttttcccttgagtggtccccattgcccgctgattggagttcagcctatgcagcctgtgtgcagagatccctctgcctctggtgtcaatggtctttcccatcctctcttctgctacttcccctggaatttccagagcagaattcagctgccacgcctctcctgcttccctcttctgtttactcacgcgtcccaagcctggagtgctgtttctctttctccatacctgccagcctttcccagtccttgctagacttgcagtaatctgtcccaattctgaactcccatagttttcttggcacttctcttagggattcttatcatgtcctacctcgcatgttagttatttaggtggcatctaacaaccactctggcctttctgttcctcaaataggatcagtttgttcttcaggacctttgcattcactgttcttttggccgaaaatactcttcctaaaggttcatgttattaactcctagtaggatacaagctgcgtgacagcagaaaccccttgtctgttttgttcaccatgatatccccaatgcttgggacatagtatgcgctcaaaccgtatttattgactaaatgaatgaatatcgtatgattcagacatttcttatatctggcctagctcatttaggttttgtatttctttgattactcactacgatttttgtattagctgaagttttcttccggttatgggtgttttccttacatctgaatccactgaaaatctacattggactttctggttggagttctcaattggaaatgtgagatataaacttactggtgagaggtaaaagaatctgtgtctataaggcttttttttccatctactttattgatttgggagtgaaacttcttttaggagtttaaaaccagaattcttatttgtagactcttagacctaagcgtttttaaaatgtgatgatgtaagttttaatgtttaaaattgtttaatgcatttaatagagatgttgaatcaaatcagcttttatctttttaaaaatcaatttggatattttatatttatgtaaaagcataataaactatgaaactcaaagatctagaagatgatatgaaaatgtagccattggattcaggaattaatcaagctttctaggtaattaagtttttttaaatcatacctgttgtagtgatagcttttttttgtttgagacagtcttgttctgtcgcccaggctggagtgcaatggtgtgatctcggctcactgcaacctccatctcccgggttcaagccattctcctgcctcagcctcccatcttctgagtagctgggattacaggcgcgtgccaccacgccaagctaatttttgtatttttagtagagacggggtttcaccatgttggtcaggctgatctcgaacttctgacctcagatgatcctcccgccttggcctcccaaagtgttgggattacaggtgtgagctaccacgcccggccagtgatagcttttaaccagagaaaattctctttaatatattcaacccctttaatgctctctgattatctccagttttaatggcaaaatcaatggtacagctagctgtttcatggtatccaagctgttctccttgctgggaaatagtgttagagactgagtcagtgatggatggaagatgcctttaatcttttcatccaccaacatattcttagttctgttgcagtagatgcatactgcaagtccattcctacgttgcatgtgaataaacaggcagagcttagcacttagtggacatgtaataaatatttgaccaaaataagaccacgaatagacatgtatctatttctccctggcaatgtttgttacctctacctaacctcttttggcttctccattttcctcgtttgttattagaatgaatacatagagcacaaagagggttttcaaagagctttgtctcattccttcttataccagcaacagagtgagattctgtctcaaaaaaattatttaatgtatttcaaagtaattccaactttgaaaaatgtggtttttttatgttatttatttattttgagacagagactcgctctgtcgtccaggctggagtgcaatggcacgatcttggctcactgcaacctccgcctcctgagttcaagcgattctcctgcctcggcctcctgagtagctgggattacaagcacacaccaccacactcagctaatttttatatttttagtagagatgaggtttcaccatgttggccaggctggtctccaactcctgacctcaagtgatcggcccacctcggcctcccatagtgctggaattacaggcgtgagccaccgcatggctgaaaaatgtgtttttatatacatgcagaaactcacctggaaagaaaactcaccaaaatgttaacagtggttgcctctgggtagtaggattacagatggggggattacaggtgaattttcttttatctatttttttatgttttccaaattttctactatgatcacgtatcaaaccttacaatgtttttaaaagttactttggtgagggctctggagttccctgttgcctcaccctgggctgggagcattctcaggtgtgcctgacgttgtgttctaacatcgtgactttgcctcagtccaggatctgtgtgccatggaggaccacaactgtgagcagctctgtgtgaatgtgccgggctccttcgtctgccagtgctacagtggctacgccctggctgaggatgggaagaggtgtgtgggtgagtatccctccagctgggcttggtagggaaggacaagttaagcatggtgaggaggaggggagactcacgtgtacctcccacatatttgtttcctcacctttgggtttccacaaagtgctcagttgtttggtgtagttgttaggcagaatttgaactttaaaggcttcatttatggctgaggtcagcgttttcttattctgggtctccagtaaaaggaacacttatgataatccatgcaaatataactgtgtgttactgcatctcttgaaaaggatcgggtggattttcttcaactttggaggatatgtttggaatggcctgacttatatatagctcaggtgttatacatgaaatttacttgggtgggttgctgagtgacacctcaaagacaacgggcagccttcctccctaatgtcacctatagctcagtgacaggccaaagtgactgccaggtgaaagagcccagccatatgggctcagcgtaattagacggcgtggtcagaggaaactagcagtagcctcaaaccctcaaacacaagcccaggtaatgaggctcaagggcagtgcttgatgctgcagacatcccccctgtttatctacaaagcctttgcaacttaacatggtctcattcctccttataccaacaaacagtgcctggtggatagtaggtgtttcataaactgaactgaatacttatgaggcagaaaatctagaaggaaaagaacttgactgacatcaaaactggaatgtaaattttctgctaaatcctgcattttgtcttccgtgttctattgttttcaggaccctattttattttgcttcgcacaaacagggtatgcttatatttttgcacatagaatttgcattttccagcacaccttaattcttagctagggatgtggaaggcaaaacaaaacaacaacaaaacaaaagttaggtggtagcctgcaattggcaggtgagtgatgagagtatcgtgggtttgtttttacacactgataggaatgaaagcaacctctgcctctgactctcatcaaagggccacaaatgcagctggtctcctgggccttagggttgtttttcttcttaatctgctggtggtggccatgatagagtggcagggttccacacccactaccactagcaaaaaagaagccaacatatatacccatggttatttttgcttcattaatttttattatgcaagtaatacccgttcatagagaaacttaaacagatgagaaaaatcactattaataggttattgtattttctaccagactttctccatataaatatctactttaaaacattttgttggacaggtgcgatggctcacgtctgtaatcccagcactatgggaggccgaggcgggcagatcacttgaggtcaggagtttgagaccaacctggccaatatggcgaaacccggtctctactaaaaatacaaaaattagctgggtctggtagtgtgcccctgtattttcagctagttgggagggtgaggaagaagaatcacttgaccctgggaggcggattttgcagtgagctgagattgtgccactgcactccagcctgggtgacagagcgagactcatctcaaacaaacaaacaaataaacaaaaaacattttgtaaagatttaacaaaatgaggtcacactgtctattttgttttacaacctgctttttcccctctactatttgttaaatgggtagaaactctgagtgctgtttggtcaggaggaaatcaagccattgtgagttaggctggtggaggagcttcaggaaacaggatgagggtaatgggttgattaggacaaggggagggacagtagaacacagggcttgcattggtcacagggagtagatggggcaggaagcccaccttggcccatgggaaactggaggcccctgaaaaacccatttctctgagtgtttccaaataattacctgcttgtccgtgtgtagtagagaacctttgtatctctgaggattttgctgtaacttttgggatttgacatttattgaagagctacaagcgtgggagggtagatgctgtcattgccagagagctttggcgtgctgtttatcggagatgggcgtttctctgcggctgcttgactgcatataagaatgtctgcattttctcagtggggatccaatccaaagagtgggaaaatgggagagactgcatcccattgcaacccaggtctcctccgtcagatgatcctagcatcaccagccttaccaccttttccccaatgccctttacagcggttcactaagcactcgatctgttagaggctgggagtgagatgattaagcaggcagtacttttgttgccagtagcctttcttagggactccagacaaaatcctacaaggttagttgctgctcaatagggctatggtgagtacaacgcaaatgatagagaaaatattggccacggaaggtcagagagagacatcctaatggctaggctggaagatctgagtgtggaaggaagggtggcaattggacaaatgtccaaggcagggggagagatgaagggcagtgactgtggaggtggcaatgctcttcaagcattagggctaagtctggcctaggagtggcagggccagctcctgggagctggtaggtcagagagagactgttacagtgaaaaggccaaactgaaagttaaccaggtggcctaacctgagggccagaaggcgcttatcaaagatggagactccaggtaccagacttagagcaggaaatttagaggagaggctggtgagaactctggacatactccattagtagctgatctggggtgccctgtgtgtagatggccagggaacattaagaacagagtgattatgcctcccagttaatacaggacaatcccagtttatgccctgttggcccaattcttttttttttttttcttttttttgagattgagtcttgctctgttgcccaggccatgatcacagctttgcagcctcgacctcctgggctcaagcgatactcccacctcagcctcctgagtagctgggaccacgtgtgtgcaccactgtgcccagctaatttattttttgtagagacagggtctccatacattgtctaggctggtctcaatctcctgggctcaagtgatcctcctgccttggcctcccaaagtgttgggattacaggtgtgagccacctcgcctgatgccatttctttttatttttagacagggtctcactctgtcacccagactggagtacagtggcgcgacctcggctcactgcaacctctgtcccccaggctcacatgatcctcccacctcagactcccaagttgctgggaccacaggtgcataccacacgtctggctaattttttgtatttttggtagagatggggtcttgctatgttgcccaggcaggtattgaactcctgagctcaagtagtctacctgcctcggcctcctaaagtgcagggattatagacatgagccactgcgcccgactgaccccatttcttacccagctggcctcatttcttgatggcacatcttttcactttgaaaggggttccagtttggatgataaattacataatcaccctagttaaggctgtccaatttgacttaaactgttaagttcagcagagaattcctgtatacatgaagtaggagatgaagttgaagacagcagaaggaactggattgttcagggctttgaaaatcagacgtaaagcctagattttatctctgaaaaagagccaccgaagggtttatatttgggtgacaaatgcaaagcttcatttttaggaaactcaacctcatggggaactgcagggtgtattccaggagaaggatggcaagaagtgggaagaccagataggagattgtagcagttatcgggtgagagaggataggaaccagccaggatttgaggtgcaactgtaggaaaggagagggagacagtaaggaatgaaagaaggtgctgtacataaagggaacaaggagaagtcaaaagtgactctaggccaggtaccgtggcacatgtctataatcctagtactttgggaggccaaagtaggaggattgcttgagcccaggtgttcaagactaacctgggcaacatagtgagacccccatctctaccaaaaaataaaaaaattagttggacatggctggatgtggtggctcatgcctgtaatcccagcactttgggaggctgaggcaggcagatcacctgaggtcaggagtttgtgaccagcctggccaacatgatgaaactccatctctactaaaaaaaaatacaaaattagtcaggcgtggtggcagtcacctgtagtcccagctactccagaggctgaggcaggagaatcgcttgaacctgggaggcagaggttgcagtgagccgagatcgcaccattgcactccagcctgggcaacaagagcaaaactctgtctcaaaaacaaaacaaaaatattagccaagcatgttggtgcacatgctggtggtcacagctacttgggaggctgaggtaggaggattgcttgagcccaggagatcattcaaggctgcagaaagtcatgttcacaccactgtactccagcctgggcgacacagcaagaccttgtctcaaaaaaaaaataaatgaataaaattgaaaaagactccatgatcttgagcttccatggctgtgagagtgatggcaacagtgatggaagagtgatggaatcgattttcaaaaagataaggccaagcgtggtggctcatgcctgtaaacctaggactttgtgaggccaaggtgggaggattgcttgagaccaggagttctagacaggcctgggcaacaaagcaagaccctatatctacaaaaaaattaagaaattagctgggtatggtggtgcacacctgaagtcccagctactccagaggctgaggtgggaggggtgggaggattgcttgagcccaggatgttgagactatagtgagccatgatagtgccgctgcactctagcctgggcaacagagtaagaccttgtctcaaaaaaaaaaaaaatgttggggtgataattagtagtcattgacaaggtgaattttgaattcaggttagacaccacaaggacacgtcaagaggaagcagaaaactcggcattaacatgacagagagagtagaatcaatgctgtagtcaggaagcagcatagtttatttcttaacttccagttattttctattttaaatatttatgtgtcagttggtttgttttgagggcatctagacctttaaaacagtgctacctgagctgaaatcccaactctgctacttgctaggtgtgttaggccatttgcgttgctataaaggaatacctgagattagctaaaagaaaaggtttaattggctcatgattctgcaggctgtataggaagcatgacaccagcatctgcttctggtgagggcctcaggaaacttccaatcatggtagaaggtgaaggcggagcaggcatgtcacatggtgagagcaggagcaagaggtagggggaggtgacacactcttttaagaccaaccaaatctcacatgaactaactgagcgagaaatcacttatcaccaagatgataacactaagccattaatgagagatccacagctatgatccaatacctcccactaagccccacctccaacattgggaatcacgtttcaacatcagatttggaggcaataagcatccaaaccatattattccactcctggccccccatatttcatgtccttctcacatttcaaaatacaatcgtgcctttgcaatagttccccaaagtcttaacttgttccaggcttaactcaaaagtctcaaactccaaagtctgaagtgtcatctggagatgagttccttccacctatgagcctgtgagatttaaaaaaaaaaaaagaaaaagtttttacttccaaggtacaaggtgttataggcactgggtaaatattctcatttcaaaagggagaaattggccaaaacaaagggcaataggaccatacaactttgaaacccagcagggcagctattacattttaaaactccaaaacaatctcctttgactccatgtcctgcatccaaggcacacaggtgcaaggggtgggcccccaaggccttggttggctccgcccctgtggttgcagggtatagcccccaaggctgccctcacaggttgttgggtgcccatggctcttgcatgctaaggttgcaaactgccagtggctctaccattctcaggtctggagggtggtggcccccttctcacagctccactaggcagtgccccagtagggactctgtatgagagttccaaccctacatttccctttggcactgacctagtagagtctctctatgaggcttcacccctgcagcaggcttctgcctggacatccaggctttccaagacatactctgaagtctagggagaagctgccaagcctctttcatgcctgcattctgtgtgcctgcagacttaacaccacatcgtagccactaaggtttatggtggcttgtactctctggagcagcagcccaagctgtacctgtggccctgtgagccatggctggagctggagcagcctggatgtgaggagcagtgtgctgaggctacacagggcagtagtgccctggacctggccccccaaatcatttttttcccctaggcctctgggcctttgatggggagtgggtgctgcctagaagatctctgaaatgcctttgaggcctttttcccatgtcttggatatttgcacttggctcccttttagttacactaatctctctagcaagtggttgctccacagcctgcttgtattcctgtcctgaaaatgccttttctttctctgccacatggctaggctgcaaattttccaaacttgtacattctgcttcccttttacatataagttccaactttatttctttgctccagtatctgatcataggcttgaatgctttgctgtttagaaattttttccatcagatagctaccttaggtcatccctcttaaattcaaacttccacagatccctagggcatgaacacaacccagctaagatctttgctaaggcatagaattggtgacctttactccagttcccaataaattcttcatttctatctgagatctcatcagcctggcctttactgtccatatctattagcattttggtcacaaccacttaacaagtctctaaggagttccaaactttccctcatcttcctgtcttcttctaagccctccaaactcatctgacctctgcccattgcccagttccaaagctgcttccatactttcaagtgtgttaatagcaacaccccactctcagtaccggttttctgtgttaggctgcttgcattgctctaaaggagtacctgagactgggtaatttatttgaaaaagaaagagtttaattggctcacagttctgcaggctgtacaagaagcatggcattggcctctgcttctggtgagggcctcagaaagtttacaatcaaggcaaaagccaaagggggagcaagtatgtcacatgacaaggacaagagtgagagttgggaggtggggagatgccacacttttaaacaaccaggtctcatgtgaactaactgagcaagaactcactcatcacctaggggtggtgctaagccatttatgggggatctgtccctgtgatccaatacttcccaccagggtccacctgtaacacgggggatcacatttcagtgtgagatttggagggcacaaacatccagaccgtatcactaagcacatatctttaagtctaatttctgagcttattttcctcacccataatgtagaatagtaatatatacattgtaaggttttatgggattaaataagatagtgagtgacattcccaatatactctaagaacttagcattattattacaacacctactattatcgtaatttcctgtatatagtgaagtatggagtgagaagagagtgaaggactgagccttggattgcagtcacatgtagggagcaggaagtaggggcaggaaaaatattcatgaagaagtagcttaaggctgggggagagagagaagaatcatggaacatgataggaagataatttcttggccaggtcaatattaatgtcatgcttcagcatggccaaaggtaacaggacttagagaaaaagccatcaacttgagtcacagattcaccgctgcaaacatttcagaactctgccagggactttgctaggcttgaggagcacaaaggtgaccaggaggccattgagaatggcaaagggggcatgggtaaagggcagatttcaagaggcagggagtgggtgacaagaaagtgtgggcagcaggttcaaactatttatttaaagaaatttggtagaagttaagcatgtccagctgatgcagggcaggcaagtcccaaagtggagcttagcctacctgggttcttggctttgcccagggaagaattcaagggcaagccagaggtagaagaaaacagctttattgaagaggcagtgttatagctccatgactgctcttgcagagcagggctaccctgtaggcagagaatagcagcttaggcagttttgcagtcatatttatacccactttcaattgcaggcacgttaaggggaggtttatgcagaaatttctagggaaggggtagtaatcgttgggtcattgcccaatgatagtaagggatggtaactcccaggtgttgccatagcaacagtaaattgacatggtatactgattgaagtctgattgaaggctgctttcaccccagccctgttttagctagttctcaatcaggtccgatgtctcagccccacctctggagtcaagtcctgcctcctacctcacagctactagtgaatttatgcagtagattttcagtttcaacactttcatagctactgctatgaaaagcacttcttttgttaccaaaacattaggggttcagtctaggtcctgttgcttgttgcacagaaagccaatcactgagacaacaagtattaccaggaaagaaggcttcagtcaggtgccatagccaagaagatgggagatcagtctcaaatccatctccctgactgactaaaattagggatttaggctggatgtggtggcttatgcatgtaatcccagcactttgagaggccaaggtgggaggatcacttgagaccaggagtttgagaccagcctagacaacatagtaagactcctgtctctacaaagaataaaaaaaaatcagctgggtgtggtggccaacacctgtagtcccagctactcaggagggaagattgcttgagtctgggaggttgaggctgcagtgagccatgattgcactactgcattccagcctgggtgacagagtgagaccctgcctcagaataaaataaaataaataaaataaaaattaggggtttatatagcagggaataaatgtaaacatatgggggaaaacaggaattagggaggagtatggaagaggagttggtcaacacgcagcaggtggttggttaggcagtcataaatggggaggggtctggcatgtcattgtgcagatgcagtgatctggtaagtttcagccccttgatactgtcagagagtcctgacggtttggttcttgagaagggttctcagataaaacaaatgtaactttctcaagtttcaagactggaaaggtaaatttctatgtttattcaaaataaaccataaacatcagttctgtgggacaattgggccggtttcactttgattcatccctgaattattactgtgacctgcatgaaagttcagttcttagtcatggactcagcatttttttatagatttccacacatttgagtaagtggaacgttcaattccagcaccagagttccaactccctgacagctcatttcaccattgagagtcctgaatttattccgtattcaatggtggattgctgactaagaacctcctctgctttagtggagtccctgaatttataattcatcagctgccactaaagtcatgttcattgccatccaaaactatttttcaaagaccatttatctagatttctgaacatgaattttctgctgtacttactcacctggtgtttacaaactgtcttttattttggggtaactttggtcctgtttgcatcttatctacccaggcagattgtaaacccttgagggcaaaaccacttgtacttttcatctttcacagagtggacttgaaatacattttcttgaagcactgactgaggttgattgcaatctcatgcattcatgttttgtaaaaaatatttcccccattgactggtttttaaattataaagtcatttttgcttattaaaaaaaaaaagtcaggccaggcatggtggctcaagcctgtaatcccagcacttcgggaggccaaggcgggcggatctcttgagctcaggagttcgagaccagcctggtcaacatggtgaaaacctgtcactacaaaaataacaaaaattagctgggggtggtagcacacacctgtagtcccagctattcaggaggctgaggtgggagaattgattgagcccaaggagatatgtgccaccacccccagctaatggaccaacaccgtctctaccaaaaatatataaagaaattagccaggcatggtggcacgtgcatgtagtcccagctacttgggaggctgaggtgggaggatggcttgagtctgggagggctgaggttgcagtgagccgtgatcatgccactgcattagagcctgggcgacagaatgagaccctgtctcaaaaaaaaaaaaaaagaaaagaaaagaaaagaaattttctctgggttttaaatcctgcatttggaattccagttatgccttggagaagagaggttttgtgagtctgactctgtgtgtgtgtgtctaatgtatgctcagcaagtaaattggttctaccatttctctaaatgacaaatttggtttttcttactttgttatcagcaaactttaaactccaaatgctcctctttaaaatatactatttctgctaatgccattcccttgcagacggagtcctgctgagaaaacgttagaattggaccaggttataaaacagaaatcattgattttagggttttattacctgcagcaaggtatcatttattcttagagacagtggagtgatttctcacatgttgggcagagaatgaatgtggcaagactgacttctgactctgggatcttagcacttgtgatctggagggctaaagagctacagctggagaattactctttccatttgtaaacaagaatgtagacattttaggcataaatgactgagaacagattttgttgaagtagatgagaacttggaacaatagagccatcattgagttatacaagaggtcacctccatacatctgcctccctaatcttgacctctctttttatgagtacaattttgcaaccaagaaagttatgcaaacaacccaaaccacttggcaaataacattagagctgaatgccctagaactctcttggccttaaaaaactgttagattcacatgcctggcagtgggttcttccatgtttaaccactgcactgatggcctcatctgccgtctccagaagcctagcagtgtgtcagtgggtggatttcaaattgagatgggatttgacaccttggagttttacagactggagacttgggacccaggaatgcgtgaatcctgccttgccaatcacatcctcccccttagttccccagagagctgtgtacacaaagaacaaaaacattatgagagtcaagatccagagaagctctcttatctcatgaattgggcctgtggttagctgataaatggaaaacatcattcagagaggggaatcctaaaaaactatatatgcaaacccaccttagtcattttatttttatttaaaacacataaatgtatacttagtaaaaatcacttttatgcttttaaaaaatgctaattttaagttgaagaaaaaagtatgatatttacaaatctttttttttttttttttgagatggtataattctgttgcccagattggagtgcagtggcatgatcttggttccccgcagcctcaatctcccaaactcaagcaatcctcccacctcagcctcctgagtagcttggaccacaggtgcatgccaccatgcccagctaatttttgtattttttgtagagatggggtctcgctatgtatcccaggctggtctcgaacccctgggctcaagcagtctgcctgcctcggcctcccaaagtgctgggattatataaaaatcttttttgcataaaccatacccataatgtgttgtctatgattttttagttttggtttctttaaattggaacaaggatttcaagacatctgtaaagcagtctaacagcagaactcttgtaaattttaatgggaaatttcccaatgttttacatttgtttcatccatgcctggttctatagcaattttggttagcaaattgctttaattttttccaaagctttcaacaaaatttttatttttaaaaactcagtttcttttagtgcttatattttattggtttttattttatttatttatttattttgagacagaatttcgcttgttgcccaggctggagtgcagtggcacaatctcagctcactgcaacctccacctcctgggctcaagcaatcctcccacctcagcctccagagtaaatgcgacaacaggtgcccaccatcatacctggctaatttttgtatttttagtagagatggggtttcaccatgttggccaggctggtcttgagctcttagactcaagtgatccacccaccttggcctcccaaagcgctgggattacagatgtgagcctttttgttttgttttgtttttttgttttgttttgtttttgagatgtagtctcacactgtcgcccaggctggaatgcagtggcacgatcttggctcactgcaacctccacctcccagattcaaatgattctgctgcttcagtctcctgagtaactgggattacaggcgcctgccaccacgcccagctactttttatatttttagtacagatggggtttcaccatgttggccaggctggtcttgaactcctgaccttgtgatccacctgccttggcctcccaaagtgctgggattacaggcttgagccaccgcgtccagccccagcccagtttttataatatttaaattacttacaataacatgtacaaatgacacatacaggtttggaaacaaaagcaaccttgactctaacaatggctcttaagttttagcgtgcctcagaatcacctggagggcttgctcaaacacatattcctgggtcccactcccagaacttctgatcagtaggtctgggatggagcctgagaatgggcattactgacaagttctcaagcgatggttgatgcagttggttcacagaccacactttgagaaccaatgtttataagaatacatctcagtcaatggaaaaagtacacaggtgtcctagagcccatgtgttccaccaaggctgctttatcagcatacaacccagccaatgtgaggcgtgtacaggtgttttaaaacacaggtgttctaactgccttgagtgtgtagcatgccctgggttatcaggattcatatggtcagagggaatgaaagcgttgcttgatcaggagttgcttaaggagtgatcagttaaaagagcatcttagtacaacttttttcttgaaacacccgagccaatttggatactctattctataacattctggaaaaggggaaagtttggagtatgtggcttagattcaaagcctaagccaagccttcaacacctctctaaattattacattagtctaaattacggggccagcataattatgggatatccctctgagagacagaaatggccgggctcagattataccccatggtgtaagagaggacattcaagagaaaaggtagagtgtgagtttctgacttttaggtatagagacctgaccactcattgttgcagcaccatcaatgtcctacaatttggaagtcagatcagcagctcctctctttgtaggggatactaagaagtgggtggccatagataggactggctgactgatggcaggcacccatatccaggattgggagattttcatcatggtgaatcaagcccagcatgaggaagttgaagctggggattgttgactgctaacacgggcccaagcaggctctggcatggccaactcctgtgacaaacagactggaccgtgtgccagggtttagccttcctcgatctcagtgttcccagtgtcaccattgattcttttgatgatcccttggttcttgagaaatgagaaatgaactattagaaggatgtggtgctagctcagtctttatgttatgactcaactctagcaaccagctgatatccaatgacgttgagatcctgagatgacatgaatgccctatccccaacataatggcttgtgaattaaacctgcaaatactaggttctactagaactctttagggagctgaagttacaaaaacaatatttagactgaaacttttttttttttttgagacagagtcttgctctgttgcctgggctggaatgtagtggtgcaatctcggctcccgggttcaagcagttctccctgcctcagccttccgagtagctgggattacaggcacctgccaccatgcccagctattttttgtatttttagtagagacagggtttcgccatattggcaaggctggtctcaaactcctgacctccggtgatccaccctcctcagcctcccaaagtgctgggattacaggcgtgagccaccatgcctggcctagactgaaacttaatgaaactttgaagcaaaagaataaacgtaacacaggttattaccctttacaaatcttcagtgtccctttgcatctttttattgctatgctaaatatgtcattatcttctccatgcatggttttgctttttaaaattttacatatgtattacttttgtagattctatttccttgttattatttacacacttttgatattaatataatcctaaaacattgtagggagtacttttttttgaaaagggactggtcttaagctcctgagctcaaatgattgccctgcctcagtctcccaagtagctgggatttccaaaaacttttttttttttgagacagggtcttgctctgtcaaccccagagttgaccctaggtgcactctctttttctcatttcacctctaatccaacaggaatcctgttagccccaccttcagtatttaccaggtgtattagtttgctagagctatgctgtggtttggatatggtttgtttggcttcaccaagtctcgtgttgaaatttgacctctgtggccaggcacggtggctcatgcctgtaatcccagcactttgggaggaggctgaggccagtggatctcttgagctcagaaggttgaggccagcctggcccacatggtgaaaccccgttcctactaaaaatataaaaattagccagatgtggtggcgcacacctgtagtcccagctacttggatggctgaggcaggaggatcacttgaacccaggaggttgaggctgcagtgagcagaggtggtgccactgcactccagcctgggagacaaagtgagaccctgtctcaaaaaaaaaaaaaaaaaaaaaaaaaaaaaaggacaagaaatttgattcccaatgttggaggtgggacctgctggaaagtgtttgggtcgtagggacagatctcttcttataagaacaccagtcatattgaattagagcacgccaccctaataagcacattttaacttggttacttctgcaaagaccctatttccaaataaggccacattcgtaggtaccagggtttaggactccaacatgtctttttaggggacataattcaacccataacttccagaacaccactccccctcatcccctgcaacatcctggtttaagcctccacccttcctccctgggattactggagtcactttcttactggttttctactctcagatttgccctgtcagtctattcttgactcatgggtccagaaccctgcagtgactcccaactcattcagactaaaagctgaggtccttgcatggcccatgggtccctcctgactgcccccttctcatctcccacctctctccctcctccagccaccctggcctctttgctgatcctccagcccaccaggcagagtcccacctcctggccttcgcacttgctgtttgttttgcccaagataccctctcccagatatcctcacggctcgtattttagtcaacactcttcctaaccacccaccttctcagagaggcctctcctgaccacctctattacatcccacctgctacccactcccccactgaccctactcctattcattgttttgcttttctccagaattttctttatctcctaatagactatgctatttacttattttacttcttatctgctccccactcccagcatcattatccaaatatacgctccttgggggctggaattttggattattttcttacttgttctatccctagcacctaaaacaggacctggcccatagtaggtactcaggaactaatgaatacatttttgttcattacacatatttgtgtaatgaacacatatttgtggaactaatgaaacaaatgaaatatttgtggaacacaggaacacatttgtggaactaatgaaaaatcagccagtgtattttctcatacattgttaaatcatttacccttattcaatgttcatcttattttctaggattttttgttgttgttgtaaacaatgctattaatagtttattgtatataatttcacccttttcctggctatttctttgggtttcacgtccagggtgaacattgtcaaattgccttccaaaaggatctttctcaatttataatgcccctaccattaataacgctgctgcctttctaccactgggttttatctcatcttatttttgccagtttactaggtgtaagtgcaccttgtgatgattttgatttgcaattctttaacttttaaatacaattgttcacatgttctttagtttacttcctatatcttcctatatgaattgcctgatatagactcctgattttttttgaggggggcagagaccttgggttcataactgtttatcctactcttttggggggcaataatattaatcctaattaatatctgttatcattttgccctcatcctaccattcccttttcctctgtttgcatttctaattctgaatgtgttttattctctccagctgtggactactgtgcctcagaaaaccacggatgtgaacatgagtgtgtaaatgctgatggctcctacctttgccagtgccatgaaggatttgctcttaacccagataagaaaacgtgcacaagtaagttacacacacatgcacacacagagaaatatttgctgttactgctgtggtgactgtgaccatggaactctctcaagtatagattagcaatataattatgtcatgggggtctaataccttttgccccattcctcctctgtcaggactttcatgacttggcttaagaccatagaccactgtatctcaacatcactattcaaggaatatgatgaaggcaccatgtgtaggactgttccttcagcatctgctgagcatgctgacaatccgagcaacttacttcctgctaactcagcctgactgtgcccatcagtactaacagggcttgagatgttttcattgaagctttgtggcttgtgggctttagctctgactccacgcgagaaaatcgctgagccaaaaagaatcataagtgatttcttctggtggaccgcagtttgcaaagaactgctcatgttttgtttgagctatttagttcaattggattttaactgtatacataaaaatcagaattaatttcagctcccaaaatttgaacataaaattcgataaactaaagatgatcattagttttgcaaaaaagataataactagttacaaaaagattccaaaagtgttctattaaatataaaggtacatcaggagacttaagggattgtgtatggattattatccttctatagggaggatcacttgagaaaagcttgcttgttaagtattagggccaagcatttataaaaagtggactttaataacaatctagaatagggtaaggcacctcagagacatgcatcagtgagaaaacaggattttaattcataaaaagttcatgtacctacaacctttctaaaatgtattcactatgtaaaacaggatacatctgcacaaaacctttttcaacataaacttacttcctactcttcaatacctaaatatcagcagcttacaaacaccagagctggaggtttgggtgatgtatggaactataagggacacattaggtcaaaagcatacatttctggagccccaaccatgtgccaatagaaatgagtacggcaaggtccttaagggagaagataactgtggctgagtcttggaggtggagctgtcattcactaggcagaaaagggtgaggtgggggttccaggagaaggaaagaagttgaagatgtgaaccaagcagagaactgtagtctccatgccccgtgcatgactggcatatacagtggtttatttgttttgtttattgaaagagtaagtaaatgaatgagtgggctgctgtgtttgtggtctcccttcccttctgaatattctgaactgtaaaatagcagcctgtgctgtcgtcgtggttggggagttgtggttgttgggctgatgagtcagtgttcctcatcaaagaggaggccgtgggctgccagcagcgggccttggttctaatcccagcttctctgctttttctcttggtgatcttgggcaagttacttatgcctcagtttcctcagttacagtacaggatgataatgctgcctactgcatagcattattctttccttttttttttttttttttttttttgacactgggtcttactctgtcacccaggctggagagcagtgatgtgatctcggctcactgcaacctccacctcctgggttcaagcgattcccccacctcagcctcccaagtggctgagactacaggctcgcaccaacacacccagctaatttttttggtattttttgatagcagtggtgtttcaccatattagccaggctggtgtcgaatccctgacctcaagtgatccacccacctcagcctcccaaagtgctgggaatacaggcatgagccacagcacccggccatagcataatcttgaatactaaatgaggctgggcacagtggctcacgcctgtaatcccagcactttgggaagagaagcaggaggattacttgagcccaggagtttgagaccagccctggtaatatggagggaccctatttctacaaaaactgttttttttttaattagccaggtatggtgacaagtgtctgtactcccagctacttgggaggctcaggtgggaagatcactagttgggcctgggaggttggggctgtagtgagccatgatggcaccactgcactccagcctggaggacacagtaagaccttgtcttaaaaaaaaaaaaaggctaaaaagggatgatgtgggtttcaaagactttatttattatcattatgtttttttagaaataggatcttactctgtcacccatgctggaatgcagtggtgcaatcctagctcattgcagcttccaactcctgggctcaagcaatcctcccacctcagcctcccaaagtgctggaattatggtcatcatgagccaccacacctggcctccaaaactctaaaaaaatgagtatttaactgtgcatataccacgtgcctgggctacatttaaaggtgcaaaaaacattcaagatttccactgcaagctggtgagggaccttagccatagccacactgagtagctgagtcatggtgccaggagttatgtgaccaagggcctacagtgtgatgcagccaggaccacagcaggagttagaggaaggagaccagttagaccagaacaggtgagatgctgccttgcagggatgaggactggagaaaaacacatatcctagccagtctcctacctgcctctccagactgcacacactggctggggtcacctgatttccaccccagcaccagccctagttcccagagtggcaccatcttccccaccctgtggctcagcatgcctcctgtcccagatccccagcccagggtggtgcaggcaaggagggtgttggagccctggaatcagaccctggaagtagataccgcagcatagtgggactgggagaggaggtttagctaggagccacgggaggggctgatccagctgtgaggtctcaccagctaggcagcgagcccagcagtgcagttgtcagaatcaagatccagaagtgggccgccccaatgcgtgtgcagggaagagtgctgggagactggagggttcgtgcaggcagcctcagggcagtacatcccttagaagagccctcttcccaccatgcttggggtgggcaggagccagacccaggaggagggagacaagaggaagaaaggagacagagtacttggaaagctaagagtagaaaataaggcaaaagcccagtcgtaagaatgaaacactcaggagtgctccagatctgtggcagggacaagaactgagaaatagagactagttaaaattacagaaacaggatagaggcagaagctcagaaccgaagcagccaccctgttttagtgagtaccaaggcctcccaccagcttccagccaagtcggcctggttactgctgtgatgttgaaagatttttttttaaaattctacttcttatacacttgcaaaaaatgaaagaaactcagtttctcaaatttcagcctatatttttaaccaaaagtatatttgaaagcgaatacaattagtaagtgtgcaactattatctcaaaaaggtagactagtcaatgtaataaaccaagcatggttaatttatgattaagcaaaaatgtacataatagggctttatgttcatgaaccagtactataatttgaaatatgtaagtggtgttcaaaaaagcaccacctttatatcaatttcttaccctagagcagcccatccaaatctagacgggagaaaggtggaaacacacaggtaccatcagtttgcaaaaagttagcaagacttttctttttctggtattgttataaaacatacataatagaaaatttaccactgtactcattcagtggcattaaatacactcacattgtgaaaaacgcatatcctagcctgtctccttcctgcctctccagaccacaccccctggctggggtcacctgatttccacccagctgtaactatcctcaccatccatctccagaacttttcatcaccccaaactgaaacgctgtacccattgaacaataactccccattgcctgccctgtcaaccaccattctactttctgtctgtgaatttcaccactctcggcacttcatgtaagtgggattatatggtatttgtcctttgccgtctaacatatttcacttagcataatgtcctcaaggtttatctgtgttgtagtatatatcagaatttccttcctttttaagactgcataatattcaattatatgtatatatcccattttgtttatccatctgttgatggacgtttgggctccttccaccttttgcctattgtgaataaagctactataaagatgagtgttcaagtccttgctttcagttcttctgggtttttatacccagaagtggaattgctggtcctatggtagcaagactttttgagatctagattgaaacccttattcttgagccaagcatgagaaagaacactctcagatatccagggtcttttcaccagaaagatctatagaggacttcagtctgctggacagggattcatgtctttggtagcaaggagactgtgggctttgagtctaatgcttaatcatctaatgcctgtaaggatgaataaaggcaattgtggacaccatcttttgcatgttgccatttattattttcgtgcttggaggtcattatactcattgtttttcagtctccagtaataacttggttgacatttccatccttatttttcaaataagaatgctttgcacagagtaaggcactgaatgaatatttttgtgtttgcactagaaacaaaacacagaaggaagtaaactttttaaagtagagatggggtctgctatgttgctcaggttggactagacctcctgacctcaagtgattctcccagcttggcctcccaaagtgctgagattacaggatgagccaccattccggaaataattttatactgaatcagcaatagaagaactacaaagtatcggttgtcaggtttcttggccagagcatagttaacatactgagtgccactaccttcctacagcctgtaatatgccacttttgtgactccctatgtggataaatcaaacactttcagctggaagaggctttaaagttcaacctagttcttgcccaactatccatcctacaatattctcactgtgccatcatccaacctgcatttgaatacccccactgacaggatattcactataccccatggtagttcattccactttgtatagctctgactcttagaaagtgattccctagactgagctgatatctatttccttgctcttagaaatgaacaaaacaaatttggctacttgcgttctttgtggccactaagagtgagtcatatcagagtaactttatttcacttagtagactagccaggcatggaaaatgtagtagtgaccatctaaattttaataggcatttgaccaatttgtgtgtggaggaatttgtgctcaatgaatgattggttggtttgtaactggccgaatgtctgtaaccacaggatgctaattgttgaactgagatcctcctagaaggaggtttttaaacagcttgctgggaagaagccttatggagggatgagagctatcttccattcatagggtcccccgtgtttcttcatggtgtgcaatgtgtatgtatctaaactctcaaaaacacactccagtaagagtaataccaataaccttttattcattccacaaatatttgttgagtatctactatgtgtcagatatgattgtagacactgggcatgcagtaataaattaaacagaccaaaaagaaaccccaccaatatctgtccttatggagcctacattctattggagcaggataagagaatactacaggtctcaacagcaaagtaatactagtctttgattaaagatttgaaggcagtgagagaaggaggaaacctttgaggcagaggtagaaatgaaattctatgaaataaaatgatctgtgatactatcacacagcaccagtacaaaatggatatgttttagtccatttgtgttgctataaaggaacacctgagactgggtaatttataaagaaaataaggtttatttggctcatgattctgctggcgggaagactgggcatctagtgaaagcctaaggctgcttccactcacagcgggaggtgatgtggagccgacctgtgcagagatcacacggtgagagaggaagcaagagagaaaggatgaggcggtgctctttttaacaaccagctctcatgagaactaacagagcaaacgtactcattactgtgaggacagcaccaagctattcattagggattccccaccatgacccaaacacctcccattaagccccgcctccaacactgtggattaaattttaacatgaagtttatgggatcaaacatccaaactgtagcagatatgcacacctgaagctatatatatttattgtttttagcaatgttccctgattatgttcttctccaaatcacaggacacttcccacattgttcttttttgtatattatttgggccgttttccatggcaactagtttcacaaagtacaaatgtacaaatgtgtacatttatttttagtactttttctgattacaaaagtaatacaggttcattgagggaaactggttcctatagaagtgaaattctatgaaataaaatgatctgtgatactaccgcccagaaaaaaccactgtttttgtgtttgttttgctttttgagatgggtttctcaccatgttgcccaggctggtcttgatctcctgagctcaagcagtccttctgccttggtctcccaagttttgagattataggcgcacactactgcacctagctgataaccattgtttatgccaatttggaacatttctctccagtctttttttaatgtatgtgtatggatttatttttatagagttgagatcatgcagtataataataaatcataagcattttgacatgtcacttaaacgttatcaaaaacattttaatgtctgtgtaaaattctattatatgtatatgtcagaatgtgttcaggtttttttggctgctcaaataatattgtgataaacattcttatgcttgaatctttttttctgatcattttcttaggaacacaacaaaaaaggaaatttattgagtcaaaggcaattaacattttaagtcttttgatacatattcaaaattattttctaaaaacgttttaccgatttatactctaccatcagtgtttaagggggcaatttttatttttaaattaaattaaattatttatgatttcaataggtttttggggagcaggtggtgtttggttatatggacaagttctttagtggtgattctgagatttttggtgcaaccatcacctgagcaggatacatagtacccaatgtgtagtcttttatccctcaccaccctcccaccccaagtccattgtatcattcttatgcctttgcatcctcatagcttagctcccatttaaaagtgagaagtgggatatttggttttccattcctgagttacttcacttagaataatggtctccaactccatctaggttgctgcaaatgccattcttttgttcctttttatggctgagtagtattccatggtgtatatagacactgtattttctttatccacttgttgattgataggcattgggactggttccatatttttgcaattgcaaattgtattgctataaacatgcgtgtgcaagtatctttttcatataatgacttaatttcctctgggtagatactcagtagtgggattgctggatcaaatagtagatctacttttagttatttttttttgagacggagtctcgctctgtggcccaggctggagtgcagtggcgcgatctcggctcactgcaagctccacctccagggttcacgccattctcctgcctcagcctcccgagtggctgggactacaggtgcccgccaccacgcccagctaatttttttttttttttgtatttttagtagagacagggtttcatcgtgttagccagggtggtctcgaactcctgaacttgtgatccgcctgccttggcctctcaaagtgctgggattacaggcgtgagccaccgcacctggcctacttttagttctttaaggaatctctacattgctttccatagttgttgtactagtttacattcccaccagcagtgtaaacggaatttgtccatttcatcttaacacatggacacgtgatagggagcaacacacaccggggcctgtagcaaggagtggggagagggaaagcatccagaagaacagctaatggatgctgggcttaatacctgggtgatgcgctgatctgtgcagcaaaccaacatggcacacatttacctaacaaacctgcacatcctgcacatacaccctagaacttaaaataaaagttgaaggaaaaaaaagtgtttcttaagggagcaatttttaaaaatgttgctgattttctaggagaaaatttcttcttcttgcttttttatcatgtctttaatacctgttcttcataaaattatccaattatatatatctaatttataaatgtatgtttattggtgttattatttgattaatgaatattttccagtataagtgattgtaagggactcttacaaatttcatgaagcaagggactgtgcctctttgttcaacactgatcctagtgcctgtcccatggtaaatgctcagagaatatttactgaatgaatgaatgaacagggaagttaacatgtcttcatatattagacattcaagagagagggaataataaagatctgagctaaaataaaaggaatagaagacataaatcaatagagataattggtaaaaaccaaaatgtgttttttttagaagattaataaaattgataaatgtctaaccagactagtcaaggaagaaaaaagagagaagacacaaattactaatatcaggaatgagaaagtggacatcaatacatatcctacaaactttgaagcataatacaggccaagcatggtggatcatgcctgtaatctgaacactgtgggaggccaaagcaggaggatcacttgaggcaaggagttaaagaccagcctgggcaacatagagcccatctccaccaaaaaaaaaaaaaaaaaaatatatatatatatatatatacacacacacacacatatgtatacacacatacatatatatatatatatacagaaaaatcataaacaagtttatgccaataactatgacaacttagatgaaatggacaaattccttgaaagacacaaactactaaagtttacccaagaataaatagaggctgggcatggtggctcatacctgtaatcccagaactttgggaggcttaggtgggaggattgcttgagtccaggagttctagatcagcctgagtaacatagcaagaccccatctctacaaaaaataaataaattaactgggcatggtggcaagtgcctgtagtcccagctactcgaaaggctgaggcaggagggttgcttgagcccaggaggttgaggcttcagtaagccacgatcacaccactgcactccagcctgggcaacagagtgagactctctccccagaccgaccaaaaacaaaagaatatagtctgaatagatctctatctattaaaagaaatggaatttgcactttaaaaccttcccacagagaagacttcaaacctagttggcttaactggtgaattctaccaaaaatttgaagaaaaactcatactaattctacacaaattattccaaaaaattgaagaagaaagaacaattttcaactcatcctatgaggctatcagtaccctgatacccaaaccagaaaagaaagacataaaaaaagaaaactatacacaaatatttctcatgaaatacctgcaaaagttatttaaacagtttctagcaatcaaatttaacaatatattaaaaagtacaatacatcacaaccaagtgggatttattccaggaattcaaagttggcttaacattcaaaactcaatcaatgtaattcataatattaacatattaaaaagtcaaaaccatatgagccatctcaatagatgcagaaaaggcattggataagatctgacattcattttttctttaaataaactttcagcaaattaggaatgaaggtggccaggcgtggtggctcacgcctgtaatcccagtactttgggaggccgaggcgggcggatcatgaggtcaggagattgagaccatcctggctaacacggtgaaaccccgtctctcctaaaaatagaagaaattagctgggcatggtggcaggcacctgtagtcccagctactcgggaggctgaggcaggagaatggcgtgaacctgggaggcagagcttgcagtgagccgagatcgtgccactgcactccagcctgggcaacagagcaagactccatctcaaaaaaaaaaaaaaacggaatgaaggtaactgcctcaatctgataaagtgcatcagtgaaaaaactatcagctaacatcatacttaatagtgaaagacaatgctttctttatcagatcaggaataaaacagaatgtccactcacaccactgctatttaatattgtactggaagttctagccagtgcaataagacagagaaagatcaataaatggtacctagattgttaaaaaaaaacaccatctttattaacagataacatgatcacctgtgtagaaaatccaatggaatctattaaaaagctactagaactattaatagcaagtgaatttatcaaggttgcaggacacaagatcaatatacaaaaataagttagttttatatacttacaatggaccatcaaaatatgaaatttaaaaaaataccttttcaggctgggcacggtggctcatgcttgtaatcccagcacaatgggagaccaaagcaggtggatcacttgaggtcaggagtttgagacaagcctggccaacatggtgaaagcttgtctctactaaaaatatgaacattagccaggcatggtggcaggtgcctgtaatcctagctacttgggaagctgaggcaggggaattgcttgaacccaggaggcagaggtttcagtgagctgagattgcaccactgcattccagcctgggtgacagagcaagactctgtcaaaaaaaaaaaaaaaaaaaaaaagacaagccactcaataaaaatgggaaaaatatttgaatagaaacttcaccaaagaatatatagagatggcgaagaagcatatgaaaatatattcaacaacattagtcattaggtaaatacaaagtgaagtcatattgagataatcatacccactagaatgactaaaattaccaagtgatgatggggatacggagcaactggaactctcataaattgctggtgggaatgtttaagcagttaagcatacatgtcccatatgactcattcattatgcaaaaggaatgaaagcatatgtccacacaaaaacttgtgcattagtgttcatagctgctttatttgtgatagccccaaactgggaacaggtaaccagcccttcagcaagtgaatggataaacaaattgtggtataatcacatagtgaaatactactctgcaataaaaaggaacaaactattgacacacatatgaatctggatgaatctcaaaataattatgctgaatgaaagaaaccagacaaaaaagaatacatactatatgattacatttatttaaagttccttggggagataaaaaaagaagataaaaaataaaattctagaaaatgcaaactgatttatctggatagaaggtaaatggttatttgggactggagagagtggggaagaatgaattagcaagagacaggaggaaagttttgagagtaatgcatatgcttattattttgattgtggcgatggtttcatggcaggatacatatgcaaaatgcatcagattgtttttcttgagtatgtgcagtttggtttttgtcaattatacctcaaaaaaactaaaaacaagtagaagagactgtattattccaaaatttctatgtcataaaacacaaagagaggctgtggaaatgttctggcccatcactatcctatgggacactctggttgatggaaattctctgtttgcatcatacaatacagtagtcaggagccacacgtggccactgagcacttgagatacagccagtgcaacccagtaactgaatttttgtttcgttttgttttgtttgttagagacaggctcttgctttgttgcccaggctggactgcagtggtacagtcatagctcatagctcactgcaatcaccaactcctgggctcatgagatctcctggcctcagcctccctagtagctgggactacaggcaggtgccaccatgctcagctaacttaaaaaaattatttttctgctgggcacagtggctcacgcctgtaatcctagcactttgagaggccgaggcgagtggattgcctgagttcaggagttcgagaacagcctgggcaacacggtgaaaccccgtctctactaaattacaaaaaattagctgggtgtggtggtgtgtgcctatagttccagctactcgggaggctgaggcaggagaattgcttgaacccgggaggcggagattgcagtgagctgagatcgtgccactgcactccaccctgggcagcagagcgagactctatctcaaaaaaaaaaaaaaattcttttttcagaaatggggtcttgctatgttgctcaggctggtctcaaatttctgggttcaagcaatcctccagcctcagcttcacaaagcattgggattacaagcatgagccaccacccctggctgaattttaattgttatttcattttaatcaattttaatttaaatagacatattaggcagcatggttctagattaagggagactaagcagatatgaaaacgagatacaatctctgaccctagactagatcctgtactggaaggtgaaaaatgctatgaagaacataattaagtcaactgacaaaattagaatatggatggtagattaaatataagtattgtatcaatgtaaacttatgaaatttataaccatactgcagttatgtaagagaatatccctcctcttaggaaacacggactgtttttaagggaaaggaccagaatgtatgtaatgtaccctcacataggtcagagagatgaccaagtaatcacaggaatggggtaaaatgttaacaaaggtgaatctgggtaaagagtatttaagtgtttcttgttttatttttatgtttgtaactttttgtaagcttgaaattgttttcaaagaaaaagattttttaaatgcctttatatatgactatggtattacaattatattgtttataaagactcccagtgttttaaagctacattatgaagcatttatggacaaaataatacaatgtctgggccaggtgtggtggctcactcctgtaatcccagcactttggaaggctgaggcaggtggatcacgagatcaggagttcaagaccagcctggccaagatggtgaaaccccatctccactaaaaatacaaaaattagctgggcacagtggcaggcgcctgtaatcccaactacttgggaggctgaggcaggaggattgcctgaacctgggcggcagaggttgcagtgagccaagattgcgccactgcactccagcctgggtgttagagtgagactccatctcaaaaaaaaaaaaaaaaaaaaaaaaattactcaggcatggtggcatgcactggtaattccagctactcaggaggctgaagcaggagaattgcttgaacctgggaggtggaggttgcagtgagcctagattgcgacattgcgcttccgcctgggcgatggagcgagactctgtctcaaaacaaacaataataataataataataataataataataataacaacaatacaatgtctggggtttgcttcaaagtaatgtgggatcttactatagagagtggggacatagctgaaagccaagcagccatagattgattctcctgaagctgggtgatatgtacatggatttattatactactcagtccatttttgaaattggacattattgtatattttgcttaacatttccataagtttaaattgggaaaaattggcatctcactcaacattttttcctttcaagaatattgtatatctttcccttactcagtttgtttcctctggtatggactgggaactctcatttataccaaattatttgttaggaagattatttatgcagttcaaatgttccttaaaataataaaaaccctcatcaaaacaaagactccttttaagattccatcagtggtcatttatttcaagcaattttaaacaatgtgtccaagttccactatgggaaaatattttgctcagattctgcaataaaagtttctttccatatttaaaaatacttatacaaaaaatacaaaaaaaagaaaaagaacaaaaacaaaaaaataaaaatacacaagtaaaatttcattatgaaaaatttcatgaaatacttttaaaaaaatattttggtttaaattaatgtatccctagagatcacattctctgtgaatcttgaggtaaaaatcctatttatgtgcagctgagcccaatgaggtaaccaggaggtgttttgaactcagagtatttatgcctttcactcctaggccttatttttcccaggatatgattttgtgtcttattgtttggctcattgtttgatgggtttaagtggtttggagtttggctttgggaacgtttaattgttttaattgcttaaattcgataaaacactcagctaaaccattctcagcctgcagtctggcaaataccccatcttcattttagtggctcttacatgaatcaagacaaggaaagcatgttcacaaatttgtttgttgcataaacgttttgtaatatgtcaggaagtttgtctttgcctagcagaagagtccaggtataataataataataatagaagaagaagaaggaaaggaagagagaaagaaagaaaaagaaagaaagaaagaagaaaggaagaaaggaaaggaaggaaggaaggaagggagagagaggaaggaaggaaagaaagaaagaaaagaaaagagggaaagaagaggaggagggaggggggaagagggaagagggggaagggaaagaggaaggagaagggggaggaagggaaagagggaggaggagggaagaaggagaagaaggaaagaaggagaagaagtttctcttaggagaggccatatctctaaacatggaagtagctttattgggagaccccttcatggtgtgactctttgaggtgtgggattttacctgtttgggaaaatgaagactggaaatccctggttttcctatgctagctttattgattggtttgccattcttgtgatttttccttcttgccagagatagactactgtgcctcatctaatcacggatgtcagcacgagtgtgttaacacagatgattcctattcctgccactgcctgaaaggctttaccctgaatccagataagaaaacctgcagaagtaagttacagtgggagttggagaagggcttgttctgctaaatgctcctctagttagttttcctttccgtgcaaatcttaagcaagatgtgcttgtattcagcattgtgtctattaacattattctcccctttattttactttttggctcactagatcctattatgtggatgatttttaaatattgaataggtctggccattagattcaattagccaagtggacccaagctgaagctcccacctatgtgaaatgcaggtgcagtctccctcccccttattcccatagcattggggtcttggaaaaagaaaagaatgggcccagagatgagaggtagaaggagttggtttcttctactcctacaagataagacacttgacggatgctaagagggaggacattgcagctttattccctttgataggaaagaagaagaaaaatgagactctaggacatcccagcaatattcaaggggtacagggtgtcagcgggttgatattgtggatgtactgagtgcctcaaatgcctgtcatctagcacatcaaagggcatgattggggatctgagcacaggccccagagggcacctgcttaagacaaaccattcctgagagactgctagaatggacggcccacaaggacagagacgattatctttttctcgctgctgaattctcaaaagctcaaagagtgcttggcactcatagatgtgcacaatgtttgctgaatgggaatgagtaagtgaatctttctatgatgtatcatcctggagaaattgaagctattttttttttaattcttcaatcttgttagaaagatagccttttttaggcgtgcaagttgtgaattttttttcagaaagtctttccctagttagtccacacttatgcacactgaattgtttggggtctgctgacaatgtcattcgtagaactctctggagcttccattgagggatgtaattttctgtatgttccttcacccatttcttcctgatggtgtgtacagcagtgttctgcctggcaagactgcgttttgaaaggtttcacatatatcttttttgaaaagcaccatgagctatttaactgaatccagatgagtcacattctgctcatagcacagattaactttcatactcattctagcaagtgctaaactgtgtatagtggcagatggttgcaaatcccggattttgaaacggagcctgtcttataaaactattctcactgccttgtgagggtacaaaccctgcacacattcaagcattaaatgaaaattttaatggagagcattcagaatgtgaaaacaattagataagctatttttcataagaccacacatgcctgcaataggtcagagggccaacttttctggtctggccactcctctgtgctatttacaccttttgctaggagtgggtgtgtgagggactggctgcacccaggggaaatcactcccaggtggactcaaatttgcagacccaaagctcttcagtgggcggtgattagatctggttcagctcagatgctcattgcaagcttcctcatgtgttactaatggaggggaaaaaggaaacaagttaggcttggggccatgggcggaggacattttcttgacgttctgcatgtcttaccaaccatctgagtcccttaatttctgctactccctccacacccttcctggagaggcacttggaataagagaagatccaatgcaatgcaggcatcattatcatgggaaggagaagactgagaaaggaagagcgagtagagagggagtgaccgttttggagtggtctgagcgctacagattggtccccaggtgggcctgtttgcaagcaagctgtggccccgaccagagtccctaatgctcatccatgtatattcagtgggtatagcccctctttagccagggttcttactttttcatccaagaaaaatgaaatttgttcctaaaggccagtgtcctcatcagccctcgcccaacgtcccgcctcatcgttacattttccattgtctttgctgtgaacccaaccctgactcctgaggtcagcctgcaggagcggcccctgacttcatgcttgcactcagtccattagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaaaaaagatcaaggcagaatcctactgaagaaaagattcttggccaggatttgttcttgctcctcatctgggcacaatttctcctcatggagagtgctatcatcagtttaaggcatgaattattaaggcagtagtgcaaagcacagaaactgcgactgccttgcctgcccaggtagagccctagggccaaatcagatgtgggttcatcccctgtgctgggctccaggatccctgattctggtaccatgatgagtgctctcaaaaattggtgtgaagcccacgggttcgactgagccaagagacgtgacgtccaggcttggcaatgtcactcatattggttatgtgaccctgagcagctactttctacttctcaggacctggatttcctaaactgtaggaacaggacttcctgccttaacaccctgttgcctctccagtttttttgaaacttactatctgtgcactcagctggtatcaaaatgtactacctggggtcactgatctttcatggtttcagtcttacctgctcagggctccaactctttcacaagttagcactcagaaagatcgtttgatttgttttctgacagtcctgtcatctgacctcacagagctttagtggacactctgggccttaccagattaagttgtgtccatcctgtgggtgccatgtcagagcacctatcatggtaccagatacaggatgcacagtaggtcctcaataaatatttagtgaatgaataagtgagtgagtgaatatctgagaagcacacacatgaggaaatatgacaaaagggtggtgagaaggcaaagagccactgttaaacgtctgctaaaaagaaccatttggagaaggttttttttttttttttttttccagacagaatctcattctattgcccaggctggagtgcagtggagcaatcttggctcactacaacctctgtctcccaggctcaggtgattgtctcacttcggcctccctagtagctgggactacaggcgtgcaccatcatgcctgactagtttttgtatttttagtagagacggggtttcaccatgttgtccaggctggtctcaaactcctggactcaagtgattctccctcctcagtctcccaaagtgctgggattacaggcatgagccaccacgcccagccgaaaagggtggtatttgaatagctgcctgccagattgctgggtgataacctctttaagaatctaaatggttttcagttgaattatctcatgtgtaaatcattctttaaaaaaaaaatcttgctgggcgcggtgtcacgcctgtaatcccagcactttgggaggccgaggcgggcggatcacaaggtcaggagatcgagaccatcctggctaacacggtgaaaccccgtctctactaaaaaatattaaaaaattagccgggcttggtggcgggcgcctgtagtcccaactactcaggaggctgaggcaggagaatggcgtgaacctgggaggcggagcttgcagtgagccgagatcgtgccactgcactccagcctgggcgacagtgagactctgtctcaaaaaaaaaaaaaaaaaatcttgcttgaaacattatttactaatttattttaattttttaaaaatgtttttctttttatatttttattgtatgtgctgctgaagcgagagcttcagcatatttttttatatttttaaaatttttaaaatttttttttatatttttaaaattgttacaacatagttgtacctctttttggtatttattttttaaaattgacataaaaattgtatacttgtatacaatatgttgttttgcaatacgtaaatataaatttttcttaaagacaacattggcttttttagtgtggcaaaatatatataacataaaatgtaccattttaaccatttttaagtatctagtccagtggtattaagcacattcacattgttgtgcaaccatcaccaccttcaatctccagaacttcttcaccccaaactgagactctatacccattaaacaataattccccagctcctcctcctccatctcctggcagccaccaatctactttttgtctatgaatttgactattctaggtgcctcatataagtggaatcatagaatatttgtccttttgtaaccagcttatattgcttggcataatgtcttcaaggttcattcagttgtaggacgtgtcagaatttccttcctttttaaggctgaataatattccattgtatctatacatcatcctttgtactcatcctttgatagatccctgggttgcttccaccttttgacttttatttattaatgcagctatgaacttgggtgtgtatacccagaaatggaattgctggatcatatggttaattctatatttaattttttgaggaaccgccatgctgttttccacagtggctgaatgctgggttttaaaaagagagttgactaaagatcatttcacctttccctgatggtgtaatggagtgattcctataggcagtagactgcgggcccttcctgttctgtgtttgtctgtctgtctgtgactggtgttttattgccaggcctattttcctccatcaaagctcttggcttgtttcctggcactcagttatggcctgcacaggtgaggctgctgatgagtttcaggtagatgaatagaaactgcacacagctaacaatatcctgcctctcctcacatgggagtgagctccagagagagtgccaagggtcagtgacacagcaaggtgatgtcttttcttctacaccagccctgcatgttgtgaccttctctccatgcactctgtctgcagccattctgctcatactctgggcatgaagcaagctccagccaccagtcacctgggagggcacgtcacggattctttttttttttttttttaattttttaatttttttaaagacggaatctcactctgtcacccaggctggaatacagtggcgcgatcttggctcactgcaacctccatctcctgggttctagcgatcctctcacctcagcttcccaagtagctgggactacagatatgtaccaccatgcctggctgatttttgtattgttagtagaggtgggctttcaccatgttggccaggctggtcttgaactcctgacctcaagtgatccatccgcctcagccttccaaagtgctgggatacaggcatgagccactgtgtccagccagatcctttaagagaccctttgaggggtccttcaggtctgggtcccattcacatttccatttttactagcagtggatcttgatcaagttattaacctcgctaaacccgctaaacctcaattcctcagctttgaaatatggataacaggccaggtgcggtggctcacgcctataatcccagcactttgggaggctgaggcgggtggatcacaaggtcaggagatcgagaccagcctggccaatatggtgaaaccccgtctctactaaatatataaaaattagccgggtgtggtagcgggcacctgtagtcccagctactcaggaggctgaggcaggagaattgcttgaacccaggaggcagaagttgcagtgagccgagatcacgccactgcactccagcctggatgacagagcgagactccgtctcaaaaaaaaaaaaaagaaatatggttaacaatcacacatatcttgcagggtcaaatgaagttatgtttgtaaagtggttggcacagcatctggcattcagcaggtatttaagaaatggcagcagctatgatgctatgattatcatcactaatgtaactatcagactgccactaatagtgagaaaaataaagatggcatggtccctgctcgtggaactcagtctagtgaaagaaacagactttgaagcatcacagatacaaaacatactacataaccattgtgatgaatgctacgaaagagaggtcctgtagaaagaactgacttcatctacgaggtcacaaaagatgacaaaatgatgttgagctgatcgtgaaggaagatagaggttagccagtgcagcaaggagccactgagacaagagggtgatgtgtcatatctttaagtgatttgtggatgtgagcttcgtcaaataacttttgggcagatacatggtaaaaataaaatctagtcattactttatgatttcagatcatttcccctgtatcagttatggtgctttttgttcacacaaaaccggaaatccaattaatggtgttttaagtcagaaggacttttattttttacctgacaagtccaaaggtggttggtcctatggatggctcagtgactcagtgatattatcaagaacccagactctttctgtctttctattctggcaaagtatgttgcatttacattttcatccttgtcacctcttggttacaagatggttgctgcagctaccagcatcatatccttacactacaagactcaaaggcagaaaggacagagagcagagaaaagcatttctctttatacacttttgtctttttttttttttttttttgagacagagtctcactctgttgcccaggctggagtgcagtggcacaatctcagctcactgcaacctctgcctcctgggttcaagcgattctcatgcctcaggctcccaagtagctgggattgcagacgcatgccaccatgcccagctaattttgtttttttgtttgtttgtttttagtagaggtggggtttcaccatgttagccaggctggtcttgaactcctggcctcaagtgatctgcccaccttggccttccaaagtgctgggattacaggcatgagccactgtgcctggccacctttgtcttttcaggaagaaaaatctttcttgagggcccccagtaagcttcttatgtttcattggtcagaactagggcatattcccaccccttgaccaatgactgacaaagaagaacatggttgccacgctggcttagaccagccatgactcatgcttgggggtcatggggtaatggttattggcaagacaaccaacagtgtctgccacatccccagaaaaagaacaatgctgtgcagttaaactgatccagcccagccaatgaggtcggtggtgaccttttcccgcgacaccagtctcataaagcctctccacaagctcattttgtgtccttttccagttctctatcttccctggagcctgctatgtgtggggtcttatggctttagcattttctaccaggaaaggaattgcttattggctcctggttatgacacagtttccatctgctggcagaaacacagcatggatagagtgaccttaccataggacagaattgcagtagcctggggcagcatcagagatacgcctcctccagtcccatgatactatgccagcgtggtctcaacagagcaaggcgaagcatttagatccttcttcatgaaactgccaacccctgcatccctaaatagctggatattttgcaagatcaccttttgtttattttgccttgtgccgtccaatgtcactgtcagatgtcactgtagacagaagctctctacatgctttgagcccaagtgatcaggttaacctgagagagatactggattttcttagcttttccatctttcttggaaggaggtaggctggggagcgtggctctcaccccagctctcagctctttggccactgactcagttcagctcagctcaactgagccttggcttgctctttggccatcaaagagggaaaatgctggagaatccacaggtatacttcaggtgccaggccctcttttaaacaagctcctggagagcaggagctattttctctgtgtcctgtagctcaccttgtttcctgaagatttagtgaagtttgcctgcctttccacctctactgcaaagtcttcttcaagacataaccctggccttgtcacctccaccaacattctcacctctagtcacctgtttagagccttcactgatccatcctggggcttgcaaagcccgcacgtccagtcatgctcaggtgggccagctccctctgcctcccagcctcatctctctcctcacactccagccatactcagctcctcacagctccccaggcatgcccctcgccctcatccccaggcatttgtgttcactgtcccctcatccctgggcgtttgtgttcactgtcccctcatccccgggcatttgtgttcactgtcccctcatccccaggcatttgtgttcactgttccctcatccccaagcacttgtgttttttgtctcctcaccctcaggtgtttgcgtttgctgtcctcgagtcctcatgttcttcttcctgttgagctcccttacctatggaactcctcctcctccctggggcctcctgttggccttatctcttcttggaagaccctctcaccccaggactcagtgaggcccctgctctgtgctctgcattgtcttttagttgctgtccttgtctgactcctcaccagagcctgaacccattgaggcagggcctccatctcagtcgtcattaaatctctgaatctagctcaaggcctggcacttggctggcagacaaacgaatgaatgatccgtcccggcttgcctcagcaggcagcacccaccagccctctccatgggggctcatgggagccccgaggggctgccatcagccctgggagaggtccagagtctgaaggaaggtctgcccttcttcccctcagggatcaactactgtgcactgaacaaaccgggctgtgagcatgagtgcgtcaacatggaggagagctactactgccgctgccaccgtggctacactctggaccccaatggcaaaacctgcagccgtgagtgtaccctaggggtggggtgctgatggaaggtggggtccactcatgggggcgggcgggttcactagcaaccagttgtttctggagcccaccgggtttcctgatggtctgtcaggtgtatccttccttatcctcagtttcatcacccatagaatgtgactattaatactatcggcctagccaacttgggttgcaaggattaaaagaattaataggaataggctgggcgcggtggctcacgcctgtaatcccagcacagggaggccaaggcgggcagatcacctgaggtcaggagttcaagaccagcctggccaacatggtgaaatcctatctctactaaaaatacaaaaaattagctgggtgtggtggtgggtgcctataatcccagctactcaggaggctgaagcaggagaattactcgaacctaggaggcagaggtgcagtgagctgagattgcgccattgcactccaacctgggcgacaaagcaaaacttcatctcaaaaaaaaaaaaaaagaataggagtaaaatacttagaacagcactgctaggcataagcactcaataaatgttaactaatattagtatttgctgttaagtgtatttactaggtcagacaggtctaatttcaaatccaacctctcccacctactagatgtgtgtgaacttgggcaagttatttaacttctccatgctttgatttcccatctatgacaaaaagcaaaactaatagtcgtattattcccacagggtttttatagggagaaataggagccattttgatatgttagcctggtgcctggcacagggtaaacttccaatcaaggggaactgttcctatcatggagcctgtgagaggggccagtgcctggcgccagactgggacaagaggccggaggggacagaccttggaaagcaatgggctgcagaggctgatctgagagcagaatcaagaaacatgggattttctgagaaggcttgtcttaattttcttgtgtcagagccacaacaaagctccactgggtgatgtaaatgtatgggaacttgcaagctctgccagctgggcggctccatggttttttatgaggcaccatctccacaggtcctggccagcaggataggagcgcctgagtgtggtgatggaccctatgcccttggcatgcgggagagggggcccatctccatgacatggcctatgcagaaggggccctttatgtgcctttccactcagcaagccccacatctgctccctttggagaaagagatagattgtgagtgaggacagtgcagctgttgagccctgggctccacgctgccagcagggaagtttcccagatgaaataagaggtccagggcagtcctcaggaaagcgtggctcctctagtgtccagagagaacaaagtgcccggtaaaggctttctaaggactgatctcagaggccaaagggcttttgaactggaaagtggtgccaaagtcagtgcctgctgtacgttgcctctgcatgtctctgagtccttttgagaggccagcgggaagcgggtctcccattcaacaggagatgccctggtgaccatggatctgtgtgtatcctgcctgtttcccggagtgtcaggtctgccagctgatggccctggcaattttcccagggcaggtggtcctgacctggctgagcccacgcagatcaccagggacatggcttgactgcccctcccagcatgcttccgggggccagaagagctctaagaacggaccacaagagatcgggaccctcccttctctctgggatctagtcaactctaagaaagtacaaaccaagctgtttctgtctcgcagtccttagagaaagccacaggcttctgctttctcagaggaatcagggagcccaggccataaagacagcaagcaattctgaggcgctcactctgtgcaggcaatgccctgagcacttcccatgcataaactccctgcatcctcacagccgccctactgggcacccacattcttgtcgctatttaaacaagggcaaactgtgacacaaagggattaagtcactgtcctggggtcctgtgattaacaaatggcaacactaggatgtgaacacaggcatgtagctcccaagatccagcaagtgttcgcaggagatgcatccaccagtggaatgttctggaaggcactggtcccagactctgcgggagtcaagaggcccacttggcagacctgcaccaggcctccagtgtctgtccagtctctggaggtgcattttctccataagggaaacctgggaagcagcctgcagggctgttagtgggagctgttcaccacagctgtgtgttcattagccttcggcacttgctgcccggaggaccagctgtgcagcattcggatgccaggataggccacacatgcagtcccaggctttggtttgttttttaatctggatgtcctgataatgggggtaaaaaaaatagaaattgatttcatggagaatgacaactctttttcattttcaattagaaatgaaactatatgactaattcttactcagcactacttgataataatagtgtgttcattaagtggttgctgtatgctagctactgttctgagcgctttacataatcaacccctcttattctcaccctattcctataagaaagcaaccatcaacatccacattcacaaatcaggaaacgatggcaaagaggccgtgggactgcccagcatccatagctaggaagtggcagaggtgtgatttgaacccaggtagtttgatgccagaacctgcattctaagcactactctattagctgtgtggctttgatcttgaccttcctgagcctcactttcctctctgtgaaatgggaattgcacctgctctcagaggtgccctgagactgtggattctgtgcgccatggccctggcagagtgctgctgtcgtcaacaccagggacagcattccccagccattggagttgtatgctttaaccttcaaagaaagaaatgggaaagaaggctgggcatggtgtcaggcacctgtaaccccagctagctactctggaggctggggcaggagaatcgcttgaatccaggaggtggaggttgcagtgagccgagatctcgccactgcactccagcctgggtgaaaagggaaagaaaaccaacaagccaggctgattttctagagggatcagtgatgtggggtagaatgacaccttccctgtggcttgttatgcctccggttttgtttttgaatcttggttgctggtggggtattgccccctcggctcctctatgctttcgcgtgtgtgaaaatgcaggagtggaccactgtgcacagcaggaccatggctgtgagcagctgtgtctgaacacggaggattccttcgtctgccagtgctcagaaggcttcctcatcaacgaggacctcaagacctgctcccgtgagtccctccgcgctcctctcataggggaaggtttgcaccaggagtgaaacctatgtgactgcagagggcacaggttgtacttgggcacccctcccctgccccttgctctgctccaggagatagtgaggatgtccactgggactgcatgccttcgagggagggcggggtgagcatgacggtcacttgatccaatcactgtcgcccagaggtctcactgataaagggctgcctggcttttggttttgcaggggtggattactgcctgctgagtgaccatggttgtgaatactcctgtgtcaacatggacagatcctttgcctgtcagtgtcctgagggacacgtgctccgcagcgatgggaagacgtgtgcaagtaagtgtctgaaggacaagcaggacctgcacaggtgttccgtgggtgccggtgtgggtgcgctgccgacgtgtatatgtgcctgtgtgtcctgtctccaggctttgctgggcctgcatgaatgtgtgtgacagcatctcttagccattgagccttggtggctgcttcaccaactcccctcaatcttccttcccccgtgccctgaagtggctttttgctgtttccacctccctgtcattctgaagctggacagagcccttgtcctcagctctctctgctctacccccagccagctagtatggcacatgaataataataatgtggacccctcactgactgctagctgcatgctgggcactgtgctaagcacacatgctgttgcattcaggggacagatgaggaaaaactgtagctcagattaagtaaagagcctaaggtcaccagctagtgagtggtgggttcaaactctgctggctgtgattccaaagtcagtcctgggagaagaggatgctcctgagaaacgctttgccctgctttctgaccccggtgatctcacagcacatggtgaggctggcagtgatgtgtcctgggtacatatttccttgcagctggtcccaaatcttgtctcaattaaaaaaaaaaaaaattgctcccagacctccttctctcctttactgaagaatgctggtgtgtttgttgccctgaaatcctgtttcgaagtggaccaagataaagaatcgaaatatggtcattttgagagaaggaatcagaaatgaaagaaaaggaccaccatttatcttccccagcctgctggtctttctggttatagggccaagttccctgaccactggtataattgtaggcacaacctaatttatccactttttatatcatctattcatctaggcagatgagctggctgcacagctgggcgtgcctctctatgctgcctgtgagaaaatatttccagtttgggacagatccttggatcttagcaaatgggttatccatgttatagctttcggtggctccctgcccagctgcctcccagactgctgctgcagccagctcagggagggatcgggcacagggggtgcagaaagagggtgggtgtgttgaattgcatcgacattgacagcatgccaaagccagatgtaaggggtttgttggtttgtttaattctccatcattttagattattctgagaataagaggagtcattcttctgtccacctcgttcctgtaataatcaagaactgactacaagatggttgtaggaccctacgaaattctcatgagcccttctaaacaaatgcagctccatctcctttgaatcaggtgccccttcctctcccctgcccaggtccacatctggattttgacctgaccacttttaagtgttgcccattttctcatttaaagtgggtttctaaccaatggcacagtggaaccatctacatgagtaaatgtccaacaatgcaatgaatagtgaattttgttatttatatgtggttgtatctagatgagaacttgtgagatagtcagataagtgagaattgtcctcaggaaccgtataggagagatgcatttcacccaccagctgatacatatgcattgagctattcccctaattgaagactttctgcctgtcccagaatgattcattctgactgtcctgtcctgtaataatgggctaggttttcagcgtggccacagctaactgggggttgggatgtgtgttccccagctctactctcaatgacaaagggccagacgacatgactgcacctatttggtaaagccttttggggggcagtcaggcctggctcagcagataagagtgtccttggctctttatagaggcagcctccacttagagctttgatagcaagtggtcttaagaatgtgtcactcaccttctggaaagttctctgaagtgtggaggggttccaggggccctgggatgagatgggcactgctgtgcccctacctcttcaggcaccttgggttctctggcctctggagcgatgtcccctcccttcctccagccccctgaccgcaagctctgctttcccagattttccccagaggcctttttgcctcgggcagttagatgcacagactcagggtgtggggggtcggggaggggatggggcgatctcttttaccagctgcagctgagcagactccttccctctctagacgtttccctgagattgaccttgtgcaagggcatcccagcaccaagaaagactctataggcctgatgtgcatggaccacactgcccactggcctgcaagctgctggaggttggaggtcagaggccaacatgaaatgactgggagcgtgaatggacagaggccacctgtctttttgccccacggcccctggcacagggtccgctccccgcttgataaccttcagtggctctccactgtctcccagaataaatttccattgcactccttgatttggcagagtgcagaaccccctcttccacttctttagcctcaccccaggccctccctgaagccgcctcctgttctttagccaaagtggcaagtcccccattctctgaacaggcctggtgccttccagcccatcccaatgtcacccccatgggtaacctcctctcccacctgataggctctcctctcctcctcccaccccaggctctgctggggcctctctgcagagctctcctgcccagcctcaccctggggctctctgtgcacatgtctgagaaacagtgtggcagagcagaaagagtactgaactggaagcccaaagactgggtttaaatcgtgtcgcttctaccctaggcaagggaattggccctcttggggtctgactgctcatctctaaactgagaatggtcgttgctgcctttcaaggccactgtgtggttcagggagactgctgttgcagtgctatgtgaacttgtggactgccgtgacccctaaggaattcctcttcctctctcccctcccagcatcagaaccccctgcactgaggagactcagaaggtattgctgcctggaaacccatctgccagggccaggcctgctctccttggaggggccccagagacacacaactctggaagtgggctggactcaggagtccaagggctgtcctatgagggaccctcccttctgcaagcggaggacaccaacggggatcagagccgtcagcctagggcactgggggatctctgctggtgatactcccagtccaactaccacaggcagatctgcgagggcctgttaggctgcctgaggccctgagcttggccttccagggctgaggcaggcctaggcgaggctaggggagtgtcttagtctactcgggctcccatcacaaaataccatagactgaatgttgtttcttaaccacagaaatttctttctcacagttctggaggctggaagtccaggatccaggtgctggcatggctgggttctggtgagggccctcttcttggtttgcagacagccagcacccagctgtgtcctcatattgcatgggttgtagggggtgagagagcaaaagagtgcaggcaagttctctggtgtctcttcttataagaacactaatcctatcaggtcaggatcctgccctcacaaccccatctaaacctaattacctcccaaagactccacctctgaataccctcacatcagggttagggattcagatgtaaattttgggggaaacagtctgtagcagggagtagggggaggggaccaccctcactctcatgtattcacattacaggcttgatgcaacagaaggaaactagagattttcccttattttgtgggaaacggacacatggaggaaagtgatgcctccaagctggccctggtcggggagtcagtggcagagccaggaccagagccgagtcccctgattttaggatcttttgcccagtgtgagatgccctggaaaagcacatctcagttcagctgcttcttggtttgtctgagaaaaagcctatattaagttagcaaaggattggctgctgctagttttattacgagaaaagccaggaagcagtgtaattctatctgtcggcttctggttactgtcttggcagatggccactgtggctttctctctctggggttggggttggttttaacaacgtcttatgtggagccccagacgcaggattgctgtctgtcatcacggcagaggtgcaagtccacagaacacgttgccccactgttgctgcgccacagacttacgtgactcacctgtgtcagcgtgcagggctgctagacagggaccctaaagacccgtgctacatcctaaaacttctaatcatcctgagcacacgctgcagaatccattcacgatgagggtttaattaaacacataggcctgggtccttatgtgtaaaaggaggagaatccttctttgagaggaaaaatgttttctttctccctcttgagatttcttacatcctcccacctatttcacttaagtgatggctcctaatggagtctgtctttactctcctctctgggtttgaatctaggtacttccttaagcgcttggttcctttaccctcgttctctacaaatatttactgtgtacctgcattgtgcggggtgctggggatctctggggttgatgcagattcggtttgtgccctgacagtgtttaaagcttctcggggaagaaggatagcagagacagcgtccattccttatggtgagagtggtgatgtgagaaggatggagccgtgggagcaccccctagtctagagaaagagaagtttaatccaacacccagaggagggggctgtgggagcctcccctagtctagagaaagatgtttaatccgacacccagagagtgagtacagtgagccagccagagatggaggggaaatgcttcactaggggccagagagcgaactgcaggaagttctgtgctctgagtacggggtactgaatgcaagagggaggcggtgggtgagaaacgagcctggggacgccggcgggacacatcacccacctacagccttcagagacttcctggctggcctctcttgagaaaatgatttttgtctagtttgtcttctgagaatctgccaggctgcctcagcacactcccttaagctaggatgatctgtggatgtgcagctggaccagggacacggaggtctatttgaatatagtcccatctctgcccccaggacagctaagaccagtcacctctgaaggttcagggacattgggaaagtcacttcccctctgaccatcagttttctcatctttaatgaaggggttggactagttcatatccaatgagttgaacttccagcacccaaacaaggatattgcctggctcagataagtgctccgtaaacacttgctgaatgaatggacttactgtggtgcccaccatagtctcccaggctgaagacacccagtggtactgagtcaggggtggtggctctgtttgcctgttaggggaccactgaagcattttcctataggggagtatctttgccctgggtagaaactgactccaagttggtttccagacttggtggatagaaagctagcgcctatggtcaggaggttaactatcatccacctttggcattctctaatttcccatccacggttctttgaatttataagtggcccagaacatccctgaagggcagaaactggacattttgctgaacaaatgtgagtcgtgcattttgcaaggtgggtgtgtgggagagagtgggaagcctagctggccacaaacatccacacatcccatggggttcttatttaaaacatctgcacaaaacccctgtgaggtggatctaattaccctcaattttcagaatagcaaactgaggaaatgtttccttttgttcaacaggtctttcctagggatctgttaggtgccaggcattatggccactgccaacatctcacctctgatgattcgttgaaatcatctatggggctaggaaaaagtctaaaggcccaggcagcatcccagaaaccctgaatcagaaacagaaacagagactgtcttacattgttggtgagagtagagattgaaataatctctttggaggatgacttggaaatatttatctgcctttaagtattcataccctttacctaggcaattctgcttctggatgtgtaactttcaggtatgccttcacattgtacataaaactacatgcacaagaatatccattgcagataaggtgtggtggctcatgcctgtaatcccagcactttgggaggctgaagcgggaggatcacttgaggccagaaatttaagaccagcctgggcaacatagtgggaccccatctcaacaaaaaatatgaaaattagctaagcatggtggcatgcacctgtagtcccagctactcaggaggctaaggtgggaggatcacatgagcccaagagccaaggctgcagtgaactgcgatgacaccactgcactccagcctgggcgacagagcaagcctgtgtctcaaaaaaaagaaaaaaaagagccttagctgaagctaggaggacaggactgggcacaagggaagctccaggaaggaagggcttaggggtctgtctggattatggcttgacaaggttgacgtgaaagagctatagctattttattaccatggaaaatggagtagtagtagtattataaattcacggtagggggaaaaaaaaacacctcacctccatggccatccagttgtctatatcatggatcactcaactctactttccactcttacaccatgtgaggaactatcccaaaccatcaggaaatgttctgcattaatagtgagtctagaatttgctgagaaaagcaagtcatgctcagggcaaacaggagggtccaactcggctttgagcctcctctgcagctgtaattgcagttatcaaacttttcccattcttcaaagattttggcagtgcttctccccaaagaaattcccttcacatttgaaagcttgctgtagaatatagcaatgtagtatagtcagaaaatacggggatttatttataagattacaatttttgtctggttctttctcttgttaacaattggtcttgacaagccatcagccttcccaacccttagtttccctagctggtgagtgagaataacaacagctgccttaactaacccaaaggtggttctgaggagtcctctccagagagatactgcaaagatgctttaccaaaaaaagtgtgtggtttgtgcctgattataaaggtcattatgtgctttggggcctttatttaataattccgattcatgtccattttagaaattctactcaatctgaaaggattgagttaactttcagaaatatgtagggttcttataaaaagtcaccactcacctatcctcagtattaagcttttaaagtaacagcctggttttcacaggttcacaaaccttctagtcccccagaagccacccagccctgtaagatggcaatgccatccttcagttgctcagtccagcaacctgggagtcttccttgactcttctgtcctatccatatgggctctttgtattaatccatgaacaaattttatagattctaccttaaaatacagccagtctgaccacttctcaccagcctggtctgggccaccaagatctttgcacagggctgctcccaggtgtccaagctccattctgtgcagagcgatcctttaaaaacaaacccatatcatgccactccactgctcaaaacactgcagtgactgcccttctctttcagatctgacccccactgtgaaccccacatggtctgccccagccaaccttgctggcctcatcccctgccaggctcccggatgctccagtcacagtggtctccttgcctttcctgaaacacaccaaccaagcagctcccgttgctgcagtttgcaaatgctgttctttcttgctgataatgctctttcccagacaccaccactcacttcctgtctttctgcagggctctgctcagtgtcaccatatctgacacaccatataatataacaagccctccctactctccagcccagtagccactctccatccttctatcctgctcttcctccatagcactttttcccacatgacatatcacatatttgtctgttttccacgcatccctcttctcctgacacctgctgccaaatgtaagcttcacaaaagcagaaactttgtttcgttcattgctatatccccagagtctaaaacagtgcctggctcattgcagggactcacaaaatatttgtgaactgactgaatacatgaatgaattggttacctaagtgtaatatatacatacatacataagtagatatgtaaataagttgatattatagttacataatagccagttaggttaatcttattttctaatatttacaagtaatttatctctcattctgtaacttgtattctcatgttttttgttcatttttcttgtggagatgatttatattgtttgatttttatgtgccatgtgtatattaagaatttttgctcactttgggagtccgaggtgggtggattgcttgagcccaggaattcgagaccagcctgggcaacatggtgaaatcccgtctccacaaaaaattagcctggtgtggtggtgcacgcttgtagtcccagctatctgggaggctgagatgggaggatcacttgagcccgggaggcagaggctgcagtgagttgagatcacgccaccacactccagcctggatgacagagtgagaccctttctcaaaaaagaatttttgctcatagacatgctttatattctgaaatgtgtactgtaggataaggcactgttttaattcaaagtgtctgaaatgtcttttatgattgaataagccactaatatatgagtcattttcttcttctgtttctctaattcccatttgattctcagaattggactcttgtgctctgggggaccacggttgtgaacattcgtgtgtaagcagtgaagattcgtttgtgtgccagtgctttgaaggttatatactccgtgaagatggaaaaacctgcagaagtaagtttgtactggagctggctcctactactatgccagaccactgtgtgaaatcgctatccttatctctgtatatatcagttcctctcagaagtcaatgccacacagcaaaatgtaatgtagtgtcctggataggaccctgaaagagaaaatggacattagggaaaaaataagtaaatgtcaataaaatatagactttagttaataatcatgtatcagtatgggtttatcaataataacaaatggaccatactcatgtgagttgttaataatagggaaaactaggtgtggggtatattgcaattctttgcgctatcttctcaatttttgcgtaaatctaaaactgtcctaaataataaagtctattaaaaaaatggacaaacaaaaaaagtcaatgccagagctactactgaagttcttcacttatatgctctgtggcaagaaacagtggtttggcagtatactctagtggaaagatggacagtcagaaatccaagattcagtcaacctctgtctctgccatttattagctgggaaagttgcctaacttctctaagcctctctgcttatttatctttaataatgttgttgttgttatttctggtagcacaaatccctcccaaagggcaccttgtgatgaagccagttttgcctttcagaaggcaaagcctcttagatggggctgcagccagccagcccaggacaagcagccttagagtgaattgctggtgtaaatctcaagacacatctctgaataatcaaaggggagtgtgtgaccctggtttccatccatatcagttatctttttctcaacgtctcaaagcactttataaagagcaactcatgttgacacttttggaagaaaagatgggtaactggaataattactctctcattttttggacagcacagctaagactccaagaagttaagtgattctcctaagtcatacactatgttaggcacaaagccaaagttagatttcagtgctgctaatctaaattgaggtttaatctcctaaggaatcatatcaagtgtttccattctgatatcagaaactatgtctacagaaagttgatgatggactgcattttaacactaaagtagtgctggtgaacgatgatggtgaagacagtgaaacagtttgaagggttagcccgaattagagccgctaaactttgttctcaattgtaacttcctgccccatggaccactgagctcaggtggcagatagaatccagtagctgactccagtggatgggtcctccaaggtgaagtccatgtgaaatgtatgttgttgaaattgttgtaacttgctctcctgtcttcagggaaagatgtctgccaagctatagaccatggctgtgaacacatttgtgtgaacagtgacgactcatacacgtgcgagtgcttggagggattccggctcgctgaggatgggaaacgctgccgaagtaagtagcctcgaggtggagaagaacttttccctctgtggactcagacagttagagaagttcatttaatccttaaagtcctcctttattaccactgtcacaagtgtcagttcctgccttgggtgctctgaaagtgtttagctagagatcagttcagtagccccttgctttttcgggaatttctcagtcaaggcctgagttttgggttctttgcttctcttcattttctgccagccatcagccctttccacagtagctgtgtgggtgcccggaaactcgcacagtgctagtcactggactgaattagaacctctgccagcaatcactacaaggactgaaggttaattacagagctttctcctcttggcagaccgtaaaagtaagggcaaagggtgaaagggtgtattcgtccattttcacactgccgataaagacatacccgagactgggcaatttacaaaagaaagaggtttgatggactcacagttccacttggctggagaggcctcaaaatcatggcagaaggtgacgggcacatctcacatggtggcagacaagagaagagaacttgtgcagggaaaccccctttataaaaccatcagatcttgtggagacttattcacaatcagaatagcacaggaaagccccgtccccatgattcaattacctcccaccaggtgcctcccacaacacgtgggaattgtgggaactacaattcaagatgacatttgggtgggacacagccaaaccatatcagagggatttcctgtgggttttttctattatttttatcatttgcttctataggtcacccagaacaggctctgagagtttcgttagaaggtgtattccccagagttctccagagaaacagaccttctctatgtatatcttcatcttctattatatataaatataatagaagacatatatataatatatatatgtcttctatggtctgttctatcttctatttatatatatcatagaagatatatatatatatacacacacatatatatgtgtgtgatgtatatatgtatactatggtctgtttctatcttctattaatatatcatctccacaggaaaaatggacatacacacacacacacacaaacacacatatattgtgagggaggaaaagattggttgattttaagggattggctcacacaattgtcaggggctggcaagttctaaatctgtagggcagcctggagacccaggcaagagctgatgctgcagcccaagtctgaaggcagtctggatgcagaattcccttttcctctgaggacctcagtctttttctctttaggccttcaagtgattggatgaggcccatctacattatagagggtgatctgatctgcttcactcaaagtctactgattaaatgttaattgcatctaaaaattagctcacagcatcatttagactggtgtttgaccaaacaactgggcactatagcctagccaaagtgacacatcaaattaaccttcacagtacccaaaggaacagagggatgtcatacgagctcagtgaggtgggcattaggagagtacagagcagggatttttccccaccatgagattctgagctggtaattccctattttggggggaggggtggttgacaaagtctacttgcttttgtgacactttgccccagtgggcaaaataaccctttttcaattaagtcaaaataagttcagttgctttgaggttgatttttgggaatttcctcacagactcctttgagataactggggatattccacaagccaacaaggctgggttggagggatctcaatacctcgcttcttcctccaggaagagggactcctacctttagcaagaagttctgtgtgaatgactgacacctaggatgcctgtggtaccctggcctaactctgcagggattcccctcacaactgcaggtccagcttcacactgcagtggccctcttgtggagattttgtctataattctgcccattgtgcctgtctgcactgcttgttcatgcttttctttttgtttgtttttgttttgagacagggtctcactctgtcacccaggctggagtgcagtggcactatcttagctcactgtaatctccacctcctgggctcaagcgatcttcccacctcagcctcctgagtagctgggactacaagcgtgcaccaccacacccggttaatttttgtattttttgtagagacatggtttcaccatgttgcccaggctggtcttgaacacctgagctcaagaaatctgcctgcctcggcctcccaaagtgttgggattacaggtgtgaaccaccatgcccagccctcatgcttttctttctgcaaacatctgcacactcacacacacactgtttattcattcaacacatttattgctcagtaaattgaacacaaggtacaacttctacctctggaatttgatcctaaatcagatttcaccattcctgcttcctagagggatgtgttctcactgattccaattttgtgtgaagcctctccttttaaggggtaatgacaggaaagagccataggctctcatgctatggaggagcactcgggagacagctgtgtcatcaacctgccagatgaccgtgggcagcagtgaagctctctgagtatctaattcttcattgataccttgagaataattatccctgtcttccttgtctcacagggtgttgtgagggttaaagggctgtaagtacttcgaagagtttaaattacctcacacatgagaaatgttcattagacaatctgaactggagtgtttgggatgtctgtggcaaaagaaattagaagctaaagcacatctaataataggatagtaagtcaaggacacctaatcacccatcgtaccattcagactcatgggagctagagctttctgagaggagctttttccccatcctgagtatgagactgcaaaagacattatgaaggaggtttgaagagaggtgtgttttctttaaaagagattacttccacaatctctactcacatgactattcaattcacctcatttctacactgatgggattgttcaactccctacattttcctcagggaaggatgtctgcaaatcaacccaccatggctgcgaacacatttgtgttaataatgggaattcctacatctgcaaatgctcagagggatttgttctagctgaggacggaagacggtgcaagagtaagtgatctgaacttggctctctgctttaattttgttttggagcaactgctttttggagtattttcaggcaacaaatccctcacctctgcttctcccataaatataaatgcatatgcacaaatacagaatggggaagagagggcttaactgcagcacctgtgaaaacactttcggttttaattgacagtaaattcattatcagccaagaggctagggtgatcgtaggctgaacagcaatgtctgcatgagggaggtggagagagctgtgctctgctctgtgctggagaattacattcagttctgggcatggtactttaggaaaaaagagatggatcaacagtttaaacataaaaaaaaaaaaaacacaaaagagcaaaaggagtcttgagagaattattttttaatctgagagtagagaagatctttctaaacatgacatgaaatttaaaagccataaaagaaaaacaaaggaaaatatctagtaagagagtaaagctgtgatacctttttttaacctattagttaacctattagttaccagagatcaaaaagtttgattccttatgttggcaaaggtatattgtagtagggaattataaatggatcagtgagtgtctgaattggtataacctttcagagggcaatttggcaatgttatcaatccagttctagaagtttatcttacagatacgtgcatgtttacaaagccatgtatacaaggatattttatacagcactatttgtagcagcaaaaaactggaaacaagctaaatgatcacccatgagcctggctgaataaattaaggcacatctatgtaataaaacatgatgcagctgttaaaacaacaagcagctctggatgtatccccaagatattttaagagaaaaaagcatggtgctgaatgttttttatagtatgttaccatcgatatattttgtaaaacactctaacatacagtctctctttctctatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacatacacacaccctttttctaatatttaagttttgttccaaatgcatgtattattttttagaaaaaaataagataaacacgatttagaaagaattaagcagcatgatcttgtgaggaagttcagtattatgttaagcagaaaaaaattaggaaactggggatctttgtagaaaaaaattttgaggtaccaaataccaatgtgactgtcatctcactcatgatttgtatgatacccccaccccaccccaccctaccctggaaagaaaggacacttggagaagctacagcttagcacgaggacaaagaagctttctaccagggaagctgcatgcctaattagttcagagcataagcttcagctcagacagatctggatttgaaccctgattcatactacccgtgtgaccttggtcaaattatttaatctcggccgggcgctatggctaacgcctgtaatcccagcactttgggaggccaagacgggcagatcacctgagatcaggagttcgagaccagcctggccaacatgacaaaactctgtctctactaaaaatataaaaattagccaggcgtggtggcacgcatctataatcccagctactcaagaggctgaggcaggagaattgcttgaacctgggaggcggaggttgcagtgagctgagattgctccactgctctctagcctgggcaacagaggaagactccgtctcaaaataaataaataaataaaataaataaaatacaaaaattagccgggtgtggtggcatgcacctataatcccagctacttgagaggctgaggccaggagatggaagttgcagtgggccgagatcgtgccactgcactccagccagggtgacagagcaaggctctgtctcaaaaaaacaaataaacaaacaaaaattatataaactctttgagtcccagtttccccatctataaaataaggataataactcacaaagccatcacaaggaatacattagatcgtgtatccaaaggtgctgaacagccgggtgttgtggctcacacctgtaatcccagcaccttgggaagctgtggtgggaggattgcttgagctcaggagttcaagaccagcctgggcaacatggtgaaaccctgtctctacaaaaattagaaaaattagctggttgtggtggtacgtggctgtggtcccagctactagggaggctgaggtgggaggatcacctgagtgcaggaggttgaggctacagtgagttgtgattgtgccacttcactctagcctgggtgacacagcaagaccttgtctcaaaaaaaatttttttaataaaaaataaataaaggtgttgagcccagtgctcacacacactaagtgctcaaaaaatgatcactattacgattcacaatagtaaagacatggaatcaacccaaaatgcccatcaatgatagactggataaagaaaatgtgatacatatacaccatggaatactatgcggccataaaaagaaatgaggtcatgtcctttgcagggacatggatggaactggaagccattatcctcagcaaactaacacagaaacagaaaaccaaacactgcatgttctcagttataagtgggagctgaacaatgagaacacatggacacagggaggggaacaacacacaccggggcctgttgggggtagtcgggagtgagaacatcaagataaaaagctaatgcatgtggggcttaatacctaagtgatgggctgataggtgcggcaaaccaccatggcacacatttgcctatgtaacaaacctgcacgtcctgcagatgtatcctagagcttaaaataaaattaaatttaaaaaacaacagacaggccaggtgtggtggctcatgcctttaatcccggcaccttgagaggccgaagcgggcggatcacctgaggtcaggagttcaagaccagcctggccaacatggagaaaccctgtctctactaaaaatacaaaaagtgtccaggtatggtagcgtgtgcctgtggctctagctacttgggaggctgagacaggagaatcacttgaacccaggaggtggaggcagcagtgagccaagatcgcaccactgcactccagcctgggcgagagagcgagatgccatctcaaacaacaacaacaacaacaacaaacaaacaaaatgatcactattgtaatcatcaacagcagaggtgtccaaagatggggctttcgtggtaaggtgacaaattcctcatcaggagaggcattgaggcccaggccgaatggtcactgggtgaggatgctgtaaagaggatgtaagcaacagcagggctggagtagatgatctttaaagggcttatccatgcctgaagttctagaactttctgaaaattacgttctgaaagcaagtcacagctccattccagtcttatcaacttaactaccaaaaagaaaatgcccaagaaaagtgggaattaacctctggcaaaaaaatagtctaataagtggggctgtccttcctgtgtctgaaagcaaatacctgggccctgctctccctgatgcttttccactctactttgttttgtgtttcctggagaagccttctggatgccattctatgtgtgggggttgcaagtgctagttttgttctgtaagaaaaatgtgtacagaaaggaggagaaaacagactcactgctggaaaattatttcagtatttttgaaatctgctgaagagccacatgcatgctgcctgagtctttttttggttcactcaggaacagactatgaatgtaaatgaagctttgagttggccttttcctctttcactaataaaagatcgataggttgagtgatgaggaaaagcacttaatggagaaacagaagaacccaatcccccaacatgtgcgcactcacgcacacacacacacacacaccacacacactatgacgttaagcattttatactggccaggcatagaaatggttttgcatgtgtgtgtctctacatgcttatattgttgtgcctcacttttaaagattagacagctgcttgatatataaaacagaatgtttatcacagattgtggattgtttgaaatgagatcatctggcccagcacggtggctcacgcctgtaatcccaacattttggaggccgaggtgggtggatcacaaggtcaggagttcgaaatcagcttggccaagatggtgaaaccccgtctctactaaaaatacaaaaattagccaggcatggtggcatgtgcctgtaatcccagctacttgggaggctgaggcaggagaatcgcttgaacctgggaggcagaagttgcagtaagccaagatcgcgccattgtactccagcctgggcgacacagcaagactctgtctcaaaaaagaagaagaaatgagataatccattttggatctgtccatttttcttttgcagtcctaaataacaaaaagcctctccacacccaaattgcttaacataaagcttttatttctgcttactatcgaccatctattaatagttgcctgagaccaggtacagtggctcatgcctgtaatcccagcactttggaaggccaaggcaggtgaatcgcctgaggtcaggagttcaagaccagcctagccaacatggcaaaaccccgtctctactaaaaatacaaaaaactagccaggcatggtagcgtgtgcctgtaatcccggctacttgggaggctgaggcaggagaatcacttgaacccaggaagtggaggttgcagtgagccaagatcacaccattgcacttcagcctgggtaacagagcaagactcaatctcaaaaaaaaaaaaaaaaaatgcctgaaaagcttccatgtaaagaatttatggtgataactttttttttaattttgttttttttttttttacggagagatgcagggtcttgctctgtcacccagactgaagtgcagcggcacaatcatagcttactgcaacctgtaattcttgggctccggtaatctttctgcctcagcctcccaagtagctagggctacaggcatgcactaccatgcccagctaatttttctttttttaagaaagacagtcactctgttacccagggtgttcttgaactcctgtgctcaagccatcctcctgcctcagcctcccaatgcactggggattataggcgtgagccactgcactaaggctaattattttgtaagctttaataggtcagtagggtacttacaggtgtgctacccaatgaacatcacctcattcacttagtctgtcaccacacatttactgaacactttttttgtgccaagtattggggggtggggcacaaaaatgaatgaaacacagtccctgctgaggaggaactcacagactggaggaggaaacacatcattaaataattattgtacaatgtggaacactatatagagtacattagattgtatgcagcttggtgttagggattgtgtcttggtcactattgcaatcctgctatgcccatggccttgtacaaagcaggtcctcaataaatttttggttgaataaattagtagtgtttggggtatatagaaagcaatacaagctgagttactaggaaggctccccagcagaggtgatggctgagctgaagaaatctctttctccattgactgtcagaatgccagcactagggtgatgtcaccctcctaaagttctaggagtcttttgggtattgttagacccttcagtgtactctacacccagctcctcccagacctgtcagtgttccagggtacaatgtagacttggtttcctagacaattgtatatctgccgttttgcttgtgaaaaatactatttttatcaatatgacaagccaaccataaaagtatacgtgaaaattattgttgcttgtggccctcccaacaactcatctatcctgtgtattatctaaagaacaaaactggttccccaaagtggttatgcctccaattgaagcatcattttattctactcttgtgcataaatgattttttattcaactatgtcaactttccttctgttcatatagaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtaatatggggtggaggtgcggtttacaccactcaaggttcaggtttcttaaactcactcagtggtctcagctggccataagggtaagcttctttgagtgtacagaaaggcctcctggcaactgccattatacatctttactaccctgccacctagaagccttaacaggaccccacaggagttaaataaagtgctcaggaaggagtctggctactagaagggtaggctaagctgaccacaggcgggtatcctctcactgtgatttactagccagtgtgtgatctccagtgtaagaatcgcctagatatacacaatagttccgaaacactggtcggcttgctctagaatcaactgaagactttgttaaattgtttctgatgggaacttttactgtgtatatttattcttgtattttttaaccaatacttcaagcgagcattctgaaaatgcaatagcccctagggtggataatactcttgtgtttccaggaggcaaagttagcttttccgaaaatcaaatgatggaacagattatgactctaagctcttgttgctcagtaaagcccagcctcttctctgaggttttcctgacctgagggttacttcagttgtacagatgtgaagcgtgctcgaggagtatgacccttggctaaaggaaacccaaaaggtaggataattggtagagacagtttatggtgaagtttctagattccttgagggagataagaaaacttgaggttgtgaactagtttgcttgaaaactgctttttttttttgagatggaggcttgctctgtcaccgaggctggagtgcagtggcgcgatgtcagctcactgcaagctccgcctcccaggttcacgctattctcctgcctcggcctcctgagtattgggtactacaggcgcccgccaccacgcccagctaatttttttgtatttttagtggagatggggtttcaccgtgttagccaggatggtctcgatctcctgacctcatgatccacccacctcagcctcccaaagtgctaggattataggcgtgagccactgtgcccagccgaaaactgccttcttaaagtacttgttgaggacacactgctttagcaagtcctgtaagaggaaataaggtatgcacagatcaaggcctcatctaagactttatggacccagtgcctagatcaggcctggcacacagtagatgtgtgacaactacttgctgagtgaatgaagaaagaagtgagagtactggcagtcccattggtgaactccattcctcctcacagaaaggctggttcacatcgacattcactcgctgtctttgtgaaggaggtcattttattgatactgcgtaccttcctctttttctagcccaagagtggtagccacaaagtgtcctgccctgaatcatctggatagattgtaaaactggctgttcacactagcctagattgctagagctcatgtcaaactcataggccccctagtctgcattcttaaaaagaattaattaggggaagcatcttagtctccagagacagtggttagccctttcatctcactgagactaatctaccttaccctttgctccactcaaatgtctctacacatcacacaaagacaggtggtagcagaaactgatgtttacttgattcttgaatcaacaagatttatatgaggtgacatcctcttatgaatttaactagtcttatgtatagcaaacagaatcttaaaatagtagttatcctttttaggaagtcgtgcataaaatcactgggctcccggacaaatatgctgaacttggttagtgaccttacacagactcagaacaaggcatcacaactcttgccccttgtcttgaagagccatttttaagtacatttttaagaatctagtctaataaattagctagaataagttatcagtgctgaaaaatgtttggactccagcagaacatattcttattgtgttttactttcaaatgaagagtatataggggaagggagtctaaggattgagtaagaaaagcttttaaagcaaacgcatatccctgttgaaatttaaggctgatcttgggtttgttctttttcctgactttaggggtttccaatggtctgtagattatccttttcagcttagcacttcctcacaaagttgtgtcatcttagcagaagtgggcaaaaagcagcttcacttggcctcaggtcacttacgtttcctaccctgtagctttgagtagaaactaggttattaggtcataaattgacttgattcttagaattcttccagaagagattcccatttagcaagccataaaatagggctcatttctatgaatccagaaggctaattcagggggaagttgcagatttgttaaatggcccagcccagggctgagcaacaggttagtagtttagttccccagcgtctcccagatgcctcacttctctcttggatccctcccttttgttcataggaccaaaataaaaatggtagaaaaataaaaaggaaggttggcatggactcttcaaatcataccacttaacatctaactggctttgggtgcagtacacacaacttccagcccctgggaacacaactctaactaacttgctcttaatttttcctgcaccctaggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaaggtactatagcttacgccgaagaccttagcaaacaaggcagcatgaactcctttttttttgttttttgagatggagtctcactctgtcatccaggctggagtgcagtggcacaatctcagctcactacaacctccgcctcctgggttcaagtgattctcatgcttcagcctcccgagaagctgggattacaggcacccaccaccacacccagctaatttttgtatttttagtagagatgaggtttcaccatgttggccaggctggtctcgaactcctgacctcaagtgatccagccaccacagcctcccaaagtgctgggattacaggcgtgagccaccgtgtccggccagcatgaacctttagtgataaattctcaaccaaaaaaaagtgtctccttcatgggcagggccagcaatgcctagaaacagtacaaaaagaagggctgggcaccatggttcccacctgtaacccaaccattttgggaggctgcggtgggaggattgctcgagcccaggagttcgagaccagtttaggcaacaaagtgaaaccctgtctctgaaaaaaaatttaacaattagctaggcatgatggcacacacctgtagtctcagctacttgggagactgagcggggaggatcgtttgagccctggaggtcacggcttcagtgagccatgattgcgccactgcactccaacctgggtgacaaagcaagaccctgtctcaaaaaaagaaaaaaaaaaggtgggggaaacaggggaggtgggaaagaaaaaagtaatagctaccattgtttgcgcccttgctctgtgccaagcagtataataagtgttttgacacaccagcatgcttcatcctcacaaacaccctagagaaatgatcatttaactaaaaatcaatcattatataaatcaggagagctgaagtgcaatttcagaatatacctataattggagtggaaaggggcgtacctagttcttccaagcccactgttaaaattaatgcctttctgcatggactacttgtttacagaatatcagactgccctttagacttcagattttgttatgcatgcttttctccagtttactaactgtgccagatatgcttacagatagcagttctgcctatttttccttgtactcatgtccccggctcaccagttagatcccagtctaagtgctgtgtcttacccctctagggaaagaactcttgagatgaggggtaacagggagggaaggcctttcagatttctgagtagagaatgttttgcctcttgattgtttcatgcaagttaaaatgcctcaagtggagctgctgccactgcaactaaaatccctcaacaacttcaccttttttttctgccctactttctagacatgacatttttgggagcattcttaagatgtacttagggggtccaagcttctcttacgagagagaattgccctagagtggtcataagtatcatggtaaccaactgcttttttgaatctttggtgttaccaaacaaaactaaaaaaccttaggttatggcaggtaggtaaggaggtggtctgggaccagcttcctgaagaacacacacatgcctgtggacaaccatcacttcttttggtcatctttttctgctcagctctagaagactccgatggaagacaggactctccagcaggggaactgccaaaaacggtccaacagccaacaggtacagtttttaaggcagtgtttttagaaattttggtggagggaaccatggtttccctccagataaaagctgtaaagaagtgaatgtaagtatgttcaaattatgataatgaaggccttttttccctcaaaaagatagttaacatttactcttacattaagccatatttggtaactagcatcgtttcaggtgacagtgtttttttgtttttgtttttgttgttgttgtttttttgagacagtttcattctgttgcccaggctggagtgcagtggtacgatttcagctcactgcaacctccacctcctgggctcaagtgattctcctgccccagcctcccgagtagctggaattacaggcacccaccaccatgcccagctaatttttgtatttttagtagagacggggttttaccatgttggccaggctggtcttgaactcctgacctcaagcgatccacccaccttggcctcccaaagtgctgggattacagacatgagccactgtgcccggctgtttttgtttttttttttgttgttgttgttttttgtttttttaataaagatgtttactccactgaagataacagtctttttgcttcagtatgtcccaaagtaaagctctgtaccaagtgctaggaataccaagtaccttactctgctgatggctgttttataaccaaaagcgttaagcaggtttgattgcagttttctttctctttacagaatctgagccagtcaccataaatatccaagacctactttcctgttctaattttgcagtgcaacacagatatctgtttgaagaagacaatcttttacggtctacacaaaagctttcccattcaacaaaaccttcaggtaattccaagtaaaatattactataagataacttgatctcagcctttcggcttgccaacaaccttagctttaaggaggaaaggaaagaaggaagtaggaaatagtatagaggaaaagagaagaaagaatttaagtaaaatgagaactaaaacataaactaaaagaaactcaagtagtgttcctcagtaatccacagtaagggccacttccagtgttggaagcatatacagtgctttcctggtatttactggatctggctgcatggaaaaagtggaacatgtctttcattatggtttcctccatatgctgattcattcctattattatgcgtctgggaagtctggtggattctagaggtgaacactttccatctgctttctcaggaagccctttggaagaaaaacacgatcaatgcaaatgtgaaaaccttataatgttccagaaccttgcaaacgaagaagtaagaaaattaacacagcgctatatccttttcttgcattatgcttctgtatggaatgcaaagaatattatcaaaacttcacacactctatgtaggttttatcaactgaagtaaatcccacgaagtcacaaagaacagtgatctccaggaaaggctttttgctttaaaaagcagcctcacaggtgtttgagaggcaagggcaagccaagcttattagcagcagtcaagcacttagttgccatcggctgttctcgggggcttagcaataaggcctgtcagtcagcatacaaagtaaggaaaaaagagacactggcctaactccgtctctgctaggaaggtgtgtaggacatgatgaggtctgaagtgcatcaaaggtacggtaagtatagacaaagaatgttgtagaatgaagaggtttcaaactcagtactccaaacttttcctttagccccaaggaacaccacagccacatatagattcagtgtgtttagtttctggaggacaggagtggttttttcttttttttcccttggcagcagagatcttctctatcggcactctaaaaaatgaaacactccaccaagggaacagcaggatccaatgattcatttaaacaatattaaataaaaggaatgcttggggataataaagaaaagaggattcggtgcttttacatattgaacaccctgccaagtgctctaaacttaaaattacagtaagcgtactaaagctggctgatatctcaagtgcatcaactagtctatagggaaatggcttaattctgaactatctctgtgccaatgggcttatgtaataaggaacaacagcatagggcaattccatttctgaaagctggaaatacgctcccttaagtaaaatgaaataatctttctgagtggttaattgacgaatatgggctctcattctgccctcaagagggcagatagagggtactgaggagcttacagggaagaccaatacctattctaatgcccttttcttctcgcttgcctgtcccaccccaaagttctactcacaagagactaaagaagacatatttttacataggtcagaattcctcaaaaccgtggccttatgtagcatcatggtgaaaactccgtatcgccctttgcttctgacttcatatcttactttccaaggccgaattctttcattgtcttctcttcaccagattcccaacattatcaattctggctcctagaagtgtgctatggcaaactaatttgcaagcattaagggtggaagtggaatcacaattaaaaaaaaaaaaaaaaagactgcagctgggtgctgtggctcacacctgtaatcctagcactttgggaggccgaggtggccttgcttgagcttaggagttcgagatcagcctgggcaacatactgaggccttgtctcttaaaaaataataaataaaataaggccgggcacggtggctcacgtctgtaatcccagcactttgggaggccgaggcaggcagatcacctgaggtggggagttcgagaccagcctggccaacatggagaaaccccacctctactaaaaatacaaaattagctgggcgtggtggcgcatgcctgtaatcccagctactcgggaggctgaggcaggagaatcgcttgaacccaggaggcggaggttgcagtgagccaagatcgcgccattgcactccaacctgggcaacaagagcgaaactctgtctcaaaaaaagagaaaaaaaacaaaaataaataaaattaaaattaaaaagacaaattcacactgagccatctggctttgctgatgttaaaaaaaaaaaaacccaaaatatttgtcttgacagaatatgttaaatgagttctacaaatttacaagtcagggttttaacatacttgacagaaatgggaaaaaaaaccaaaaccttttagatttcagaagccaaaattttacgtggataaatcaagttatatttaaatgtaaataaaaatagacaattcttcatcttccttaatttgagatttactagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtattggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggtaaggatgtggaaatgtgaggttcttgtagtaagaatgcaaatggcactctttgtagagtaagtctgttgacatctcataaaactgaaaatgcacacaaccctgtaaatctagcaactgcactcagttgatttcagcccatacatacaaagagacctgcataagaatgttactaggctttgtaaaagcaaaaaataaggaacaacttaaacatcatcagaaggggaactgataaactctggtgtaatccataccacagaaatacaacaccgcatgtacaggaatgtgctacatctatacaaataaatggtcaaactcaaaacaaagatgactttaaaaagaatgacaaaatgtttagcataccattcctgaaaattaaaaaaacaaaataaaaaatgtcacggtgaaaccccgtctctactaaaaatacaaaaaattagccgggtgtggtagtgggtgcctgtagtcccagttactcaggaggttgaggcaggagaatggcatgaacccgggaggcggagcttgcagtgagccaagatcgggccactgcactccagcctggggacagagcgagactccgtctcaaaaaaaaaaatgaaaagaaaaacctagatgggtaccccactacacaccgaggctgtttgttatataccccattgctcctagactacaaacctgtacatcatgttactgaatacggtagacaactgtaaaacaatggtaagtgttgtatctaaacacagaaaaggaatttttcagccttattataatcttatgggatcactgttgtatatgcagtccatcactgaccaaacgtcattctgaggtgcatgactatcagttctggcattgctgccaaggtggctcaattctactttactctctgttgtgttcaggctccacctagcggcacaaaagtctgcctcctcctttttagcaattaaatacctttcaacctaacattttatctctctgccatgagactatgtgtgtgtgtatatatatatatatatattttagctattaaacacatttctcctgggggaagaaaaacctcatggcaaaaaaaaaaagcctccaaccaatgcattaaaatctacagattaatccaagatatttaacttgaagattgtctaaaatattatttctctattttgcttgtttttgccacttgtaaatctcagagttctgcattccattttcatcacttattggatttaatctgcaaaataaggctaataataatattgagtggtcagaggattaaatgagttaacatatacactattttgtaaggtacctaaaacttttattatttattttttgagatggagtctcgctctttcacccaggctagagtgcagtggcatgaccttggctcactgcaacctccgcctcctgggttcaagcaattctcctgcctcagcctccgactagctgggattacaggcaactgccaccatgcctggctaacttttgcatttttagtagaggaggggcttcaccatgtggccaggctggtcttgaactcctgacctcaggtgatcagtcagcctcagcctcccaaagggctggcgtgagccaacacacccgaccatattatttatttttagagacagggtcttgctctgtcatccaggctagagtgcagtggcaccacgatagctcactgtaacctcaacctcttgggttcaagcaatcctcctgcctcagccacctgagtagctggcaccataggcctgtgccaccacaatgggctaatgtttttaactttttttgtagagatggggtctcattacgttgcccaggctggt

SEQ ID NO: 12087 - DNA, 24638 bp, Human
gaggatgtttctggaagagattagcatttgaatcggtagactgagcaaagaagatcaccttcatctatgtgagtggagtgggcatcatccaatctgttgagggcttgaatggagcaaaaagacagtggaaggcaaatgtgttctctgctggagctgggccaaccagcttctcctgtccttggacatcagcattcctggttcttgggtctctggactcagattgggccttatgtcattggctctcctgctcttgggccttcaggcttggactggattacaccactggctttcctgggcccccagcttgcagacagcagactgtgggacttctcagccttcataatcgcatgaaccaatccctcataatctcaattactccccccaccctctctctatatgtatgtgtatataaaatttattggttttgtttctctcaagaaccctgactaatgtagggttcaaaggctttggggatcattctaaaagcaagacgaaagacaaatgtccaccagagcttgcaaatactgtatttatcaatccctcctcttcttggcatagtttctttcaaacttcttagtgtcctcttcccattattacaaacttctcgtttcttctaaggtccttctaaattggtgagttctcagtgggagttgagtgaccttttccctcagtgtgactatcactgcccaatgtcattgatacattatacaactccccatccccacttcccctcagctcctgttaaccaccattctttctgtctctatgaatttgactactctagattccccatgtaaatggaatcatacagtatttgtctttttgtgactagcttatttcacttaacataatactctcaaggttcatccattttgtagcatctgccaaaatttcctcccttttaaggctgaacagtattccattgtacgtagatactgcattttgcttttccattcacacaaagagagacacttgggttgtttccgcctcttggctattgtgtataatgctgctaccagcatggggtacaaatatgagaagtgaggtttaggatcgtgtgaggaggatcacttgtagagggaaaatagtgaaataggacgaccagataggctctgttggaactcgcgcccattgttttaagacgcagctcaaatgtcacctggttttagaagtcttcctggtctccgcaggcagtcagtatctctttcctaaatccaccacattcccgtagacagacaccacatttatgcaaatctccttctcacagacagtgagttccatgggggtcccctggcagcctccagccctgtaccatgctaactcttccggagaggaaatggggcctcgggagagcctttgaagcctgtgttggtacaggctgtccttccagctaacggggctctctggggaatgtatgtttgactttctattcccggtaatataagttcaaatgtttgtggatatttgaagctcggatgaaagcgtttctattcatgcccctagaatctgtgaggccttttctttctttttttttttttaaacaagagcccacagcaaaacttgggttacttggctgaggaaaggaatgtagagctaggagcagggtttcatcttcagccccagtcgggcaaaccagtggcagaagggaaagcagagcccaggggtccccatcccgtacctggggcgcaggccccgctggggtgggagggagagtggagggccgggcaggctgcagccgcggatggctgccccccctgccccggtgttactgggaggacggaggttgcgacagcagccgagcccacccagttgcagccggctcggggcttagggcaggggcgggaggtgaccaccgcgccgctggccgcctcgcccagacattccgtttctgccgctggaatgcgcggacaaggctccttgttggccttgggcggggttcgccgggccggcctggcgctcgaggccccggggcggggcgggcccgaggccgcgggacctttaaatccgagcctcgcgtgggctcctggcccccgacggacaccaccaggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtacaggcgggcggcgggagggacgcgtgagcatcgaacgaggagaagcccagggcatccaccaagcgcgcttcatcccggcctcaggccgaccgtggtgcgggggaaagaggcccctcccggatgaatcctgtgggggaaactgaggtccagagaaggggagggagatgcccaatatcactcatgtgtccaggctagagatgtgggtctcctgaagctctcactcccctgtgattcggccaggagcacagggcagctggggagcgcaggggctgctgcccagcggctgctgctaagctccgtcccagtcctgacctctccattcagtgagcaaacccttcctgagactctgctgttagttctcttggaatctctccatctccatccaatatcagggcgtgatctttcctcccctcccacagtcctcaggctgcctcagactggaaggtaagggatgcgggtgtgagaccaggaggagatccgaggagccgtaggataccccaggatcaagacactctgggtctttggcgaacaattctatttctctttttggtcagcaattgattcctgaagcagagcaaagctcatagtgcagcgaagcgggcaggtcgtctgacacagcccctgacagcacatgaagggaaactgaggcatatcaagttgaagggactctgtgaatcagtatcagaggccacaataaaattcagggctccgaaatcccaagcaaggtctctttccactgccccagcctaccaacctcttaatatggtttacataagattgtatcttcatttccaaaaagcgcagcttcagtcttgctaaaaagagtctgtgccaggccatttctgggtatgcagtctcatttggccagccacgctgcatgcctcaggctgatttcaattgtctatccccttctgcatctttctggataagctgagaaggagctcaagggactctttcctgactcaaatactcagtccccgtatttgaagtggcagatttgaaatggcaaaagcattgctgctaaggcaggaggtaccggggtccacagggctagattcagctggtggctggttgctccaggccgggaattgagggaaagcctttcttctggaagttaatcttactctagtcctgacctgcctccctctgggatgggactggaagaggaaggagagattcagcaccaggtggccatgtccccctaagctttactggtctttcattacctagagtccgaacctgatcatgaatgataacccattaataaatgcgagattccaccctgttccaaattatctccttttagcaaccagaaattgctaagcttcgctatggatttttatttctagcaggactgtaaggactcagtggtattatgagtatgggaacattttaggagattcagattctttctttgttcttgggaatcaaattgctgctatttagtaaatgggagtgagattcaaaaacaactaatgattgatgcggagtaccagtcaggaaggaaccagatgttcacagaattttctgccaccatggtcaagcctcaggtattagttttctatggccactgtaacaaattactgtgaatttagtgccttaagacaacacacatttattacctgagagttctgtgggtcagaagtctgaccctggtctcactgggctaagatgaaggtgtcggcagggctgtgttccttttgggaggctctaggggagactgcatttcccttccctttccaccgcatgaaggctgctgagttccttggcttatggcctttttcttccattttcagagccagctaaagcaggttgaggccttctcccattgagttactcacatttctttcatctgcctccctcttctactttataattacattgactcactgaataatccaggataacctcttgtgtagagctctttgacttaatcacacctgcaaagtctctgctctttgccacgtaaaagtaacatgtctctggaattaggacgtggacgtctttggcgggggacattattctgcataccacaccccgaatagaggattcggtgtgaataaccaagtggagaaggaaagaatcatgcacgtttagttataagaacatagccatgatatttataaggacaccatttgggtgctggtgaaagcactgtcaattacagagttcatatcttcatgttacccccaccttttctttttctaattatacaaaaatactttgacccatctccaggaaagattttcaacataattcttcttcctagctctagatctatgggactttccaggaatgaagtaaaattctggaggtttttttttttttttttttagtatttgaagagatttattctgagacaaacatgagtgaccatggtctgtgacacagccctcaagaggtcctgagtacatgtgctcaagatggtcagggtgcagcttgtttttatacaatttaaggaggtatgagacatcaatcaaatacatttaagaaatacattggtttggtcctaaaaggtgggacaactcaaagccggtggtggtgaggggcttccaggctataggtaagtttaaatattttctggttgataattggttgcatttgcctaaagacctgggatccatagaaaggaaatgttcaggttaagataaaagactgtaaagaccaatgttcttttgaagtcttatagtggctacccttagagacaatagatgacaaatgtttcctattcagatctttttaaaaaattattattattttactttaagttctgggatacatgtgcagaatgtgcaggtttgttacatagggatacatgtgcgctggtggtttgctgcacccatcaacccatcatctaggttttaagccccacatagattaggtatttgtcctaatgctctccctcctcttgccccccaccccctgacaggcgctggtgtgtgatgttcccctccctatgtccatgagttctcattgttcaactcccacttatgagtgagaacatgtggtgtctggttttctgttcctgtgtcagtttgctgagaatgacggcttccagcttcatccatgtccctgcaaaggacatggactcattcttttttatggctgctggagttgttttttttttttttaaagaaagaaagaattttgattccttttttttttttttggcttttagagactgggtctcattctatcatccaggctggagtgcagtggtgtgattgtggctcactgcagccttgactctctagctttaagcgatcctcctgcctcagccccctaagcagctgggactacaggtgcctgccaccatgcctggctaatttttaaactttttatagagatgaggtctccctatgttgcccaggctggtctagaactccggagctcaagtgatccttctccctcagcctctcgaagtgttgggattacaggcgtgagccactgcgcctgggtttaattccttttgacttaactaaatgcatgacatacagcatatttcagggcggtgacttaaagtcaacaagcaggatgtttactgaatacatgagagaatgttgatttttgtggaggaaaatgttgcctcagagagaggtaactgggattcagtagcaagctcccagggactgggagtcaggaaacctggagtccaatccatgctctaccactttctagttctcacacctccttgaacctcaggtttctcacctgtaaaatgaatataaaaaccacctctgcacctccagcctcacaggttgatgtgttggtaccttgcgattcctaaagtgttactgaaaggaagattttctttttgttaattaaatacctccaagcagcaggctaaaaacaagaagataattttctgcttttaaaagaaaactagacagagacataaggtaggctgttccaggtaaggctttaatttttttctataaactgcttagtctaggcattaattttgaatcacctttttttcctactaagtattaccttcctagagtagcatcaacttctgcctccttattaggaaaggaaagagccttgagtgacacttcatgccccaggacctcatttccatttagggctgcatgcgtgtgttgggtgagaagggggaatgacttgaaaaagaagtttagggctgggcacagtggctcacacctataatcccagcactctgggaggccaaggtgggaggatcacctgaggttgggagtttgagcccagcctggccaacatagtgaaaccccgtctctatgaaaaatacaaaaattagctgggtgtggtggcgcacacctgtagtcccagctactcaggaggctgaggcaggagaactgcttgaacccaggaggtggtggttgcagtgagccaagattgcaccaccgcactccagcctgggtgacagaatgagactccgtctcaaaaaaaagaaaaagaagtttaataattggctttttttcttgtctcatcctgacttgtggatttgatttttgtatcgaggagagagggtgtgcaaacaggggttgggggaaacaggaaagaacaggaaagaatagatgaacactaaaatgtactgtgatactaaactgttaggtacttttgtgtagaaaagagataaattctttgaaggtgggaaatctggctatctggtttatatgcttttgtagctccagggcttcatacatgtaggccctcaaaaaatgtttttggtgaatgaataagtcaaaagagagatgaccaagagagttagttggggcagtagggtagataccagatcacaatccctgcttcttacgagacatgctcatgaagctggaagctcactaaacagatacaagattaagttggcatccctcattctactttttttttgagatgatgtcttgctcttattgcccaggctggagtgcaatggcaggatctcagctcactgcaacctccacctcccgggtttaagcgattctcctgcctcagcctcccgagtagctgggattacaggcacatgccactacgacccgctaatttttgtatttttagtagagacagggtttcaccaagttggccaggctggtctcaaactcctgacctcaggtgatcctcccgcctcggcctcccacagtgttgggattaccaggcgtgagccaccgcgcccgggcccctctttctacttacttttttttttgttttgttttttgagacggagtctcgctctgttgcccaggctggagtgcagtggcgtaatctcagctcactgcaagctctgcctcccaggttcacgccattctcctgcctcagtctcccgagtagctgggaatacaggcacccactaccacgcccggctaattttttgtatttttagtagagacggggtttcaccgtgatggtcttgatctcctgacctcttgatttgcccgccttggcctcccaaagtgctgggattacaggcatgagccaccacgcctggctctacttttaattagttcagggctccagtgagcccccaaattcactaaacaggaaagatggccagatggagggagaattcagggatactctggagcagttttcagccccttggaagtggagtaaaagaggggggccaccagaagagcccctgagtgccttgcctcagactaccattgcctgaggcttgggcacagtggttggcagtgaggctgtccctgagggcccaaggccttttacatggttcagggacacattgtccaattgctccagatagccaaggtacttaagaaatgtgtagaatctattaattcccaggaatcatgagggcccttgggagcaaaagcttaagcagagggatgaggttctaagtgaaatttcaggattcagccagcctgcaggtgaggtatttggggaaacttcacacctccaggtgaattctcactagggaattctgaagtccttggtgctttcaacaccccgatggtcttggggaaggtcgcaggcagtggtgatgttggggtcaggagatgctgccttgcctggcctcctggaatcccagagttctctggaagtgaggattactgcatttctaattgtggtctgatcattgcttggtcttttgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggccgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaggtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtggtaagttggtcagtctttgcttccaactagaaaggatgttatattcagacattgtgtacccagagaaaagagtattattcttttttggtggaaatttaatgaaaaacttaaatatatccaatgcgtgtgtgtgtgtgcacgtgtgcatgcgcgcgtgtgtgcgaccaacctaaacacactctattggtttaggaatatagagctgcattatatggaacttggtttgctcataaaatcttcatgtttgcgttagaactgtgaaggtctgcaaatatccaggataaatgaccctgctgttccctgtcagggtcaggaaaaacaaaactcaagatgcctctcctgtcccctctgccccaccactacatttttttcccctgatacatatttttttagttttaccatctctagatctaacagaactctgtttgttctcctgcagaagacagggagaagcgtctgtccttgggagagtcagcaggcctctattccaatgtcaccgtcagcccgagtgtgcatttagtgaatgctctggttttcagactgggctgtttatctgattactctttgttgaagaacaggattcagggaccaggcagattagggtttcagctcacttgaaagaaagcaagatgatcttaagaaatcattctgttaactctgctactccttccatcctttaggatggaatttgaataaggacatgctaattttattggaatttttagcatgaattgaccaaatctaggactacagatccattcaatgctggagtttaattttagtcactgatcagaattatgatctgtgggactcatgctttatttttttatcatctggagataatcttttgttccctctatgtgaatatccaagcagttgtggacaaatttctagttcaggtgaatttttaaacatagatatctttttgcaatataatttatttcacacttatttattcagcatgcatttattgatctctgatgatacaaagataaaggtaatccctccataccattaagtaacattctgggggtgggggtgagacaaacaaatgaaccaataattaattacaattatacatttcaaggagacttttaatctaggttaatgtgaaacgcagccatcaatggtttgtcaggaaaagggagatgaagtcttgctctggggcaacgtttggcctcattgcagtcagacttggctgggatccccttgtctttcctgtcccaggacactgggctttcacaagccatcactggctttggtggcatctacttggcattcgttggcttccaaaaagaaagtggctttctttctcccaggaaatcaccctcccactccatgcttgtgggtgagagcctctccatcaacatgctggtctgtggcaaagttgggtttcaaagctagcacctggggttgggcttcgaaggctataaagtaacaagtggtgagtggcaatcttttccttctggtacaaaagacctgcttgttctgggggaaaaacgtcctctctatggaaaaaagactgagcggcagcttgttgtagtcaacgggttggaaagatcattccatgaaaaggcccttcttgggaaaatattagccttgtcctgttgccaagggcagtggaggttgggttacctgccacaggagggccagcctccttcaacaggcctccttggtttctcagaaatgacttaattcattgattcatctttcaaaagaggtcactaggaaaaaaatatccaatgagatataaatggctccaggagcaataagatggagatgtagtttagctaatgtaatctcatttattttgttcttttctttttacctgtttgtattagcatatgagttcactatggatttagcgtatggatgacttcacccaccttacatattcagaagacagttacccgaactgtcctctaccatttgcatgttcaaatatgtaccactgcccacctgtgagttcgttctaggcttagacccagacttgtgtgagaattctgtttagacataggctatagaaccttggaaatcagattctggctacaatgggacaactagctcacgtcacttcaggctgtgcatttattgttctcccatttcttgtggtggggaagcacaaatctttttttcatggggaggcggataagccaaataaaacatccaattgcctggcctatgtaagtgtttggcttcagctccaaactccaaattccctttctcccttgagaaagtctatatagcaagatgtgtacttttaaattagcaacaatttctagtttaagagtagcattgctaataagccagaggcagaaaacaaataaccatttttttatagtgaagtaaagatggactcggaaaggagcccagagagcaatgtctattgacatgggagacggtatctgagatgtttcctaagtgtcagtgctgactgttgtaaacttcctctcacagcgctggacccctgtgtgcttggaacacaccagtgccagcacgtctgcatcagtgatggggaaggcaagcaccactgtgagtgtagccaaggatacaccttgaatgccgacaagaaaacgtgttcaggtgaggcctgtgtagggggccgtgactgaatcaaatacttgggaacctatgctccaggttttggactggccttgtgctttgactctctgacccctttttacctaactgccttttggctggtttactggtgttcatcagcagttttccctgaaaaggagcttagggagaaaagtgaaatgatagataaatcagcttatttccatactttgtaagttttaaataaaatcgtaggagaaaaggctactaagaaagaggtccaggctgagtgcagtagctcatgcctataattcccacattttgggaggctgagatggtaggatagtttgaggctaattcgagattagcctcgagaacatggtgagaccccatctctacaaaaaataattaaaaaaaaaaagccaggtgtggtggtgcatgcctgtagtcccagttacttgggaggccgagatgggaggattgtttgagaccaggaggtcgaggctgcagtgagctatgataatgcctctgctgcactgccacagagggagaccttctttcagaaaacagaacccacacacacaaaaaggaaaagaaacgggtccaagattcttagcccttttgaggatttgaaaattttcctggattttatttcattacatgcaagctaccctcttcctctctagtcatagatgctcatggaatctagaagtagcaaagaagttagaggggtactcactggtctggtacatagatacatacatggagtcaatgaggaatgggaattatatatttttttgttttgtttttaatcctagaaaaaagtttttgggaggaagaaagcttagagataacttaattttatagataatgaaattgagatggacagaagggaaaaaacttacctatgtcacagggtctcttagtgaaagagccaagaccggagggttggttcccaactcccagctgcccctcccttgtttcattagctctgtgtgtgtgtgtgtgtgtgtgtgtgtgtgtataactgtaagtggcgtggcccacaattatttctgccatgctctgcatgcatttacatttgtcccaatcatcttttgatagctcttgataggtgtgctcttaacacccacggatgtgagcacatctgtgtgaatgacagaagtggctcttatcattgtgagtgctatgaaggttataccttgaatgaagacaggaaaacttgttcaggtaagtgagggaggagtctttactattgctacttagctctctgcctacctacccggtgatggaagggcaggtcacattgactgggaagttggtgtgttttcctctcttgccaccttgagcttttcccatttttaagtcttatccaaaatgttagaaatggtaacatgtatgtatctcggcccaaatacataaatatgttgctcatttccttctctgtagccagcctgaacaatccttcccaaatgctacagacaattcagtaggttgaaatcacataacaacccacaagttacctgttgcttacaaagggaaagacagtaactttatagtggagaaactggcagacatcaccttaactaagtgatcaaagttaacatcatcagtgatgacacatagtgacatcatgtatgacctgacatgctgtgctcaatactgtggacacaacagcacacctgtagtattcttgctaaaaattcaggattatgaggaaagattagaaaaacctgagagacactctcagttcacaaaatagttttccagtacttctcagaaacgtgaaagtcataaaagacaaagaaagacttaggaagtgtcccaggttggagaggacggagatgtgaaactgaatgcaatgtggaatcctggattggatcctggaccagaaaaaggacattaatggcaacatttgaataaagtctgtagattagtaaatcatattatatcaatgttaatttctggtttgataatcatactatggttatgtaaattactgtttggggaaacagggtgaagtacaggaattttttgcactgtttttgcaaccttttcataaatctgaaattatctcagatgaaaagtttaaaagtaaaaaatagtttaaaaatatatcagtagagaggaaagtgcattgaatgaaaatgtgtgtcttgagtttttatgctgctctgaatcaaatggtctccctcgcgctcctttccctcatttaaaaaataggagagggttgaactacaatttcttcaaactctaattctatgtttttctgaatctaatgtaattagccacacaactgttggtatcccgctgagttgggataagtacaataagcctaaaaggaatgctagaaagtatttatgagatacttaggttataaaaactcaatactgatgatttccaaaagcaattgtggaaggtcagagaataattattgtatgtgcaggatttcacttaactcagttaacttctagttagaaaaaaacagtgccaatggctttgaatagtttccagtaagttttcctcatatgtttccagctgcaaataaggtttctatcctgggtaataaaatacttttccaccttctatttcttttctcctgactttttgtttcacagctcaagataaatgtgctttgggtacccatgggtgtcagcacatttgtgtgaatgacagaacagggtcccatcattgtgaatgctatgagggctacactctgaatgcagataaaaaaacatgttcaggtaagatccactcaaaaaattctttcatacttgggtctttcacatgaaaccaacttgcaactcaccagcaaagaggtttttaaaggtaacttaagatcaaggttcagacattctatcacacttttagatgaaggcacacattgctcagagggtggtgagctcactggagcaaacatagattacttcagaaaattactgggaaataggtagggagtgggggatatgagaaaaactaactaaatgtagggtccttatccaggaaaattttatagctctgtacactgaagacttttaagcaaagagaaaactttagtggaagtcagttggacagtaactatttggtgtgataggatgaactgatctttttccagttaaaacttggcctggaacttttctgtagtgttaatcttaaagctggatgattttagtaaagaagactttgtgaatgcctgaattagacccacacagatcttccagtaagtttgaggccagtcactccctggcagtttctagacgatcaatcattggtgaaactcagccttatacgttggccaatgagcccaggccagtgctgttaatcctcattaatttgatttaaacttactggcaggacagggtggcatttataaatgtaaaaacactcctgagagaaattccaagctctcaaggtgccgtttagctttggcatattgaatgtgttttagatttgacatatattttcctctcccttgaggacatacagacttcatcaagatagacaaagggaaatggcatgtcacccagtcccctcttttttttttttttttttttttttaaagggaaaccagtaaaaaaataccggacacctactttgttcccagtatggaactaagcattgggagcatacaaagaagcctaagtttctgcctctgagcaagttaaatctgggtgaacagagagccggctccttatgaaagcagagactgagccagggagagggactgatggaaacaaagggctgtagaggctggggaggtgggcatctgcgaagggctggtggtgggccttgaaggagggtgaaggtttcaatggagacaagtggaaagtggcactggcgggggactggcttgagctgatttgttcagggcaggatgactaagaaagttggggtggagagaactcacctatggctgcacttctcaaactagtgacaagtgtcccagttggtactttaagctgccaggaacattgaagacctgggaaaacaaaccaaaaacaaatttccatttaaactaacagatagtatggaataaagtgaagcaatctattttaaaaaaaaacataaatcaaagaaaattttcagttaaggcagacaacactcccagatgccagtattccatattcttcaatacctactgtaggccatgcaggattctaggcattttagatacagtaatgtaccttaatactcacagcaacgttaggaggaaactgattcagtaacttgcccatggttactctgctagcaagtagcagacccagggtttgaacccaggtacttcctctagtggttacataggctcttaaccactaagccttactgtcttaatgtacaaagcacaggacagtgaagagggacagaagagaaagaatactagtgggaaagttagttatatatatatatatttttttttcttctcttttttgagacagggtctcattctgtcacccaggctggagtgcggtggtgtgatcttggctcatacagcctctacctcccgggctcaagtgattctcccatctcagcctcctgagtagctaggactacaggcacatgccaccacacctggctaatttttgtatttttttgtagagatggggttttgacattttgtccaagcttgtcttgaactcctaagctcaagcaatacacctgccttggcttcccaaagtgctgggattacaggtgtgagccactgtgcctggcctatttatatattttaaagtaatagtgaatactgctataaagctggggaacataccatggatcagatcccttctaatggtctgcttttccgttgctagtggtaggaaggcttgtaaattaaatgtggagccccaaataagggccaggggctggaagcatgtccatttgccacctgtagagtgggtactaacctggaatgagggggaaaaaaatgaaacaccctgctataaggcattttgctgaaaaaaaaatctaaattgtagcactgaaagggaatagccatattaaggttggaaaggcactttatgtatagattatatagcgtctcacatttcacaagaagctattctataggcattagtgagccacaaaaggttctgcccatgaaatgacatttaagaggaaaattagagggaaataaactattttggttcctgcaatggcagaggaggaacctatgtcttccaggaaggctttctggatttcaaaggagaattactgttttatttgtcctaggccagtctgaacatgggatgagtatggcactttgctctcctctccactcaaatttgggcaaactgcatttgtccctgaaatgttatttgtgatagatagtaagtacttcactctctaatcatacacatcatcattactaaccctgtatcatttccccatctgtgcttgtgtgtgtgtgtgtgtgtgtgcatgtgtctcctggtcagtcttttctgttacactttgtaagctatgaaggcaggcacttggtcaatatagtgctttttgtgcagcatcaaacttagctccatgtatgattaggtccctaaaacattacttttggtgatgatgatgatgatccatgagtagctggggatgctagaagcattgatagtcatcgggaaaggctggaggtaagttctggaatatagtcaagactcagtgctgcccagtgctgtgggtagaaaaaaaggaaaggtacccttagatatctgtgagagatataaaggaaaggagtgtgtgtgatgtgaggccaaagggatgagaggtatgggaagagaaaacaggcttgctcctgcagcatggggcctgttgctgactactgactactacattctcagcacttgtggggaccaaatggaagcttctcctctcaaacatttgtgtttacttttctatttaatgtgtgaatattttctttcctgcaccacgtgcggtcagtccgtgacaagtgtgccctaggctctcatggttgccagcacatttgtgtgagtgatggggccgcatcctaccactgtgattgctatcctggctacaccttaaatgaggacaagaaaacatgttcaggtgaggatcagccctttaaggctatttcctttggtaggaaaatttttcaggagcaagcttttttctttctgtctaagacacagttgtgattctttctccctgtcagaattctccagtggctcccactggtctacagaataaaacaatgatacccctataccaggcagcctaccctccatgatctgtttctgtcttctctgtttttcacatttttcttaataactaaactttctgcctaagtctgaattttttttattgtggtaaaatacacatacaatttaccatttcaattattttcaagtgtatagttcagtggcattaagtacatttacattgttgggcaaccaccaccagtatccatctccagaaattttttatcatcccaaaataaaagtctgtgccgatgaaacaataactgcccatcacccgctcccctcagcccatggtaactacttctctcatcctggcttttaaaacttttctactacatttgcccccagattcactgcttcttcctgcatcctggtccagccacagtgggctctttgatggtccaggagcatgccctgcactcactcattcccaccctcccctcaatgcttttgcttgtcagaatttgcttgccaacatttggttttgttgaattaaatttttgccaatccagtggatgtttttttcatttcctggttactaatgaggtgaggcatcttttcctggagagtactgccattttaacagtctttcattgcattaacatggtatgtctttaatttaatttaattttattttattttaggtcttctttaatttctttcaaaattgttttgtagttttcagtgtacaagtcttgtacttttaaaaatatttattcctaactattttattccttctggtgctattataagcaccatttctccatttctcaactttcaattttgctacaacccaggtttgagaaatggagtttgagatccatttctcaactttcaatttttctacaatccaggtttacaattttctatgaagtgttgtaattaagactatcccactgaacccatgccctgctagagcttagagactatcaggcacgacagacactgaacaagtattatatatacccatcttatgggtacagggataatggacatgtagttgatcttcaatagatacttcctggtttattgactgattaactaagatgggatttggactggctgtccctaaaaggttcaataggattcagacaggtggatagatgatagattatatttaatgaatttatgatctcccatccctatattggatctttgtaaaatgttaagagtaaaaatgttgcagcaaaggaccatttcctgtcctcaggcaatagaattactccattggaagatgatacaccagtcttcagacctgggaagttactcttatttctattcacaactttaggaggagccctgatactgaataggaatagctgcctgactgaattccataaagaaataggagttacttttatcacctctcatatttggttaaatgtcaatacaaacgtgaattttcagttccaaagtatttattggtaagaactaggactcttacttcaaaccattaaatagaataacagtcctctagaggaaatcaggacttaacctggtttttatcctttttttttgttttgttttttgagacgacatttcaatctgtcacccaggctggagtgcagtggtgcgatctcagctcactgcaacctctgcctcccgggttcaagcaatcctcctgcctcagtctcccgagtagctgggattacaggcatgggccaccacgcccagctaatttttgtgtctttattagagacggggtttcactatgttgtccaggctggtcttgaactcctgacttcaagcgttccacccaccttggcctcccaaagtcctgggattacaggtgtgagccactgcgcctggccctagttttcatctttggtatattttagccatacaaatagaggactattgtcctagttttatttttatttatttatttttaagagacagggtcttactctgttacccaggctggagtgcagtggtgtgatcatggctcactgcagccttgaactcctgggctcaagtgatcctcctgcctcagcctctcgagtagctaggattacaggtgtgtgccactatgcctggctaactattttacttttttgtagagacagggccttgcttcgttgcccagggtggtcttgaactcctggcctcaagtgatccttctgcctcagcctccaaaagtgctggcattataggaataaggcactgcaccaggcccattttcctttcttaattacacagtattacataaacattgtcttatttctatatccctggcctccccctataccaaccatgtttttctaaatttactttatatcatgaataatttctggcaatcacaaaagtacagagaataaaataaggaaccctcacttaagcatcactcagctttgacaattataaacattttccccaatgtatcctaagatgaatttttctgtgataagtattttctcgtctttttgtttgttcatctatccctttacctcttggaaaatgcacttaggtaagtcttaacggtggaaatattcaactgtggatttcctgatttgttatgattcctatatagctattcctagatagtatatttgtgtactgtcattgtcttcagccactgaggaagcacgaagacttgtttccactgaagatgcttgtggatgtgaagctacactggcattccaggacaaggtcagctcgtatcttcaaagactgaacactaaacatatcctttctggaaggttttctccttctgcctggagccaaccaaggtactacgatcgagccaaacactttaagacattccacaggcaagtgacttatttgttaggttttaatatgagcagtggtaatatacaactttaaaaaatttagagttcttttctaatggtttaatagactgtttcacccattcaatatttacatgtaaaagctgcctattttgtcccctagtgcttttccataactgtatatgctcctaatgatgctcttacataacagatggaacatttatgctaatgactccttaatatggctttcttagttcagaatctgaacatgtacaaagcaagtcagctgattaatggggtgtgatatctcagattacacacagttgtaccctttgactagccaagtggtcaaaaagcagattttaaaatgtaacatgatacaatctcagaaactttcaaaatcagttctttcttcaaaggagtaactagggaaaagtttctcagaacagttcaagttaacaactctgttcctatgtaccccagaggagtggaatttagattgtggtaggtacaatctaggcgtatgtagagacttttaagggaggtacagataattggaaagaatcaatttccaaatccttcacttgcttaagacactacttggaatcagctggcattttcttttcccgtctctcatttccatatcaccattctcctaacttcacacaagaaaggcatacttctcatttaccctagatctactaaggtgcatttgttagaacagcagaatcttgagatagccaaacaaagggacaatccaactatccctttaatcaatacttcataaacactgcttcccccatccctcacactaagatgctactccaattacattttatatgaacaaaaacatctgaagaccactgcaggggtctacttttattgtgctctctgaagaacaggatttttgacttttagactgaattcaacttttggtgagaaaacagttttgctcttttttttcacttctcataggacataattattttatcttgtgaagtgtttgaaagtgtgtttatattttctaatgtgtaaaaataaatggtgttggccttaacaacttgccacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgattcttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttacatattatcatgtctatttttgatgactcatcaattttgtctattaaagatatttctttaaattatactgaattaacagttattttgatattcaacagtttcttatcaaaagacagaagtttgattctcctcctatagtttaatctcacactcctgaggctaaaagtgtaagttcaggttcaaaagaaaggcttcaatataaaattatctaaatttggataaaataatgatgagctttacattaatataagctcctgagaagcaaatatatcctacagatgtaaatataaaatataaactttaaggaaggaacaaaaactaaatataccaaggaaatatataaagcatctcttacttttcaaaaattttgaaagggtatgacatagagctacagtagtattttccagacttttttgagcccaaaatcagtaatacatattaatataccacagagaaatggtggtatagaaggaataaatgagagttcatgtgcaagaagggaaagataaagagaggtgagttttcaggtgtcaccatcagtaactagcttcaactaattatgtcttgaccagtttattggaaactcctgggttagataatactaatttgtctcatgcgtccagtatagggagcctatggacaggggccaatgtatcttaaacagacacacaaacaatggaaagcaaacattatctgaatgggattgggttaagtttggaaagaattcctcatggagactgatttgtgctggtttggctaggcacaactggcctgttaagagggtaggaccatatataaagtggcttgggaagcagagccggatggaatgttgccctgcagaaagcatattggcttacttgaggtgggggctccctagtaaaaacatttaggattgagggaagatctgattttggatggagtttagatttgctaggaaaggcactagggactattgtcaattctataatagattgtgctgggtgagacaaatcacccaggtcaaaggattggaggatttttattttatttttgtctgagatgggaaaagactccaagtggggaaattaactactgatgcataaattacatgctagattatggtaaaagggaaaaccagaaataaaaacataggtgagaccaaataatttcatgagtggttctacttggatttctgccctatgccttagactttgaggctttgtaactctcaagcattccaaaaggacaaaggagaatgaagaaagaaggtaagaaaaagaagagaatatgtaacagtcgactctagacgagaaaacaccaaacgctcaaatatttgtaaaatgggaggccatgccccaatagcaattgtacgctgtaattacccaacgtttacagaaattcctttaaaaggaccctcggggttgcggtaataattaaactgttaaaaaatatcaaaacaagcggaataaacaaaatcttctattcctaaattgctctagaggttctccaatccccaaagacacagagaagggttgtaagatctcagtacgcacatttgcactttcatctggccagtggcgccagcctatcaaatacagtaaatggcttttccctttcaagaatgttggaactttggaacttacaaaatactaaataatttgcccttattcgaacgggcgcctctcctcttaggtttatagtaatgccacctgaggcgcggctccatagcgatcatcacaggtgtggcgggagggagggcggcagtgaccacgagacggggcgcagagggcgagcgcacggctggcagtgacaggtcgcgacccagctccttgcggagagcagaaaggcccagacgccagggaacaggactagcccagctaccgcctcgcgcctcgcgccctgcgcccacaaacccatcgacgtccgcgcaggcgcactacgccggtgcccggtgcgagggcgtcaccggaagtgtcccgcggcgccccggatgcgaccgggcaacagcggttgccagggcgacgggagctttccggagctgctggtactcccgattggagacgtagaaccgttacttgtcgaggg

SEQ ID NO: 12088 - DNA, 44180 bp, Human
tttatttcttggctcatagaatttcattcttctcttaatgggcttcatttttaatgtctggctggctgtaacctacttcaaattctttatgaagtaggcaagatctgcacagccaattaatttttcaggacccacttcttatcatcacagaattatgaatgggaaataatagatgaaaaacacagacatgataaactgaacatagtatttattaaggtcaggatgcatgaatagactcttctcaacagaaagataattcaacagcaatcaatttacagaatttagaacagcactacatttcagcaaaatgcaactagagaacatcagataaattatagtaatttgtttttaaaaatccattaaactatctcttacctctgcaataatgtatcatacatgcagttacagaagttagtagggaaaagcatgatcttccttccctattctctgcccatccatcttccaggaaaccacaggctgctgctgcccagagttggcatgaggcttcgaggctgctgcttttccccctacatcataaccgatttcaaatggtgctagacaaaaacagactctgaacaccaggagaaatcggtcagcctgtgtaagagatgggccagtggtgctcccagggtctgcacctcgacagtccaggtggcaagtctgatttcgggtgccccgcaatcaacgccgaatactccagggcatcctctaagagcagactgatggtgtcgatgtggacaaaatggtcctccaggtgtactgccctctcccctgccccatgacaatcgacacccaatacattgttatccaacagaatatgacaatcgccacactcaaaggccctacgaacacattcatgctggtgatggctgctaggagtcaacagaaatagcatcacaacctctgcccctgctcaagccactgtgtttattttaaacacaacccccttctctactgtcacctctcccaaaacccaacaaactcaagagtgtattttgctcttcaagttcttccctggacttctcgaacagactcaagtggcaagaggagaggagccagttccatgagcagcagttcctctgcagtccacccttggctgtgctgcaattcttactcctaaaacactgatttcaaatggtgctagatacaaagatggaaaaatctaagccaccatgtgaaaccagcttccagaagaagaggatctcaatgaagaaagaagggagattcaatcggaagacccagcctctgccctgaggagaaatatcttcttgtagttctacttgtgatatgacacagtgctccatgggaaaggcacagaggaggttacacagggctgcacaaggcaacatgaaaggcacagctgatgcttcaaatagatgagagcaatacaaaactcattaattctaggttaattctatttaacttcacaccagtcactacaaattattatatatgatgaaataaaagctaaaattattactaaaatacattaatatttacatttgtactgccctgcatttgtatagtatttcacagtacacaaagtgtttccagatatattctcttacttcatcaggacacaagcaccctatctgcctgtggaatgaagctccagctgctacacaaaggcgagtctcacctgggccaggacaactcttttatgtgtcttaacttgagaaaagcatgcattcctccttcccaccccatatgtaagtatcagaacattcaaatatgaccccatgaacctgcaatcttatttaaccccgatgtgacttcaaaaactggtaccctataattgtattaagcagataatcctctaacgtaagaattgagttttattttcaaagtctgcttgaaaataagatttgcacactgtattccaaattagatttcccatctccttactgcatcatcttttttggtggtttgaagctaagaaaatatgtgtatttcctctgataccataaccaagagaaaagagacagagtagacactgtatattttagcttcctttcaggcctctagatacagccttataatttttatggttcctggcactaacagtatgtgttgctagaaggagaagaaatagaatttgaacatcaaaagttgcggtgtttaattctcacaacagtcgtatggggcaggtattattccaatttttgcgaagaaattcatccttaatgaggctaaataacttgtctgcagtcacacaaccaatcaatgcagatcccaggtctaactccaaagactgtgtttctgcccttgtatccactgcagcctgctccataacttgactatcatctcattttgttcttgaacttcattaagaacaaaacagggtgggtggggcaggaaattcctaggcgatacttctgcactgaatgggatcatactgactacataacacgttatacttagggggagacaggagcatcatctgggttctgcgaaagccgggtggtctggggcagcttgctttgttctcctgctcctctagcgcctttgccgtctttccccagcatgtggctgtgggaaagacactgaagatgaacctgcaacaagcgattctgacaccagcgctaggctctacagcccacgggggacttgctagcctcagtcacaggtgggagagctggggcagatctgcacacaagggctctcagtgatgacacctgtagccaacacctggggcttgttaaccaggtaacagccagggttgtaaggtcaggagtgagtgtttaaggacagttactactgggagtccaaatcctgtcaaatgaggggatttgatgagattctcacttttctgcttttcattttagccactcttccttatcaacttttagttaccagtaccccctccctatgagctatcacacaggtgtcccgcagtgatcagaaagcaccttcctccatggcgaggtcctgcctgcctaagctgttgtctcttctggaatactctccttcaccctcccttggctaccacccctcagccccgcccccacccaccaccactccagggaacctgtcatcctccccgcagctcaggaaagcctccctgagtccagcccttgctagaaggttaagtggtcctcgccagcctcaagttctttccttcaaaaaccacttatctcacttggtcatcagtgtgattatttaatgtctctcctgctacccgtaagggaccattcggagtacagcagaggggctgtgcatagcaggacgccactgccactgagggagttaacagaagccacagtctgggtccccactcctggattctaaaatttaactctttactctctggaagaagagataagaagccattaacaatgcatcactttaattaaacactctaaaagaagtggagaaaaaaatcatgttagtattgaaatcctttgcctttccaattccactggataaaaggggtccttcaggtctcagccctcccaacagaaccagttttctcctctcagaatcagctgagcaatgactcttcgctgaaacaagctggtggctgttccctactaggaagcagccagttagtttggtaagggctggaaggggcttgctttccctggcaccatgcctgaaggccacctagacctgtaagaaggcagcccatgaaaatcccagcctgctgagagctctgccatccaaggagggtgatgggttttacccacctcagcctaatgactccaaacaaactggctgaaggtgaaagggttggcagggctgtctggggaggaaaaccacccatccagaagggtgggcatgtcagtcttacgagtgctgccacgcatgggaaaggtgtgggagctatactctagcctggtccacttctgtccccacattctacctggaggcttctcgacctcacaccagggcattaatctgcttgggcacacagtgaatcagaacacaatggttttaatacctgcttggccccaactctgagaacagggacctgccacttgccctgaatgggcctcagtgtcttcatgtgtaaagagaggaggctgaggtaggctgctcacagcacattcaaatgctcggagggcttgggcaggaaacctgagacagagaagcagcaacagcatgcagcagaaatacagtgaactggagaggccatattttgtctaaatgcatgcaaaatcagatacattaaaataaccctagccaggtgtggtggcacctgtagtcccagctactcaggaggctgaggcatgagaactgctcgagcccgggaggcagaggttgcagcaagctgatatcgtgccactgcactccagcctgggctacagagtgaaaccctgtctcaaacaaaaacaaaaacccgtgcaggccaaacacacctgagggttaaataccatctataggctgttggttaaaaatagtttggagactgcaaagacagcttctacttcattctataaatgatgctttgtctttaaagcctagcatggtacctaaaaaataacatgggaggaaaatgggaaggtgagggaatccttctttctgaaatccataggcaaacccactgaacaaacagacactggtccccagttacctaaccctgcttgcttgtgctgcgctaccacagtgtgtgcaaatccagaacgtgggaaggttctgccaaggcagtgctgggtgctgagtcacagctacttacgtgactgatgtgtgttccagccagatggggggagccggaagccaagcccagatggccatcttctttcctctgggaatgctgatttcagggctcctggcagcaaggaagagctcatcttggtgagagaggggcctggggaaggctcttttgtaaaaggggaatgtcttgccctcaagagacagtcccaggccattgcatgtataaactgaaagggcagtccagcttcctgtcattctaggcagcagcctgggcattctgtctttagctgtcagggtgggggctgtgaatcagagggaagggtgataaaaggaatggtatacacatgaggggccaagggtggagcagagggagcatggagttaccggctggcccaaagtccccagaaacctccatcaggctcttcctttctggcagggtggccttcaaaggaggactcagaacccagggaccactgcatttcccaggccctgagccccagtgtgggaatcacatcctccaaacccacagtgcccctcaaattcctattcaggtaagaaggcaaaaagtaacagccttccaagcctacgtggacccagcatcggtttttctggtttcccctgcgtcagaggtatggaggtctatgttcctaggcagctgcactcctaaaagttcagttttccatccctcccttaacactactgacataaaccccagactcagtccaggcacgggggccctgggtcgggactgctggctggatgggaggatgcaccaaggttaccctgcccctgggatgagctggggggacagcaggagacagtggagggcaaagggaaggaggaggagtggaatgaagactggagctcgcgtgtctccatgttcccccagtagaagggctcagctctggcacagaaggatgggcatgtccctgaactgctttcaagaaagctagtgctttctgcaagaggaaaaatgagcataccaatggtctattacacaaacacaatgcccaccacagagttcatgggtccaaaccaatgcagatccaaaggcaaaccaccaatgctgctccctggtcattcctaaatcatctgcttgactcagtgaagatggagtcaaaagtgaaaccacagtctcaggtgaaacctaactctggaggtagggagggagacgccccaaagcccagctcccccacctcccccaggcagagctggtgaccacttccttcagccaccgggaagtaactaacagatgcagtatcctaccaggcaccacactcacaagacggcatggctgctctcgctgggagaagcacgttcctgttcccaagagctcctccagagacatgccccagcctcttgcagcacagcctctgctcctccctggagggagagcacagcatctcaaaggagagagcatttcaacaagtcaaacactctccccagagcagagcacagcccaaggggggcaccaggaagcccagggtgcttcctgaactaatctctgagtggcagttctccccagtacctgggcacacacctggtccacacacatggactgggcacaccctgtggcgtgatgtagttccacttccctaatagaatggagggaggctgggccagacagagggtagatttgaatccaaagccaactgcaagcccactttctctccttcctctttggctggcccagctggtagctgcacctatggtgctattccagcctcattctgctatcaggacctctgtctgccagactcaagaacagtgagtagcaggaggaggaaggaggagaaaggagggaggagagaggaggaaggagggtaagagggagggagggactcgggagaagaggtggaggaggaagtttcacagtctagtgcattcccatcagatcagagagaggggaacatgtgcaacttcccttttcaagcgtttctctgccccccattttgttttggttccttcccctctggcctggggatggcgcggctagtgggctatgcaggggcaggcgcccaggtacccagccaactgggctctcgcccggctccatctcaggcctggcacgctccctcaggccgttacccagcatgcccttctccttgtcagggaggccgcgccctcttgttttcaaagttttataacagtattgtttgttgtccagcagattaaattctttggaggctggggagtggggggagggtgagtgagagagaggagggaaaagagaggagagaaaatacaaataacttctattaggcccaaaatattaaatgagttcgcttaacacaaagttcacctgtcttgagagaggctagtggccaggagcctgcgttcccttctctgtctgtgcctgacctctctgacccccttctcacctagcaagggatgtacggtctcaaacttccaataccactcctcgggtcaagctgaaaagcagtaccagctaataaggctggaagatgcatgtgtgagcaccaccctccaggcaggacacatgacatagcgttgggcaggtccctgcaagaacacccttgactctcgtctcaggcgtctggccgaaacagtccagggctattgggggaagggcatctgtaggcagctgctggagcccttgtctcagagatggcttgtccctgccgtgaaccagtggtttgtttacacttgaaatcaaagtcacatattcattgatgccaatgacactggaagaactgtaccccaaggaaataacacaactgcataaataaatattcacgtagacctaaggaataagagtgggaaatagtaatgaaaagagacaaaaagtcattataaaataagcatgatcttacggacagggcccatttcagcatcctcagcctttcaggcctgttgatgctaaatctgtaggtggtgatgacacacaaaaaatatgattttccatatttaatacaactctcatttagccattaactgatttatttcagactgtgggttaccgctaaatagtaggcctatttgaacacatccctttgcctttagtatagcaggcaatgtctgtggctcccagagttgtgggcctgccctgggatgttcctctcccacctcctaccttcttcccagcaaaccatgtctggccttgcgtcctctacacggccctcctccctccccaccataggattagagcagctcagcactctttcctggaaaagatgagggacaacatgcctttctctttttttatatgcaaataacaccagttcctataagatcagtgccagaagttctctctgcaaagggaaacaaggtcaaagttccagattcgatgaccacattggtgtaccctgcccatgcatcccctcaattgcatccagcttgggcctgtcttgaagacagatgggaaagatggagagaaatgcctgctctagatcctggcacccaaacctcatgctgttccagggactgtctcaaagtgccacagacttgggactgggaggatcctgtggaggacaccgagtctcctacctcaaataaagaggcttcatctttcctcaggaaccctcagcagaggtgatgcacagttctcccagaagtctagcccaaatcactctccttgctgcaagttctgcccactctcttttccatccttcaagtggacagaatgaactggatccaacatgacaaatcttcacacatgaagctacagaaggctttatccactaaaacaattccgctgtggattccccatcacagggtttcagtatgagccaaggatgcattcaggaaataccaaaggacagacatttagagacacatatgcatgctgcccctgtccaacctcaactgtcctaaaggaatacccccagaaaaagcctaaaccatcatggctaaatccgctgtaaataaagataaaccattatttcctccttcatacaagttctgggtctatttaaacaaaggtcactcaagagggctaactggccaagaagtcctgctgtccaatactctgccttaccagcccttataaagagtgggggattatgctctgcctttaaggaaaactgacacccacgagttctcttacccacctttctctctgtgggtaagccctactttttcaagtcaatcatgaagcagacactcagaactaaagccagtgtttctagtcccttactttacattgtacattagccaaggcttccagcaggcgctgtacattagccagcaaacaggtagcatacacacaacatgcatgctgggcaaggctcagggcatctcttacaaatgtgttggaaaaatttcaaaaaccctacactgggcctcatctctaagtgagctgcactcagcagaagcatgcctgtgtgcataggcatgaggtgccatacagatgtgtcacagtggtttgatgcatcacatattccagaagcttccaaatacaggaaacctctccaagaacacatggtgagtggctggcttcccagccaaaaagtgcaagccagttctcacaagagctccaagaagtctgaagaatcagagagttggagaacctggacatgctgaggttccgtttcccattcaacacatagaaaaggcatctctaggccctctaaggccttcagaaattaaggaaactgccaaagactccactcccctactcctgtccctgccccactagtcagaacccagagaaataacagctgaagtcagaggacctagatgggagacccacgagaagcggctacaagcagtcagatcttggcaggattgactctcaggttcagttttaccaacgacaaggataagaccacctaccctctcagggttgtgtgaggaccaaatgagccagcaagtatgaaaagaactatgtgagctgatacgatggttattactccattcctctcctgcctgagtcctagcccagatcgctgtttgctattccatactggcagtggggtggcactcagctattattaatcccaggtaaacatcccacaaagcggcaagcagatagtgtcttggagaaaggtagctattttaaaactctacattctgcttagcagattgcacaatgtgccccctcagccccaggggctcctacccacacagccttgcagaagtggtgtacgtctgggactaacgctgccatggagaagctaggccagagtcccagccactcctagcccccatctggctgggcctgggaccttcggctttcctgcatgtgttttattttgctatctttttaagagtgactcaagactaaaaagccaaaatggaaccagtggctctgagatatttttgtttattttttatttttttcattgttattttttaaaattaaatttaattttttagtcgagggcctcaaaaaatacatgaaaagagaaggctaaatataaaggaaaacttcctgacagcaaggggcacagaccctccctcaaaccacagctgcattctctctccagggtttagggccagacaggacggagcatctttcctagagcagggtcccttgggtcagccccttgcaggacagcaggcacccccagcagctcccacataaacccatctccaacaagcctcccgggggaagcgcgtagccatgtcccctaccacccggtggatcctcatcaacaccttcacgaaacctccagccctctgcttccacttctgggaggtctttaaaaactacctcctcccacccacccaccctaattccaacagtaccacttcagccgctctgagacaggtcatcaagatccctccccttctcttgtggaaacctgggcctagttttcctcatcttgaattactggctaaggaacatctccatgaacattcagggaggccccaggatacagctggaacctccaaagagattctggttccatcccctcatttcatagataatgaaactggagctgaaaggaggaaagtgagtgagtttttaccaacaagagctaggaccagaatcagggtcggctgactcaacacagagcaacacaaaccccactttcctgaccctcctcctccctgagcacccccaactacactacctcatccctgtgcaacttcagacccctggcagcagatggcagtgtgtgcagtccggcgggtcagctgtccatgatcagccaaagagccaacaatcacatggcctgactccgcaggtccgctgcctcttccaccaagtaaacaagtcccgagccctggagctacatgcgctgaacacatgacacatgcctgccctgtccccagcaccaccaacctgcctccgcctctcaagacacagctcaaccaagcatctggcacaggtcacttctctatgcctggtgcccatcccttccctatcgtgagacgattagctctgggaacggctcgttctggcaggacaggctgagttcagaaccagcctcctgcaggaacatttgaccaatggctcggcaaagacctaacctgcacgtttccctgtgctgcatggacaagtgtggggcacagtgaccaggctgaggaaagaagtcagctggtgcctgggagggtgtgaggcagaaggccaacagcaaccatggcagacaggagagaaccagtctgccggagaccaaaggcttgacatctactccaccttgatccctgactcacgacaagttcctgtaagccatggggaccttggatggatttcccaagttattaggaaaaaagagggggttagtttgtgtcagtcctaactccctgaaggaaagctcaattgatgtggcttcagatggctgaggtcctaagtctctagaaccctctgaccatcatctgaattctcctccttatgtgtgtggggggtcccccttttcatccccacacaatctccatatatgtctaccctgtacatttttaaattctttttaaaaatcattattagcggtgtctctccacactagaatgtatgccccatgaaagtggaaagttggctttgtcaagttctgtatctctagcgcctggcacagtccctggcacatagcagaggctccgtacacagcagcagacgccatgtactggccttactcagctctgcctgtccatggctaccaaagggcatttgggtctgccctgcctccccctaaaggaatgcggcacaaccgtccccagtgactggaaagttccttcgggtgtctgccttttcactctggttcacatcagtcctctgagaatcttagttcacaaaaatgtctgacttcagcccaaaagagtaaagataacgtagaggctttggaataagaagtgcatgcatttaaatctcaacaacctcacttaccaaatgcataaccttgggttaagtcacttaatctgtttctttaactataaaagggaagtgatccctatgtcatatggttgttctgaggatgaaatcagataaggagaggagagccctttaaaaaggtcagtttcccttggaccaacaactctgatgcccatctcataccttcatgcctcattatagaccctgatcggggcaccatcctaccttcagtaccaggcactcagacgcaaatccttcacaggagatgcacacatccatcctgggccatgacaggcagccctggctgagcactggacttgtcctcccacaccctcctggacttgctcctgtgatctaaccacacataccacctccccacgtggctctatctgcccccatgtccccagtccatccctgtaggcttgacactatggtaccaggctccgcacaggccatggggccctggaggtgttctctggctttatcagcccatgagcagctcttgtggaaggaaccagcaagaaagcaaactcagtccatgctttcctcacagtcactccaagtctcagaaaagcaaagcaaaatgagggcctcccacagacagccggctggtgggaaagggtggtatctcttacatatctcagagggaggtaacacgcccaaaaaaagtgaccagcacaaggtacagatcctctctaaagctgtggctgcagccttagggacactcgagccaggggacagagccaagatatgcattaaacaattcacagagctgaccggaccaggattcaatggaatagagaaggtactgaccaatcagggcccctggcagggcctctcccccacaactcccagccaagccacaccacctcagctccagagccaccaactctgttaacctctgctggatcccggatggagaggccccatgctgcctcctgactcccagacctcagaaattcaaaggtcaagaaaaaagtgccagatatgctggcccctctctcaggagataccaactgttctgctatcctcattgggaacacacaatgccccatgtcatgtgtgtagaacccaggctggtgagcaaggaggaaaagaaccagatgagggacaaaaataggaaaatcagcagggaagcaccaatcccaattctggaaacatcagaggccagagagataactgcatgaccacgagcaaaaccaacctcccctttacttcccaccctggttttcccaatctaaccaaggacagggctattcgtgggagtggggatcacgaagagccatgcccagggacacactgcacatatgagggctgagactcccaagcacagccagcagctacgtctggctccagccctacagccagggctggccagactctagccaacacttcttgagggacttggctcactccttttagtctccccagctgcacccaagtcgatatctctccactccaacaccccctgccatccctcactgcagtactgctggagggctgagacctgtcagggtccttgaaggaagagacatcagattcttccaaacagccctgggttcctcaggctgttcacagccaacctagagactcacctcaaatggacagaggagaagaagaaataacaggaagcagaattggccaatcttccctggatagcaacgggagcagcatggggaagaggaaccccccacccccaccgaaacatatgagcagagagaggcgaccactgtgtggccagaggtaggatcccataggtacctccgaaaattacccaacataattccttttatctttagagcccagaccaatctgctgttggctaattccaactggctttactggccaagaatgctgtagtcatctactcgataggagagagacttcctagtgatgtgtgggcaccgagagtctgctttgtgaattgtatcaatgatgccactgacctccctgattctgcaggccgtcatcatttttcatttttaatcaccattgctattactgtgatcggcagcaagtgaggcagaagaaaagcatttctttgtcaacttcctagagatgctttgcaatggcttactggaccagggattttgttttttaaggcaaaggtaatgaaggcctagaggaagaaagtggctcattcaaagaaaccccaaaattagggagagtcccaaagctcactgctcagcccagtccaaactccagaccaccaacctagactaagccccctcaaggcaaaatgtatctagagttaagacaggccatccactgagactacacaggggagagaatccccaggcaccaggaaggctcccaggattaccgaggggttaaacccagaacctcctgctggatgctggagccaaagagagtttctattactgtgggaggcccaaatgctctgccaactgccacacccagcaacactacccagctatctcccacacgtccgcacagcccgaccacttcagctgcccattctgcccccaaccctgtgctggttactaaccccacacagaaaagccagaaggagaagaatgcaaaaaagagaacaatcgtttgggagattctgaatggagacgtctgaggattccccggcggaataaggaaaatggtgttcgtgggaaggaaggaggatgggggaaggctggagggagcagcccacactggacttacctgggaggcagagagcggttaaatcctatttccttgctgcatccagtttccagtaagcagcctggtgatgattcactgacaagactggggtcatgtcgcatcagtcagcacttgtggtcacaaaaccacaaaaattggtggctcaacagcacctatgagaggaaagaggggaatatccaacccaccctgccctgaaccagccaacacaacatgctcacccaccaccaaaactcctccagaggacagctgagccctctctgcccaactggagccagatctccagaaaccccaaatgggtaaggatgaagagtagacacagacccaggatgccagtcactgtgtttgccctcatatatcctaaagaaaatcaaagggaggaggaagtggtggaggaaggcagggaatgcaagaggtccgaaagaaggaagagagaggtcaaaagacatccttaggcaaagcatggcaaacaggaaaccaggaagagaaagcggaggcagggctcaactgtaccctcagccatgtcacatgcccctagcttctctccctctaagctcaatatccatcgcagagctattagcccttcctggccctcatcccacatcagcaccttcatctagcacgacctttcaatctatcagcatctgcaatacaggaggaaagtaagcagccctgaaccagacagacagacacacacacacacacacacacacacacacacacacacaccccttcccagaataaaaggcccttggagatggctcatgctctctaggttctggttctctgatagaagtgctccactcccacaggggagggcagacacgtctgataagaattgcttagcacaatgctatatatagtctaggttcctaccagcctggagatgtggagctagaacttggcagagaaccatgctaggtgctggcaaggaccatcctcccactgccagccaatggggagcctcacttcccggctgggggccgtgagggcacacagggtccttccaggcagcccattaacactccacactgagggacacaggctgttggctccattttagggaaaatcaacttctcccaaatgtgagggggatgtgtgggggctgaacagcaaattctagcttctctgcagctatccagtagcatgagaaaatcaatctagtcctctcttctggaggactaagggtggggtgtgtgggagaagaatggagaaggcatagcaggtggctgggctcaataaacatctacccatttctgatgttcgaagaaataaaggaatgtaaaagaatgcagatgaatacttactgcagagagcggggctgccaggcatctcctttttttgttccaaatacatgcaagtgagccactctatccggcagtatgacggctgtctccggcacactggcaccatcctcagctgagcctgagtcgccaagaggttgtcacccactcacagagcaagctgcactctcctgagtcctctatgaggaagaagagaaaggaagataggtgggctcagctcacagagccaaccaagcaatgaatccagcagatcccaaccaggggcccatctgggttagtatgtggctctgggatgatgacccttagctgttgcccgccatccaatgaaagacgcaagacaatgttgggcaaaatgacatgggacctatgtcctggagaaaggccagtaacagaagatgcagggtctgatgaaggagggtctgtttaccacctctttcagaaaatgaacctgagagaccacagagctgcctgaagcccgaaatccaggctcttatcatatacacagcttgggacaaagaaaatgagacacgaaaggttccaacgtccatatacatacaatctttttaggtcaagctgctctctactcgggtgcaaaacatgacatgaagcggctgtgtctgcctttgcactctgagtggggatggctggctcccaccccctgccctgcttaactctctcatgtgacctcggtcacatctccctgccctgctctggctcccaaggcccaggagccactcctaccagagatcccaaatgagtcaccctgggaggtccttggagagaagaggaggtgctcagtgacaaatgtcactgctagcatcatccgcgggaaagcatgagactgaaaaatagtacccagtgaaaggagggagggggctgcggccaagttgtccctcatcctcataagcaattgtttgtccctctgccccacgctccagcagagggggtagagaagagaaaggggaggacggtttgtccgcattcagtggcagtggaggtgcatcttctctctcggtcgcaagaaggtggggtggggtggggcggggcggggcggggcggggcggggcggggcggggcgggacgggacgggacgggacgggacggggcggggcagggcggggggatcacgcgcctatagcgcaaagctgcggtatggagaaaagcctagaacccacagccgccatgatgacgcaaacaaaattaaaagggtcaagaactcaaggcccactgtttcacctaagaagaaaaggaagaagatgaaggggagaagagaagctctgatttgggtcaatatggaaaggggaggctgacgcaggctgcccaagagccagcctttagcttagtgacggtgatgcggatccgccatcttgaagcgccgcccggcagaggactctcaagacgccacagccccaccacggccacttctcccaaggtacaggtgcgcccgcattcactgaggtcggcctggcccacccctaccccaagaagcgaatcgcccttcattcaaggcaatgaccagcaagactatcacaaagagaaccacggtgaaaaatcccaaagggctttctgggccctgggaagatgtctgtcatctgggactagtgggaagaactcaaaaagtgaccctatttgccaagctcatctaataacacatacagctgttattttcttttcagactctaaaatgcaagggttcccagagccctgctgagttacctggtgtcgctcccatcctgatgcccgggcggtggccgccttctctgtccagccctccctgaaaatgaccccaggctaaggatcagctcagagccccgagctgtttttgtagctttcatgttgacagaacatcctggccactctgctgagagctccatctcccggctcccgatacactgagtcatcttccaaagaggaaaaaaaacaacaaagcagccgtcaccagggtccccattgccgtcgactgacgactcactggctgtcgtcacactctgctccgcggcccccgaattggtaacgaggggcttcagggtgcccagctcccctcccgtgggactcagcagcgtcagggaagcaggcagccactgctgagattcagaaagaagggaaactaacctggcatcaaaaggctcccaggaaagctcactgaccctccctctgccgtcaccagcccccaccactcagatgccatggcatgttcctgatgcagaagtaaaggggtatttatggcaggtgggggacagtacaccttgcaggcttgaagggcgtaacgcctaggttacctcctctgcgcccctgctgtgataccacttagggcacaggagctcctgtctcccccatttcttctctagccccctgctatgctcccattttaagtccctgataaaccactgggtagggatgggaacctatttgctgccaatatattaggcatttctgtataacagttgtagtagctccatctcactgaaaacttaaatcatatgacttgtctaaagtcactcagctaagaagaaggatcacaatgaaaacctaggtctgttcaagtccagtgtctctgctccctgctctctaattctggagcttattctggctttgaagatgctgtatcccactccacctctccctcctcttgtacgaggaaggcaaccaggataactgagtcagttaatccatcaatttcagctacaagaaaaaagccatcatcttgagtgaacctgaccacaaaggaagaggagaaagttaatgacagtgtcaaggaacagctgagggacccagaccatggacacaagattgaccacccaaactccctcagagcattagggacttacaaaattccttaaatagacaaattttggggatctacttcataacagccatcttgtaaacaccagtaattcagagaggaaaaatgtaaaggctttggaagaccagggctctagtcatgaccaggccacttactagacatgggatgctccccacagggctgtggaaaggagtaaatgaagtaactgcagggaaagtgtataacatggtatctgtcaaacagaaggcaccaaataggtatttgttttccttctcctttctctagcctccctcctggagctcccaatctgataggtgacataagacttatacacaaataatcataacacaacaaaagtaccataaaaagggacagactgtatggaagtttggctgaaagggcaggggtggttatgagaactgcttcttgccaaggaaatcaggagaggtccacggagaaagtgagactgccacaggtggatgcagaggagaagaggcatggaaaacatcactggtgaaaacagataggaaaaggaagttgcctggttttgttggaacctatggtccaccaaaagaaactgagagaggtaagactgtacaggaaacctaaggccagttacggccagcattgagcatcacgctaaagggaaggaattttactctgggaattatgagaaaccattttaagtttctgagcaagaaagacaagatggccgctgcacgcagaagggcctggagagagggggaacgggcagcggggagcctcacaagaggactacagctggaaccatggcactggcagggggcatggaggagaaagagaagaaaaacagtaagcaggcaggaccatccgaacagatcctcaaagctgccatggacctcacttccctgtccccacagggaggctgctggagacagagcctatttggggaacacaaaccacgggtctgacacgtctgagatgagctgccgagcctctgcctccactctcattcagacactcagcttttccgaactactccaagcaccaggctgatgaggacatgggaaacccacgctctggcaaagccgggcccaggtgttgaacccctacccagacgccttccacctgaatccccacccaggactgtgtccaagggtgggactaggcggctctgcccctagagccaccttcattgcggcagccaccactgtgcctgcctctgctgtgcttttgcccccccttcccctcctccgtcatagcccccgccccccgcccactctgcggaactggcacagcaggacagaaaaaccaacgccaccatgtcggagaccagcagaaatggctccaaaatggcagctcatcagaggagtccagaaagatcataaacccacccagggaaaagaggggaagccagtgacaaggggagtaaactgtcaaaactacctcccaaccaagcccccgataatcatcacatcttttccttcagaaacatcctctcaaaaatcagatgggacatgagtgaaagaagggtgccaccccctccaccagagaggccctaggggccataggtggtatggggcactcagaaggatgttctgtagcctcttccccaagatgaggctagaaaaccaccacttttgtcctcaagcttggctcctgccagtaactagacaagagttagccctcccagggattgcagtccttcactgctacccagtcagaccctccccagctctatgggccctggggagcaagaaggtagggttgcaaggaagggccgagaaggcgcgtgccatgccctcagttatgtaataagaagggcggtgctcgtcctaggccagagacccagggcgcactgcgcttccagatgcgcagtcacgggtgggggccactgcgcatggcgcagggcttggtaaaccccctccccacaaacgtgagacctgcgacaaagacaggttagagagccgggaccctgatttttcgaggcctccctcccccaaccaaaggcggacagcctgctgccctagttttattctgattctcctcattccctagactgacaaacctttctaacccggggcctccaaacctcccgtctcccactgacttttctggaaatcccaccagatgcggagtttcgagcaatttcctggggtcagtcccccatcctcacctttccaagcaccacgtagtagtagcttccagaaggtagatctttcccatactgggctcagctcacaactggctcttgagggcctctggacagccccggacgtcaatgcaaatctgttgtccccagggagtagcccagagtcagcaggaagcccagggtggtggcagtatcagcagcagcagctctgccctaccttgcccatgcgtttccaggggagccaagaattattttgccgcaacactgaggtgtggctgattggaaaattcccttttccaacaccaaactacagaataaatattttcttccaatttggtcaaccctctgcatacccatctccctagcattcttccctctaaataaaaagttttgggagccctgagctcttcctccttatagtgcgtgaaattttaaaaggcataggaagaggcttcaactgggcagtcaaaagcaggcatagacacaggagcctacgcacacccctaaagagattttagaaagctgctgggcttctccccgctcccctttaagcaagtgaaatgcaaattcagatttgataccctgccctgagccaatcaaaaaaagcttttcacctgccattggcccacccaccaatcagaggaagtgtctggagggagagccctcccctggccaatggaaggccagctcagtcacttagttaatgatgcagcagtacagggaaggccatcacatgtgaactggaagggagccaacatggagacacagagagcgcaaggtaaacaactttccaacgccaaaaggatgacatttaatctctaaatgctagcttcccttcttagctcatccttaacccctctcagctggccacagagaccccaggagcctcactacctgtccccatagagctcctaaccagatgcaacagtgactgcgtcaccattccccacttttcccaactacgcagtgacaaacctaccagctttaccccacttctcccagcccacaccccaccctggccactcggctccccaccagcctcagaatcccagggccagacctttcaataaggcaacccctgggaaaaaactgtccctctgtcttcctttcggcacttctcactcccttaccttccacataagacctgcacggacagacagatggacgctgacacccaaacaacttggagaaccagtctgtctgtccactagaaggaaatagggtaaaagctgggaggtcaggtgggaagcaggggatggttcactcctctcacctctaccctggtcaggcttgagcagctgacactagggaaaagaaattaaagtgggaaaaaaccctccctcagagaaataaatagcaaaaatcgagaaagaaggtgagaaagacagagcacccacatacacagagacagcgcccctgatcccagcaaatacatacgtgggggaagaagggggttacgccatcaagtcctgaagcccgtcggaccacccatcgccgcctgcgcagacccaaatcttggtcccgccgtaaggtgccgcagtcccgaatgttccagaatttggtcccatcaaaccctccaccgtcgccccacaacctcttgctcccacccctgccccccaccaccaccccacctcctccccacgggaaccgcccgtgccaccttgcgtgtcatctcctagcctaggctacccagaggcctctggccctgacagatctctgaacgctcagcaagtgagctggcagaacctggtgcccggtgttgctatgacttgtttcttgatttctctctctctctctgctgcagcacggctgttgctagcagacctatcgacggagcttgcttgctcgctcgctctctcactctctctctctctctctctctctctctctctctcagctctgtgacgcagatctaaattctccagtctgctccttgtgttgcaagagcagaactgcagcttttcccctggagagccggagggcagtgccaaggctggtcaaacaaggcaaaaaaagttgggcctacactctgcttccttggccacacttttcagctcacaccctcccacctcacccctcctgcacctcactgctctggggcatagaggtccctgtcctttcaggctcactccttccctgaggccttctcaggcataagagtagcttaactctttgagtggcagcccccagtgcccagacagggctgccctgtactaaatgttgcaacatgttttcttgagccatatgggcttctccagccctgagaaaaaatgttcctcaccctgaccgctgtcccattaactctttgtgccacagacaagtccaggattacagtcatagctgatttctgttgttttttgcctttttggccaaaaaccaggacctttttctccctggaatttcttaaggacaaaaagcgtaattaaaacattgcctgcctaccccacaaatgagatccttctatcagggcaggaatttgaaaaaccaaattgaactgcagcctgaagaatccagagtaaaaccagtctggatatccatccttcctgggctcaaaattttagggcctaggtaaatacgttcaattacttttcaagtaattggccacacagtctcagagatttgggttgctgagtcatttgttcccaagaagatctgacaacatgaaaaacagcaaaacagagcaacagccaagcctggacctgaagtggccaatgactgggttctcctctccagcatgggcagtcaagcaagatgagcatccacgagccgacccccaacccctccacaatgttcatgcatggatgtccacactcctggaaactcttccaggaaggggtggtccaccaatgatctagagatggagtggggttgtttttggatactcacaggtctccactacagcaagcaaagagcccccaacattttcctgcccctccccccagacgcaaaaatgcttccaagaacaactgagatactaaatcactagaccctacatacccagatagaccaagggagtgttgggttcccacactgctacatccaaagaatgcagaaaggttcccgacaaccagttgtaccatatgagcctagacttgaccagaagtgagtgagatattcaggtcctgggtcaggtaacttatgaagtctatgacatcaagaaccttgcaacttccaggaagatgaatgagaatgcgaggccaggcagctaccttatcccatatctgcttcccaggcagccttcttcaagcaactactctgggccaaagtttcatccggcagaaagaaggaccacttggaagacaagcatggcactacacagttttaaaagaagaccagagtatctgtgccaggctcccagcaggggggaaagtgcttcaaattcacaccttctgggctccaaggttgagcatgccaataaagaagttacctactggtctgatgaccaaaggaacgtggccttgatggcactaaagcaagtcccccagaaaggtcctctggttacttaaatcccatttgccgtagtttccttctccatggaagaaaaacatgcctaagttcatgtcaggacattcctgatttatccaagagcccaggatcaaataaacaaagggctctgagctctgccagggagcctcctccttcaggaggcagaactagagggaagtaggcttggtacagagctggcccatcaccccatgaacttggtgagtgacgtggctgctcactgccatggcgatggggatgttacgggtgggtggaagtgagagaagaggcaaataagtcatgagagacgaagcgaaagcgaggcagggtcacaggaggaacctacaaagccacagaatttgtacagaggccgactgtagtctatgaccgcagcaaaactaagctgagtccctgcaaagataagtccccatctcaggggtgcggcatgaaccaactatgactcgcaaaaacctatgacaacactacgttcagcaaggctttgtttcctttcattttccctctaaatcttttccttcccatgaccccgttggtacggctttgatgactggaagaacactagggttttcggttttgctccggtttgaataaaatgacacagacatacatggagtggttttaaagagtggagaatttaataggcaagaaagaaggaagaggcttttcctgtacagagacagaggggggctttaagccgaaagagggaaccttgagtgcggtggaaaacagccagttatatgaggaggctggaggaggcaggattaaaacagtcattttaggtacctctgcccaattctaggtcttccttctattaacctgattctacaaggcaccaagaacaaaaaaacccgaatgggatgaccaggaagcagaaatgaattcagttccaaaaacatgggaggatgtttacttagcaagcacgctcgagcctacaaggaagcagttttacagggtgctgcatgcagtgtttgatttcagggggtaaagataacttcagagtggggaaaaggtgctggctccttctactcaccctcagaggcttggggaggccaggccagcacaaacttgaaaaggcaaggcttcagctcaagcccaacaggttgccggctctctttggctcctcggcagctaccggactcaggaactaaacaaactctccagacttcatgagcattccgtggcctccgactgatctgggtcaaaacttcgaaatgccaaagacaaagaatttttttctttaaaggggaatgagctgaactttgacccgcccttgttcagggtgtggaatgcaagcactgtgtaccggccacaaactccagttcggcaggcaacagccagaaaagcagtcttcatgccggcttcatgccggcctccctgtcctgtttcctctttagggccaactcgacggggtctaggtctttacctcgctctccagacagggaagctgtgcagaggacacattccaatctctgttatctagagctagagtggatgttctagataaatctggcagcgatctggtctcaggtggaactgacaggcccagtccacagcaagatggcatttctgttcactccctgggagctggtggacaacaggcgcttggttaccacctgaggtaaatcatttattaagtacctactaagtgctaagccaagatacagcacaggaaaagcatcagaaacagtccatcatggagaacacacacattccagctgaggctaagtattcccaaatttgcattgctgatatttaaaacatctgcttactttaaaagctgagatccacttttgcaatgaaataatatcaaacatactgcttggttcccaggctagctcacaaaagcccattttatccactccaggaagtcatcaactccagtgtcttcaggggccatgcaggtaatgaaggagtacagtggcctggggaggggatgtgcccagtggaaggaccgtgccactcctgatgggccaccctcctggctctgcctgctggggaccatctgggaacagagacccaaagagtccagatcatccaggttttcagggcaaggcggaaaactagctttatgttaaactcctgattttttttttaacactgtccagatattttaatggtcagaacatacctatagagcttccagtttgttctcctggttgtaatgtgtctaaaatacaatacgtttgtaataaaaaaaaaaaaaaaaaagagcaagcattgccagagtgaggaattaaataaaataaagaacatacccaaagaggaaaactttacctcacacatctgccatttgaggaaaataataagcatagaggaaaatgaggaaaatttaaaacttccctgagggctgcaggtggagaggtgtatcgaaatgacttccaagtatacgtgatttaactgaagtagtaataatatgtgtgcatcctgacctgccagctaggcagaaaagtcatgctgatatactggctctgtctcccagttgagagcgcttctctggacatccacaaaacgtccatccagggctttggtgataagattggaagggcttatcataatccagctgcccattcaagacacagtaccctccacaaacaccaccgtgaccaagtcatggtctagccccaacttgattcaataactcccaccacacctttggagggttcagacaagtggaacacaactgagatgaaatctctctgcagggaaatattagccttcaggtctccactctgcctctggagccccagagaacaagcctactcccccaaagacttggagacactttaggatggtttttacaaccagaagtttttaggctaaacaagaaggtacaaaaagggaaattaaaaaggaagggcggggggaagaagccagagagaaatattctcgaaataactgatcaaaagttaacaagccaaaggaaaagaggaagagacacaggcattcatgagacaggagcctcttgtggccaaaccaatagcaagtgaagaagcacatgggaaaggaagggcccacagtccatacacaaaagaaaatgccaagagccaccagatcagacagttcccaaggccagccaccaggctgtgccagtgatccaggacatactggttagaaccttgcactgggagaagaaaactgcatacaactcacaattgttcagtatggaacttttttctgtccagggggaagggtttcttttactgatggatttgttggagttatttatatattctggatatgaatccacttgccaggtataggtactgagtatatcttctcctctctgcttggcttcactctcttttattgatgtcatttgataatcagaagctcctcattttaatgacatccaacttatcagtcttctcccttagagttagtgctttctgtgtcttctttaagaaatgtatggctaccccaaagttataaagatattctatgctatcttgtagatgaagttttgttttaattttcacatttagattgatgatcgctttggaatttatttttgtatatgatcaagattcatttctttcctgtggatatccagttgaaccagcactgtttattaaaataaccatccattccccactgcccagcagtgccttcttcatcataaatcaggtgtccagatacatataggtctgtttctgagctccctgttccatttctttggtagaaataagacaaacaaataggtctgctattacggtgtagatcactaattgtaaatctggtcattttaacatgtttacaagtaaggtttaggaaaatacactgaggggccaattgtgagaagccagcttgatgtggacatgcatagtctgagaagagaactccagcctgggcttctgagaatgaataggatgagcaagaactggtaaagaaatagcatcactagctaaggaaggggacagcaagaagaaaagcacagaaaaataaaaatcagccttatttttttgtggagagcaacatagtgattaagagtacagactcacacagtttaggagacagcttgcatccaaatcccctaatactatttagctgtgtcaccttgggcaagttaccttggcctttctggcctcagtttcctaatcagcaaaatgggggtaatcttcctcattgagctataagattaaatgggttaactaatgcatatcttttagtacagagcttaccactgcaagcattcattcaaaaaatgctgtgtgctatcatcatcatcattagtgacaccatggagaacagctggactgtcagagcaatcttgccattcaaccaacatttatagagtacttaactaccaaacaaaaatattacatttagtggttaaaaactctaactctaaaatgagatagatttgaatctgaattctagtgcagcctcttgactaattatataaacttgaacaacttacttaacctttctaagtttctagtttcagcttcatctatacttcattgggattttcttggagaggatgtgagatacagaagtaatgcagcacaaggcccaacacagaataagtgctcaattaatcccagctatcactatgatgatgagaatgacaacaatggtgacataaagattttgcatttggtataagaaaaagcctaccaacacctcaaaagacttagaatacctagcattctcagatcttccatccaagtactaaccagacacaaccatacctagcttcatattgacgagataagtagacaagatcaagtgtgttcaagtggtaggcccaagacagataaggagcttagagaaaaaaaggttgcagaagccaagtaaaagctaaattactgggatagttcaacacctggtaaggaagagatgaatttctaacatcaagcaacttcaagaagaaacaaaaatacagaaatctaagtatatataatcacaaaaagtatgagaatgtgctcgatgttggggtggggacagaaatggtactcatagagtagaagtctgatggcattcatggggaaaaggctcctaaggagcagtgccattaatagttgcagaccaacagcagtgatcatggtgtggtcagacctcagccatgaagaccacactgtgccagtctcctggaggaactaccccagagccactgaggagctttcccccaacccaagagaccatgacacttccacccatgtcactgagctgaagcgaaacaaggcccagcagtgacaacgaacactccaaggacacaatgcagtgccaggtgccaagtgaaaatccgagaggcaagggctggggacagcctgtgctggagggtaggttctggcagaggtgaaatgcagacacacactcagaatgccgccacagacagggagccggagccaggcggcagagagtgagtgacctggcagacgctggccaagaacacagggctccccgaccctcagggtaaaggaagacaagcaaaggccaagttgagtgctgaattcacagcacaaatggaagtgaaccccagcaccaacagggactcccgtgtgaaatacgcccaagggctgcacagagaggggcatgtttgcatgggggaaggtcaggcctgcaacagcagatattgtgactaggatgctctgtttgtaagtagatgctttttcctggacagacacagtcagtctgtctctcaggccagaaatccaggctccaaaatgtcctgcccaagctggctcccatcacctcttgggaaagtgaaacaggccaaaacatctatcttgtcttaggccgctaatcattaaatctaagctcccaccccagagggctcacaactcagccataagcaaaacccagactggcaatagcactggcacctgctatcctgactatgggctggggctgagtgaatgtggccactctgctaaccactggtcacagctcctgctgcctaaaatacaggaggacaaagtcttcttgggactgagggagtaacccaatgtgcctcttggctggctgctcaaaatcttggccctgccaatggatggaaataatttccagagagacagagtgtggttgggccatgtgagagggacttgaggagaacattactccattcctcaacagcggaacctgtagcctgtgccaggccagacatggccgggattgaggggtcttggccagactccctccaggcacaggttggtgccctcagacgctgctgctgctcttgtgggcaggaggagatgtctctagggtaggaagaacctaggcctctgatgatttatgggtctgtgctgacctctgtgtgaccacatgggtttagcaccatgtgacttaaaaatggagtcgctttcctgcctcacaacaaacttctgctctacttaactgagtcagatctagacagcaggaatcataaacacaagtggggcaggggattccccaaacacttctgacttgaactttcatttccatactgccttatcccccaagcaggggcacgtccgtacctgcagcctaggacagaggagaaaagagaccagggccattatgcatggcctgggtgcaggtccgagctttcagcaaagtgccagctttgccaggagcagggacaaaacttccagggccgagactctcattcaggggtgggagaggagctggggactgtctaaaacataacagttaatatttgggatacgttttcatattgttttcataatgtgaaaccataccaaaagtaaagttccacaaaacctttgatgatgtgaatacttcctctgcactgggaggggatgttgaccagaatctttgggggtgggaggcagtcctgtggttgatttatttactgaaggtaggtgttggaattacactcttttagagggttcagctctctgaaaccccctgggaccactggacagccattattctcaggctaggatttgacataggcctccgaggccaatgttctttctccaaaagcagcacagcaacaacagctctgccttaaaagacagaagattacacttagaagatttctccaacgccacatactttggaggtgagaggagtaccccatcactctccctctgaaaacttcaaaaccttcagaggccagggtgaatatttagaaagcaggcgggtccaacagaaagaacggccattgatctattccaaaaaaataatgtgtttggggcccatgtgtcaggtacagcgcgaggcactttttaaggagctccacccttggctggcaggaactccctcggtcagcagaggctggtaaactaagaaagcaagatgctaggaggacagctggctccttaatcccaccctggccccccaaacaagacagctcaagtcttgccggccctggaggcccaggcacttggacatcacttgctctatgcctttcttgggaggcagagcttagtgggggttgaggagagatctacaggctgagtgcgctcatgacacaatcaagaagtttctggggccaggtgcggtggctcacgcctgtaattccagcactttgggaggccaaaagaagccaaggcgggcaaatcacttgaggccaggagtttaagaccagcctggctgacatggtgaaaccccatctctactaaaattacaaaagttatctgagcatggtggcacatgcctgtaatcccagctacttgggaggttgagtcatgagaatcgcttgagcctgggaggtggaggttgcagtgagccaagattgtgccattgtactccagcctgggtaacagagcgagactctgtctcaaaaaatatatatataagtttctgggtaggctgacatgaaaaaattaccactggagcttctgagagccctaaatcaccataagggtagaggaaggaagacaggaggaactgagatgctgagataagctgggatgtcccagcccacttccctagagaggccctttcctaacagccagcgggagaaccctgttcacggagccctatcactgacctcgagggcagcaccagcatccacagtcaggtcatcccgagagtcgtaaccactgttcctgccccaaacccaatgaccctctcaaccccatccaaatagcccaggatgagccacaagacagggccttagaaccctgggggtgtaagacaccctgaatgtcatctggcctcaccttccactgagacaagaagattccgccttgggttagagtccaaggtgtgggatcttgggtgagttattccatgtcttgcctaaattctctcatctataaagtagggctgataagctcatcatacctcttcacagtgttgctgtgaagattagagtctatttgagtaaagcactcagcaacagtgcctggtacccaacaagtattcagtaaggaaagttatggctactgttttcattattagcacccctgcatggtggacattcgctcatgtgtaaacactacagggcccacggaaggagctggagacctgacagggtcacccatcttctctccctcacatccttcacagcccataaagcaagacaggaatccagctcccaacaccaacgtctgcctccctgtcacagctacccactggccccagggctgccccctgaggtaccacagggtaactctgacacccacatcacctgacagtgctttaagcacacaatactgtacctagcaaaccccctctcaccaaaatctctacctctctgggccacgcagtctcatgtttttaaccactcttcacgtgccagcagctctgctctgtacttcaactagtagtttgacattttccctcctaattgagatcaggaactggagcggccctccaaaagtggcctgagaaggccaaagggcagccggctctgatctcccagagaaccttcttcctcccttaggagtcctcactccctgtcttgcttaatcttcccctgcccctcaactcccaacccagccctcccatacacacaataattaaaaccttgctatgtgccttcttcagaccctctcagtcttgagcttaggaatctgccaataagcctttgttgaattatttctgtatgacacacactaagccatttcacatatattatctccattaatctgctcaatttcccttagctgggaatcaatcccaatgctcacctgctcctttttcgagagttagctggatagattctttccacgtggccaaactccagcaaggagaaggtgctttgatactcttgatgttggacaagagtctgagacccatggactctactagactaagcaatatgtctacctgtatccttcactctttcccagatgagatagacagcaatcctgcaggccccacgtttgccatgattgttcttccttctccagatgccaacagtttaaccccttgttacaatttagagccaagataataggctgtcatgtctcatgtcacacgtggctcatctgtagcctccaattagagtctgaacttttcaaagaaagggtccaggcaagcttcaaaattcttttttcattcttgccaaagcgatacttctagcagcactcaatcaatacttgctgattgcctgattggactagattaggcctgtcaacatgacaacccctaaatccccaacaaacacactggaaatgggctcacttgatgtgaatcccttccctgcccacccacacaggtcctctgaggtttctcctactctctccttcctttgatctaaatgtatcaaacaagaatgtgctcttctaactgcagcttctggaaagggtccccaagcaaatatcaaagggacactcaacctgtagtgtcacaaacaccagcaatcacctcacccctctgcctgacggatgccaaggacagctggctctggactaaaaacagtgcaaccccaaatctgagccctggggatcttttatgtgttttccttttccctgtgaccccatgtgaggctgagaacaaaggagacagaaatcagctgtcctcatcacacaggtgggaaggccactgtcagacccaccctctcccagggaatcaaagaccagagactctaatggttccccatggctaccaactgtaaatttcaactaagagtagaaagtggccttacctgatacggtaacagaagaagaaaggaaaggagcagaggagtgccacccagggccctaggaggtaggtggagaggtggagctttgcatgccttcaagtgcctcctgcggtgggctaaaactcttactgttattaagaacatacagcaaccaaggaaaagagggggacaaaccctctactttatggcctagatccaggcatttcacagattctgatgcgctccagacagaagctcagggtccttttgagacatgaagagtcttgactgcacaagagaagaccaaaagttctttggagatggttctaggtccccactttagttaattaacaagcttttaccaagtacctcctaattcttctaagtacttccaacacctacgacacagccaggcacacagtgtggatgctgctactgaatccaggacaggagggaaaagagaatcaaaattaaatataagatacggttcataaccaaaggcgttcctgaaatagcttccagagctaacatgatttgggaacagttataaaacagcctcactgctaggaagcttctcgtgggcctggactgcgtcttacagccctttaagccaccacatggtgcacatccatgtccagtaaccatccactgggcaaacaggccgatgaacacaggaaggaaacacagcacaacttccgtgaggcctacttctaaacattcgaaataccaagtttacccctcatttttggaatcatacaatgctgagatacaactgactggccacttcctgcctacctgtaggctatccccagagtcgtcatgtatcacctttgtataagaaatgtgtcccagcaagccaatctcaacatttaacctccttcccacacccatcccaacacttggctcccccatctcctttttctctctcatatgcagaaccaagtaacaagttaaaaaatggcaggaactctttctgagtaaactttgctccttggccaagatgataaagctgagcttcaccgtggaatgcgtccctcctcccggtgattggtaacctgctcaggcacagaatggaagctggccagctgacctccaggactcagccatctccctggggcctgcagaaggaccagggacagaggctacctccctgcagcccttgttgggccccacggccctgaccaccaccgacccccactttgggagatgaggaatagaactagattctccatctggctgagagcccgtttacagggctctggcttcctcccaaggctgccctcagtcccaccagacctctatgttctccttgtccccctctgggagatccttcaaataaggccaaggcccccaattagcatgccccttgccttttatctgcccaagcagcatcctcctcatcacgaacatcaacttccacattccacaaacctgccacgttgtcaggcctggtggttggccccgtgctgcctcaaagctcattcagcattccacgacagcgggacgaagctggcactgttatcacctctactccacggataggaactggggagcctatacgaggaggcacagctggtaactagactcagagccctgtctcttaaccgctgtgctgtacatgtggatgacatcccttctcctctgatgagacctcctcctaatgcctgtccttggcagatgaactactctctattgtcatacttgaccatctctggcataaaaggtggggctaaccaggtttccttagggaaaaaaaaaaaggcccaatacacgtgacttttttgtacataagtattttttaaacaagtttttactactgactcattgaaatgaggtgaaatgtatggttaaccccttccagtttacaaagtgcttttgtaacaaattaacttcattccccatcaaagcctagtgaagtacatgcaattattcccattttacggaggagaacatgaggaaagctaggagactcatccaggatcacttagccaataagcagcagagcaacaaattgaacccaggactcccaaaggctaaatcctgacttttgggtacctagccattgagagaaaacacagcattggcattcagagtgggagcgtgggagtcacaaagactcacactggctgtgtgacctgaggcaagttaattaacatcatcttgtatcactaaagcagtgctactaacaagcgtgacacatggttactgtggggattaaataagataatgtatgcaaagtacttagcatgatgcccaacacatagtaaacacccaataaatggccgtgatttttattactctccactgtccaggcagcgactataacatctccttaactctctgtgtgcctattatagtggacatgagatacaaaactgtatgtagtaggtacttaatacaggttgactaggagcaacttcctgatatcccagccactgtacctcacaaacagctgtaggcaagaataacaggacaaagccaagctcccaaccacagcaactagaaggaagcagtgtccacccctgaggaacacattccaggactcaaaagaaagacagaagaaggctcggagctgcagtctctagacacgaataaaatggccgccagcccgtgccctgtgccagcctgagcacagctgtggctcccaagggcaggggtctgtgttttctccacatcctgcatcaaccaccactccttcccagggctctgggtctctgctcccggggcttgggaacatgcatgtccttggtgagaagaccacataaaagggcatggcctacttccaggagcctccctgattcccacttcgagataaaaataataaacacacacacatacagagggcggagagtgaggggggaattaagtggtgtagaagctaaggcacaaggatttacaaagcacagggctgcggtaacctggcaacctacgaaaggtgtgtcagaatgagtaggatgcaaatagacaagcaccagggctgggaacagtcagggctggacgggggaaggtcacaacgtgctggcctggttccttgtggcgctgagctgaggagggagggggagaacagcagataggacgctgctgcccacgcagcttgtgactcccagctgtgtgttcccaacaggctcccaactggccactctgctagcttcaggctctcttctccaatcctgtctagatattgccatcagtatcttctctgaaattctgaaccatcatatgcctcccctgctctaaagctgctcatggctccccagcacctagcctcagcatcctgtggcatgtggttccaatctaccccttcaacctcaggattcactatcctcccacgtcctgtaccttctgatcctgcctcactgccccttccatatgcctcttttctatgggcttctgcatatggtgagtcctccctctcagctcagtctaaatccagaggtcacagctatttcaacacatattttctaaatacctaccatgtactaggcactgggctgggcactgagactacagaaatacttaaaatatatcctgcccacaatgagcttgtggtcatagggcaactcaaacaagccaatgtgaaagtaataacaggaacagcagatacagagcacttcctatcagcaagaccctcttttcagccttttacatgctcactttcattctttaaataaccctatcaggtaagtatgattattatcagccccattttatagatgaggaaactgaagcatagcaaaggtcaagtaaaacttactcagaatcaccctaagtaagtgataggcttcgacggagagtgagcatctctgggagtgggtgctgcggtccagcagggcagtcagaggtggccacagccatggatgaagccaaatccaggatggccatggccaaggcaccttctctctatttccccaagaggccatcctggaagctaacgcttcctagatggaagatgtacttaaagcaggaggtaaatcccagaactctgggaggccaaggtgggcggatgacctgaggtcaggagttcaagaccagcctgaccaacatggtgaaaccctgtctctactaaaaatacaaaaattagctgggcatggtggcgggcgcctgtaatcccagctacttgggaggctgaggcaggagaatcgcttgaacccgggaggcagaggttgcagcgagcctacatcatgccactgtactccagcctgggtgacagagcgagactctgtctcaaacaacaacaacaacaacaacaacaaaacatcacccaaggctgccctctctccttctaagaaagagacaagcagaaggggagacgtacatgagcaacagccaagtgtcacagtgtgaggggatggaaactcaaattcacagcagatccactcaacatctatctttcccccaggccacgtagtcggaggacttaattctatattattaagggctcagcagctccaccgtcctgcctctagcgcaagctgaggaagggacctctgaggtgtttggaatggtttcttctttctgtccctgcatggctgtgtcggcatggctagaagattccatgcatccctgacagcccaggatgcctctatgtccgtgccaggcaagtcttcactataccacgggggaacaggagcaggatgctggcacattcacatcgcaagagggcacggggcactgtgacccagtctctagacaggggcatctccacctagtgctgttcccccttcccactgtgggcatcgggatattgtacagcttcagggtcaggcacagcaatatggctcagaggagctcactgtcccttcagtccgacccaagggccttttctcttcatctcacagtagaaattctatactacccagggagtccctgggccccacagaggccaccaggggcagcctccagccaggctgcagttccaccactgaccaagcagaagggattcattcctcctcctcttgttccagcaacactgtgctgctcttcctgaaaactggctggaatataagctccatgaggacaagaacttctgcctgttttataaactacagaattcccagtacctagaatggtgcctggaatatagcaggcacccaataaatacctgtggaatagatgcattatcatttctaccttataaataagaagaattaagtatatttcctatagacataaagctagtatatggcagaactaaaattcaaatccaggacttcctgggaacaaaataaaccatattgtacaatcacctaacactactatttactgagtactgacctggcaaaatatgtgggaggacaaggaagataatccccatgattaaaaacttgtattgtctgagcaagagcatgtgagcaaataaaaatttttttaaaaaaatctttattagggatttattatgtaccaggaaatgggggacatacagacatggtctctctttaaaggatgtgtgtgtatgcatgtgtggcgtatacatacatatacatacatacacatatatgtaaatatataagtatatgctaatttatacacaatatatgtaaatattatatgtgttataaattttttaagcccatcactaggcagtataggggagcccaatgattgaaatagctaataaatatgtataacaggaacagaaaggggcagaagtcactgcaggcagatgctccacgaaggagatggaagctgagggaggctctgaagaatgtaaagccttccatgagaatgaaggagcaaaggcaacccaaggggcaggagtgcatatgcagcagaaccctgcaggctctgggaggaattcatagagaagtctgactgccctaaggttgtttcccctttttccattttttggaaaatatacacttctgcttttaactgttccacattctgtacctatccttaataccttgcttgaagaaagtgttccactgcaataaaaaaaatatatatatatatatttatttatttatttatttggaaactactgctcaaattcaagcttgttctcctacatatgggaaactggagtagcccagggtcccagagctagctcacagcagaactaggggaaagactgtaggcctccgggcttcccatgagcagactgggagacactattaaatttcccggggtgtagcaggagagcagagaaggcaggctgctgtggagactgggcattatggtgagccaggcctcagcatcctgactgaaacgaggggacctcaaggcccttctcagcaatatatgcctaagaccaggttgtaacctgggaccttcgggcccctgcagctgaggtctcccctcctgctggagagaccgcagggttttttctgctgcaagtcatgagttgcttgttggttttttttcctgcttggcttgttttgacacgaggaagaggctaataatcctcctggcaaacctaggtaaaacaacagggccacagccccctctctgaagcagcaggggcagctggctctgacagggagaaactggatctaggagtgtgattggtcagcagctgacctctctgctctggcctctggtggctcctacacatcccactggagctgtttccctaagaatgcagactctggagcaggaccggtgcaatttctgtctctgcttattactagctgagtgatctcaggaaagatattatagctctctgtgactcagtttcctcatctgtcaaatataacagttatctcagagttactgtgaggtttaaatgagtgaatacatagaaaacagaacagcacctaggacacactaaacacttaataaagttagcatcatcactacattattgcttatacataaggctccctgaaaccttgtctcttagatgctaagaccagactaagctgaatgctaaggtaacctattgtggaacataggtaaatagtggtgtcagagatctgacaggcacaagcccagagactcaaagcttccttcagggtcccggattcccttttagcactcagagctgtaggctggtagggtgacacctcacgcttcctagctctggcagggacaccccattattcagaagcacgtagggtctctggcctctccaaccccatgctctctgccttcgttctggcactggtgggtggcatccgactggttccctgtatagaatactcatgctccacgtgcttgcatccttcatttacatcctgtaggaatactctaggcaatccctagaagataaatagcttctagggatcctgaatttgggggagttagctggatattatctttcaaaaccatttctgaggatttccttgagatctggggccaaccttgtgggtgtacctaagaagttaccaagccgctttttcagaagtgcgtatgcatgagagtacagacttttgcctggccccagagcagagcattgggagcccagcagttgtgtaggaagctgcagagagtaagatgggagcagacgaggcatccactttctcagttttcagcccaatatctgtggaaaggaaggtctctaaaactcaggtaagtctaggtacagcccaggcttaactcttacttcttaatctcacctttttgtctttctatcccagcatctagtgttaagcagggctctcagctgcagcccagtgaatactggttaaattgactagaggctcttgatttttcagcatgtgactgagaaatcgccacactcatatttgagcaagtgcatctgtcacatgcaaccaggtctttacaactaccactgtccatgttacaatattctaccatacatacagggcaataagcttgcctggggattttttggtgtccagtaattttaagtaggagttacattagatgtagtgtttagatgtagattacttaagcttcccaactgccaactcttgatcaactttaaagggaaagaaataaaagaagtgccgaccctgcctcccacgtcccccgcaagtccactgcctcatcattctggtctccttttgtgccctgtaccctcccattctttccaccaagctccttttctcaacgctttctcacttgtggtgtccttctctctcctcttcatagtgcagagtccaactgtatttcaagtccacactcaagttcaagacttccacttccacgaggccttagaatgatttgtgctgatgaatctttacgtctgcctcacacgtgttgctagtcctagtgccttgcctactgcctagcacttaatggctctggctgtactgggtacatttcccctgatctcgtgttctggcctgtaccactgtcctgagaccacctttcctgcatctgtcatgactctggtcccacctgtgctagacccaggcccctgctcctattgttcaaccccgtccctgggagcaccttcacaccactgtctttaccccctacccatgaaggcgattccaacctttagtcctgagacatccaggaatacctgttggacagcccacttgggtgtcccactatcacctcccgttcaacataactaaaattcattcaactattacctgttgagttacttttaaagccaggatctgttctagtcactggtgagcaagccatgtaaaagtcctcaccccaagggttcatcaatggatgaagcgatgaacaaaatacagtggaatactattcatccttgagagggaggaaattctgacacatgctacaacacagatgaaccttgaggacattatgctaagtggaataaaccagtcccaaaaagacaaatactatataattccacttacatgcagttttaagagtagccaaattcataaagacagaaaatagaatggtggttgccaggggctgtggggagaagaaaaggcagttgaatgggcacagagttcagttacgtaagatgaatagagtcctggagacagatggtggtgagggttgcacaacaccacgaaggaacttaatacaactgaattgtacaattacaaatgggtaagatgatgaattttatgctatgtgtttttttagcacaataaaaaaatgttaagtccttgccttctatgcacttttctgtatgttatgcttcaattaaaatgaaaaagattttgtcatcatggaatttatattctagagtcagtatctcagtcatcatccaagcagtttccttcaaattcccatcacctgtaccgccagtctccaggcctgtgcagtcctcctggaattcctccttttgccccatatccaagtgctctccatcattcctctctaaggcttgcacctcagtgcttcctccttccgagaaccacaattcccatcacctcttcatttttgatagaaaagacgaggaagtgggaaaaactctacagggcctgattccagcgttggctctaccacttgctcaataacctctcatttaaactttgatttcctcactcaccaaatgaagagtttgacaagacattcatgaaggctccttctggctccgtaccaggataagtctccggttcaccctccccagcctgccctgaggtctggtgtattcctctcaggcactctgagcagcctgagaagaaaggcctcattcaggaggggagcccagcccgggcgacagctccctccaggagctccttggctctctcgccagccagcctgaacttttactgcttgtaaccttgtgactttggattacctgaccttgaatcctgccagccctgcactcctgctgggacctcttctgacctgactgcctgtaactgggacagcctcgcctgctgacactggaccctattctgctactacaaactgggctgccttgtggctgtacaaccaggatgctgctagccaaactgtgaattctccctgggccatgacca

SEQ ID NO: 12089 - DNA, 37692 bp, Human
  misc_feature (1)...(37692): n = A,T,C or G
gcttaaacgatcctcccaccttggcctcccaaagggttgggattacaggtgtgagccactgcacctggcctcaacaaatacctgttgatctcacacaaactgaattgcatgaacagatcatattccaaggctccaggagacattaggaaaggatccaaactaaccagatgctatttaaaagttacaaaaaaaaaattcctgttgaaagttttaaaaaatactaattgcacaaaaggacaggggaaatagttgacagtggttcacctaaaaaagcacccttgacctttttttttttttttttgtgagtgaggtggttgcagatttctatgaaaaagaagttaattcttcagctccttaatggaaccctggatctcccagctatgcaggaggttatgctagaagtagaacaaagcggaatgtacaaatttaaggaaggttactgccctgtgttcttttgcatgggtctgtatctagcattgggagccaggttttgttgttgcttattgggagagataagaatggtatatacacaaataactaaaaaaaaaatacgtggtaaatgctaaaagacaggtgcaaagaacactgagatggagctttcttgggttacacagccagttttaatgtttcctaatatagaagagctttcaacaaacctctcaggcaggctgtcttcaaatgacattacttcccccaaatacctaatttcatttatttcagaacaactctaaatgttagaggattttctgagcttaaaaatactgccttgtaatttctattggttttagttctgcactttggagaagagaataaggctccgttatttccaatattatactattcagttatttgaagacagcttccaatttctatgctcaaccctttccctctttttttttttttttttttttgagatgcagtttcgctcttgtcgcccaggctggagtgcaatggcgctatctcggctcactgcaacctccgccacccgggttcaaacgattctcctgcctcggcctcctaagtagctgggattacaggtgaccgccaccatgccccgctaattttttgtatttttagtagaaacgggggtttcgccatgttgggcaggatggtctcgaactgctgacctcaggtgatccgcccgcctcggcctcccaaagtgcgctgggattacaggggagagccactgcgcccggcctccctcgtttatatgcaggttaaaaactcccttgagccttcaactatttctttttcttttttttttttttttttgaggagtttcgctcttgttgcccaggctggaatggcgctatctcggctcactgcaacctccgcctcccaagttcaaacgattctcctgagtagctgggattacaggcatgcgccaccacacccgactaattttgtatttttagtagaaacagggtttcaccatattggtcagactggtctcgaactcctgacctcaggtgatccgcctgccttaggcctcccaaagtgctgggattacaggcgtgagccacagcggctggtgctttcaactatttatttgacatggcttcaagcttccttgccaccctagtgccgccatcgctccgtttcccttccctaccacccttggggagtaagggtgaggactggggaatggcagaggaagcgtagtttttccgaagagctgaaggcagcctgtgattatgaccttagctcttcctcttctctgttttctgatctcctaatacacgtctgtaaatatcacaagaccctgcaagtccctcacttattatctcttcaaatctgacgactttcaaccgttcgggccccacgactctctccccggactaggatctactctatggtagtgagctcagcctttctagctctctagtcctcccattgctccatctatggtttccggaggcctcaccggaagccctcgtgtgaggccgtgtgggaggccggaagttgcggcttcattactcgccatttcaaaatgctgccgaggccctaggatctgtgactgccacccctccccccacccgggctcggcgggggagcgactcatggagctgccgtaaggtgtggctcttggccttcgtcggcggggtgccgggagcgggagctggagagtgaggagcaggcggccgtaccgccagttgtgcgggtagcgggcgggaggagcttgagaggtgggtcgggcggcgtggggaaggccgcgccaggcggaagaagggctcggggggaggggaagagttgtgggatgagggctcgcggaagataaaagtggaggtggggtgacgtgaagtaactttggccaacaggtgacaaacctaaagtcgacgtagttggattgagtttaactggacacaacatttgaggactgttgaggcaatttggagaaaggaggtgggagagagggaaccgggtagaatgacattgacgtgtcttaagtttttaagttagtttttaggtctgcggacagtctaccttagaggcacttgagtgcttgtttgaaaatgcttgttttggcttggcgcggtggctcacgcctgtaatcccagcacttcaggaggccgaggtgggtggatctacctgaggacaggagttcgagaccaacctggccaacctggtgaaaccccgtctctactaaaaatacaaaaatattagatgtgtgtggtggcgcgtgcctgtaatcctagctactcgggaggctgaggcaggagaatcacttgaatccgtgggcgggggttgcagtgagtcgagatcgcgccactgcactccagcttgggctacagagggagattccgtctcaaaaaaaaaaaaagaaaaaatgttcgttttggggccacactgaaacctacagacagtatcgagatggggctcagagaaatatattttaatgagcacacctacccagtgatttttgtataccttaaatcttgaaaaccacaggtttttttggttgtgtttttgttttgtttttgttttttttgagtggagtttcgctctttttgcccaggctggcgtgcagtggcgcgatcttggctcactgcaacttctgcctcacgggttcaagtgattcttctgcctcagcctcccgggtcgctgggattacaggtgtgcgccaccacgcctggctaattttgtgttttattagagatgaggtttcaccaggttggccaggctgttctcgaactccagacctcaggtgatccgcccacctcggcctccgaaagtgttgggattacaggcgtgagccaccgtgcccggccgaaaaccacagtttaaaagcaacacccggagaaaatgctgcagctctgtgctgttggcacgtggaactagtatctgtcaaagatacttggaacctcttggtgttaagtattactgtatctcagtttagatttagtcttctctctcctcatacattttttttttaatagatgggatttcggccaggcccagtggctcacacctttaatcccagcactttgggaggccaagggggcaggtttgcttgagtctcggagttcgacaccagcctaggcaacaaactgagccccatctctgcaaaaaataaaaaaatcagtgtcatagagcgagcttccagtcccagctacccaagagactgaggtgggaggattgcttgatcccaggaggtaaaggctgcagcaagccgggatggagctactgcactctagcttaggcgacagcgcgagagcctgtctcaaaaaaagagatgaggtctcactgtgtgctcaggctgcagtgcagtggctattcacaggtgtgatcattgcacactacagcctgaaactcctggactctagggatcctcctgcctcagccctccggaatagctgggactacaggcacaggccaccggctgcagttggttttttaagattctataacaatcgttaatctttaattaaagatttaatcttcccagtttaatcttcccactttaatcttccctgccgtcccaggtcctgtagaacacctacgttctggatttgacttattaactgcttgctctccattttccctagtaacttgcagttagtaggtaggtctagatttggattatttatcttttggtcaggaatacttaataggtgttgtgctagtttcttgttgcttcataatcaagtagtatatggtgtgtgaatgaccctcttttagtgataaggttggggatggtggaatggtcagcctactccacgtgttttctttccaccccaacctttcactcagatggctttagcatcccctacccctgccactggagtgaagtggtatgatcttggctcactgcaacctctgccttctgggttcaagctattcttctgccgcagccacgcaagtagctggattacaggcgttgtgccaccacgcccagctaatttttgtattttcagtagagagaggttttcattatgttggccaggctggtcttgaactcctggcctcaatctgcctgccttggcctcccaaagtgctgggattacaggtgtgagccactgcttctggcctggaatctcgtgatgactgttgaagaggtgacatttaacctgagacttgaaggtttaggatgaatcagttttgtacaaaactcacagtgctccaaatgaagggacgatttgtgcaaaggccctgtttgagaaactaaaagatcagggtggctgaggctcaagatacgactaaacagtgcaagataagagtgaaaatgtgctgaggggatagaccacgtgtttatctttacagcaatagcaagctgttgagcagggcctgacactataggatttttttactttttaaaatgcttttggcaggctgggccaaggtgggcggatcacctggttgggagttcgagaccagcctgaccaacaaaaagaaaccgcgtctctactaaaaatataaagttaaagttagctgggcgtgatggtgcatgcctgtaatcctagctactcgggaggctgaggcaggagaatcgtttgaacccaggaggtggaggttgcggtggaccaggatcgctccattgcactccaacctgggcaacaagagcgaaactccgtctcaaaaaatatatgtatatgaaaaagaaaaatacagtggttggattaaagaacattggcctggcatggtggctcatgcctgtaatcccagcactttgggaggctgaaaaggattgctttagctcagaatttgagactagcctggggaacattaaaaaaactagctggattaggtggtacacgcctgtagtcccagctactccagaggctaaggtgggaggcttgcttgagctggggaggttgaggttgcagtaagccatgatcacggcactgcagtccagcctgggcgacagagtgagaccttgtctcaaaacatctatatctattctgtaatttattccatctgtaatgttatggaatcacagatggaataaataacagaacggatacaactgaggaatgaattagaattctagaaggagaaaatctagaacaaagaaagagaaaaatataaacgaaaaactaagagataagaaagaactaccattttaggctgggcgcggtggcttatgcctgtaatcccagcactttgggaggccgaggcgggcggatcacgaggtcaggagatcgagaccatcctggctaacatggtgaaaccccgtctctactaaaaatacaaaaaattagccaggcgaggtggtggacgcctgtagtcccagctacgcgggaggctgaggcagaagaatggcatgaaccccggggggtggagcctgcagtgaggggagatctcgccactgcactccagcctgtgcgacagagcgagactccatctcaaaaaaaaaaaaaaaaaaatgaattttgatatgacagtaggaattaatctatgttagtggaacaaaatttcccaaattacatgcaacatccctgcttttttttttttttaataattaagagcaactaaactaaaaatactttttaggaatccattttgatgcagtaaaatgtataaaaaggaaagcaagggaaatgaaaacaatagggttcaggatgattattattgcaggaaggcagcaaaatgggatgggggatattatcgttaaatataggttatgatcagagtcttagtttgtggaagattattgcgttaaaaataatccaggccaggtgtggtggctcatgcctgtaatcccaacactttcgttgagagaatcacttgaggccaagagtttgagactagcctgggcaacatagcaaaatcctgtctctacaaaaaataaaaaaattagccaggaatggtggcgcatgcctgtagtcccagataatcaggagactgaggtgggaggattacttgagcccaggaggtcgaggtggcagtgagctatgtttgtgccactgtactccagcctgggtgacagaacaataccctgtctcaaaaaaattatgaaaataaaaaggtaaaaataagtaaaatgggccatgtgtggatgaataatcagcatatgtcttgaataaaagagttatgattaattctgtgtacttgaggtctaatgggaaaaaatgctgctaaacggggatgttagtgcttgtctgagtttgaaatcttgactccaacaacttactcattgggtgatcttggacaaataacttctgtttctctttcctgatctgtaaaataaggataatagctacataatagggctgttttggtattaaatgggtttatatgtatgcctggtacataataggcttgatgagtccttaccatttgtttcaattatctaatgctatggaataaaccaccccaaaacttagtgagttgaaacagtcattttatttatttttcattcagtgggatgataggctgagttggatagttcttgtggttttgtggtttgtcatgcagctgttaagtcaggtgcagctgaggctggaacgtgtgtgatgctttgttttgttttctttcttttttttaaggacacctcgagaccgttgagtaagtgctttgttgtagtcaggtggcaactggggctggaagatgtgtggtgctttggagggtatggctaagagtctgggctcagctgggcaactgcacctccctctccttgtagcctttttgtgtagtctccagtagagtagccagatttcaagcacctccaaaagtacaaaacatgagcctgccaggcctggaattgtcacattatcacctgctgcattctatttattaagtcatagggccagttagggagcgtggttcattgggagccatttttggaaacggtctgcacattataattaatgtttctatctaccatgttgctctaccatgtatgtagttgtcagatttagacactggaaatgtataaatagacagttacaaattcctgtccacttgtagcttatattttacataataaataattaaaatatgtagtgttttggttggtaaaaaggttggtagggaaaaataaagcagggaaggagatagggaatacaagcggttgggagttttagttttaaaaatgggtgttcatatgaggccttgttgacaaactgtcatttgagcatagacaaaaagaaggataagaattagagggcaggctaggagtggtggcccatgcctgtaatcccagggattacagcactttgggaggctgaagcaggaggatcacttgagcccaggagtttgagaccagcctgggcaacatagcaagaccccgtctctacaaaaaataaattagctgggcatggtggcatgcacctgtagtcccaactacttgggaggctgaggtgggaggactgcttgagcccaggaggttgaaaggctgcagtgagctgtgattgtgccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgttttgggaaggggctgaggcaggctggatcactgagggtcatggagatcaagaccatcctggctaacatggtgaaaccccgtctctactaaatacacaaaattagctgggcgtggtggtgggcgcctgtagtcccagctactcgggaggctgaggcaggagaatggtgtgaacccaggaggcggagcttgcagtgagccgagatcatgccactgcactccagcctgggcgacagagcaagactccacctaaaaaaaatttttttttttttttttttttttttttttgcgacagggtatcgctttgtcacccaggctggagtgcagtggcacagtcttggctcactgcaacctccaccttgccagttcaggtgattctcatgcctcagcttccttagtagttgggactgcaggctcgtgccatgcccagctagttgttgtatttttagtagagacagggttttgccctgttgcctagtctggcctctgttagaaataaattttcgaagctgcaaatgaatatcactcaaacataaatttaattttctcagcaaggcaattttacttctatggaagggtgcatctcacggatggagcaatggtgagagcacacctgaacaagggaggggaaggggttcttatccctgacgcaggtagcccctacttctgtgttgttcccgtattggctagggttggaccgcacagtctaagctaatactgatgggctattttaaagagagcaggggtatgagctggagtggctgggcgagtagtatggcgggaagaacagttacagaacaggtgactcaggatgactcaggtcaagggaggtgaccaggagtgactcaggatggagcaggtgatagaagctaggagggggttgtttactgaaacgaggggcaaggagatgaagagaatgaggaagttaaacttttaaagttttaaatgaagaacaaagaacaggggagctgaacatacagatacattggttttttggagagcatctcagaactcattgtacttaacaatttacaggctaaaacctttgaagaggaatttattaaatcctacatctcaaactcctgacctcaggtgatctgcccatcttagtctcccaaactgttaggattacaggcgtgagccactgcacctggcctattctagtcgccatttaccctttccctgatgtggcttgttagtcatcagttttaataattgttgccttttgttagaaaaaggcataaatgaaggttaacttaagtttatttaaaaatctattttccggctgggcatggtggctcacgcctgtaatcccagcactttgggaggctgaggtgggcggatcacgaggtcaggaatttgagaccagcctgaccaacagggtgaaaccccgtctctactaaaaatacaataatgagctgggcgtggtggcgtgtgcctgtaatcccagctactcaggaggctgaggcaggagaatcgcttgaacctgggaagcagaggttacagtgagccgagattgcgccattgcgcttcagcctgggggacagcgagactgtgtctcaaaataaataaataaataaacaatctatcttccttctctgtagcttttgtttttttaaggataaaaggtaggtgaaagattttcattgaactttactctgtatttcacttcatgctacatcttttctttgatggtatatgtccatctcggtttaacccattttgtaggtttgtaattgctgtgtttttttctggggttggtacatttacaagctgttttaactggtacttaaaatgttgactcttagttaactttctatggtcctttgtcaagacatgttccaacatgttgtagaggttttcctagaagtcctgttggaatcttaaaacctgtgacttaccttggtaaatccccagtcttgcatctagagagtgctctacctgataaccattggggagataatgatttgactttcagctaaaacagtttactgattaacatcagttggaggttggagcgtgcctgaaactgttactgtttcagccttcacctgagagaagcttggacgattcttactcttaattaaatcagaactagaaagtagtcagaagatatgcagaacctcagcaagggtatacagcatttgtgtacggtgctccattatatgtgtcatatgtgtcttttacttctgctggttgcctttgtgtgaatgctaaatagggaattttctgcattagaatagatgttataaatttttttttctatttagttttaccaacagactgcagtttcttcactaccaaaatgacatcattttccacctctgctcagtgttcaacatctgacagtgcttgcaggatctctcctggacaaatcaatcaggtaaatcattttcggtatttctagttttttggttttttttttttttaatttttaaaaagtttagctgtctcatgactgtaatcccagcactttgagaagtcaaggcaggaagcttacttgaagccaggtgtttgagaccagccttggcaacatagtgagacctgtatctctacaaaacatttctaaaagaaaaaattagctagatgcagtggggtgtgcctttagttctagctacttgggagcctgaggcgggatatcacttgagcccaggagttcaaagctgcagtgaattatgatcacaaccagtgcaccccaggctgggcaagagagtgagaccttgtctcttttttaaaaaaagtaggggaggtgggggttgtgctgggcgaggtgggtcatgcctataatcccagcacttcgggaggcggaggtaggcaggtctcttgagcccaggggtttgagaacagccagggaaacatggtgaaaccccctctctacaaaaaaatacaaaaattacctggatatggtggcgtgcacctgtagtcccagctactctggaggctgaagtgggaggatcagttgagtctgggaggttgaggctgcagtgacctgtgatcacaccactgcactccagccaaggcgacagagcaagaccttgcctcaaaaaacaaaagcggggggagctgtttaaagaggttctcttgttccatagtttcagaaacctacttgaaatgtaaatagcacatttattttatgtttatatcaggtacgaccaaaactgccgcttttgaagattttgcatgcagcaggtgcgcaaggtgaaatgttcactgttaaagaggtaagccatcaaataaaattctcattttttttgttttttttttttttgagatggagtctccctcttttgcccaggctggagtgcagtggtgcgatctcagatcactgcaagctccgcctcctgggttcacgccattctcctgcctcagcctcccgagtagctgggattacaggtgcctgctgccacgcccggctaattttttgtatttttagtagagatggggtttcaccgtgttagccaggatggtctcagtctcctgacctcatgatccatccgccttggcctcccaaagtgctgggattacaggcatgagccaccgcgcctggccaaattctcagttttaagaacagttgagaagtagaagccagtgaatatgtagttttgaaatcaggcctaagaaaggaagttctactcctgaggtatcagaggggcaacttatactctgttttaaagactgttaggttgaacatcatatttcctttcttttgaagtgtgttataagataaacataagatgaaccatgaattcattgatcgtagagttaaaatgcagagcaagtaaagattaaaaagacactgggcctggcaccatagctcacgcctgcaatcccagtattttgggaggctgaggtggagggattgcatgaacccaggattttgagaccagcctgggcaacatgatgaaaccctgtctctaaaaaaaaaaaaaaaaatacaaaaattgggcgggcatggtggtctgctcgtttagtcccagcagctacatgggaggctgaagtgggaggatcgcttgaacccagaaggtgaaggttgcaatgaggtgcactccagcttggttgatagaatgagagaccctgtctcagaaaaaaaagacactgtctgatttacaggctgtattttgaggcaggaattaaatgcagtagtttttattataaatgtgtcagatatggtggctcacgcctgtaatcccagcactttgcgaggctgaggtgggcagatcacctgaggtcaggagttcgagaccagcctgaccaacatggagaaaccccatctctactaaaaatacaaaactagcttggcatggttgtaatcccagctacttgggaggctgaggcaggagaatttcttgaacctgggaggcggaggttgcggtgagccaagattgtgccattgaactccatcctgggcaacaagagtgaaactccatctcaaaaaaaaaaaaaaaagtgtcagacactcttctgagcactgtgagttattttaaacacatgcatttaaataacttatttagcttctgaagttttttaaaaaacaatttgtattctttaagtggaaaagactcagtattaaaatgttaatgttgggaactgctttcatttggtggggtagatatctaacccttcctaaagagaagaaacaaaattatcaggcttttttttttttcgaacttaaaaccttcacacctatcaacactgccacactccagaaccattacacttctcaaggagacaaatctggaggcatttctgattttttagaatacctatattacttttacgattttaaattaagcacatcgttttggagtataaaatttgacacgtaagacctttttttccccaaacttattaaagtctggaattttttttttttttttttagttttatccttttattgaagcttacaatttcactgaacttttggccccaaatgaaaaaaatgcaaattaaaaaaagtattggcaaggagaggtgaccactgtcccctggagatggaagccgagcagagcgtggcaggcaagtgagggatcccagctgcggaggcagtagcctggccaaagatgcccagggaacagatttgtctgagcagggccagccccaggcagctagaagttaatacccaaggatttatgggtgtgatggaatccaagccactggtcccaggggcaaatctctctcatgcttggtcagattccactttggagaaaatgggctcatgtgacaggatggcctggtgagggaacacaggtgctaatggtaacaggccagtgaacactcgccactggcatcagggtggagctcagctgactggacactaactccattacaaggaccagaatctcctgcgtctggtgccaggctgtgccactcaactgctcatggccgtcgggacattcagctttcatcctctccttcatcaggcccctacctgtgtggcctcagccctggtcctcactatttggtggctgtgatgcaggactctcaaccctcttttggaacagtgttgcatcaagcaagggagaatgttcttctagagggacaggaaaagaagagagaggtccacgtacttctgtcactctaggaagccaggaaaggtccctggtgcactccactctccacagatgggttgggtcatagcatccgagctgtcatggtgacgacgtccttgaagctgagccgaatgttgccttgtacagctgtgtccttctcccggaaggcctctgtcggcatctgcagctgggtgcacacctggatgaagcaatcaagctgtctggcaggattgacagagcgtgggcagtagctggagaccagtagctgggtgaactgggggctcaggttgtagcccatttgggacagagcttgctgcagctctgtgtagctaatggagcctgagttgtcccagtcataactgctggaagagctgcttccactgctggatgaatttccacagggctgagaagccgtagacatttatgtggcctgattaggtcttgtcaaacatgtttatcatcatgaggcaggtctcatcattgaacaaggaccagttgcagttgaccagagcctgcttcacctccttcatggagataaagccactgtgatcagagtcaccgactggaaccaggagtaggcctcatccatattgggaggggagccaccctgtccatgaggcctgggctgctgggcaccgtaggaatttggaggtggctgaccataggggccccctggagctgtaccatcatttggtcctcctggagttccagaggggaacatcccaggattgaggtgtccatagggccctctaccagctggtggtccataaggccctccaggggcaggacccccatagccaccaccagggggtagcacgctgccatactgccctccactactggggggggtccaaggtagtagctacccggaggggttcctggcgcttgccctgcatctccagggcagccccgcccatacagatagctggctgtggcaattctgacgtcacacacaggcaaggggtaaagtctggatttttatatcattatagtggttatgatgaattatgccatctccttcatttagcatggcagagtttgcctgagtttacacgatgagctttctgttatgaaccttgactctatctattgcataaagggaatttcctgatttttattatttatttatttagagccagggtcttactctgtcacccatgctggaatgcagtggtggtatctcagctcactgcaacctccgcttcccaggttcaagtgatcctcccgcctcagccttcctagtagctgggactacaagcgtgcctcaccacacctggctaagttttgtatgttatgtagagacaggttttgccatgttgcccaggctggtatcaaactcctgggttcaagcaatttgcctgccttggcctcccaaagtgctgggattacaggtgtgaaccacttcagccgactaaatttttatttgataaacacttggattttatgttttgtccacttacaatgctgatggctcttattaaacattgtacttcatttgccaaaaagaattattatgtgaacacatatcaaaagcctaaagtcgtttatgtgccctggactgggaaaatatttttataatccaggcaaattacttctagtaatagaatagacttctttatttggacgtctgagaaaatttttaagaggatactaggtaaattcactgctttttctcattgtcagatcagttcatttctgtgctgaaaagtctgggtctgttaattgtcagaaagacaatgagtagatggacctagtagttgggagcggctttcctgttgtaggaccccttacacaaactttgacagtcttgtaaatatgttatttctttctttagcaaactaacttaccttacctcctctaatgaatttgtgtttttggtagcagctggacagatcacaacatggtattttattccatgcaggtcatgcactatttaggtcagtacataatggtgaagcaactttatgatcagcaggagcagcatatggtatattgtggtggagatcttttgggagaactactgggacgtcagagcttctccgtgaaagacccaaggtaaaaacagtgagggcttgcgtatctttttgggtgcttatacctagccacttaatttctatgggttattaatatttattacttcactcaacaaatatgtaagagcctacatatgttaggtagcctatgaggcactgagaatatggtaatgagcgacacacagtctgattttatggagtatacagagtagtgagtcagtagatgctcttgcccatcttagtcaaataatcacactaattcatggtaaacctacactatggcaagtgctacagaaaagagatacatgaagcagggagtgggtgggatttagagtgttagaggtcaagaaaatgttcttttgaggaagtgaaatttcagccaaaagctgaaagatagataattaagtagtcaatcagagagtttgaggttgattgaacaccatgtgtaaaggcctgggtaggaggaagcttgatgtgactaggttagaattttgtgaaataattgttggagagggaggaagagtgagcagatgagagaaatgtagaattgctgggcagttagaggttgatgatgagcctggtaagaatcacagtagggctaacctgacctgttacttttctccagctgcatggggtgtaagttattagcttatatagtcaaaagctaattagtaatttagaagctctctttctctatagctttgatgactgctgcttctgagctcattctgtcttacactaagacttcccttagctgggtgtggtggctcaagcctgtaattccagcactttgggaggctgaggtgggtggatcacctgacttcaggagttcaagaccagcctggccaacataagtgaaacgccgtctctactaaaaatacaaaaaattagctgggcgtggtggcgggcgcctataatcctagctagtagggaggctgaggcaggagaattgcctgagtccgggaggcagagattgcagtgagctgagattgtgccatggcactccagcctgggcaataatagcaaaactccgtctccaaaaaaaaaagactcccctccacccccactttccaattacaatgtgaaacttcagtcctggaaggaaggaatagtttccaaaagagatttccccacttggattactgttcgctaatgaaataaaatgtaaattaatcagttttttaatgggggcagagtaacacaggggcctgggcattaacatcttaatatttaaataattaaaaactgttctgggaaaaagattctgcctttgtatgccttacagagagacttgggagataacatcagaaatacatttaatatttaacggcaaaccactgatatcttcatagtggcatttggggttgttaattttttatcttctctctttaacagccctctctatgatatgctaagaaagaatcttgtcactttagccactgctactacaggtatgtcacatcatatttcttcagtctgtatcacagctttgagttcaagggggcaaatgatgggaaaacaaagaagatgaaggtggaaatggaatgctatctttggcatgactgggagaaatacatactacctgtcacacagaatgttatgttattaactttttactgaaaaatcaaacatagagtagaaggatttccactttctagacgtactgttaacgttttgtcatattgcttcatctagacacacttttaaaaatctctagcagataaggacttttttctccaaacattcaatatcattattacacataacaaatttaacatgtaattccataatcctatttcatagccagtttatgtatcatttcccccagttatctcaaaaataccttgtatttttgtcttacttgaattaggatccaaagtccacacattgcctttggttgatatgtctcataagtgtctttaatctataaaacttaactttccttttgttttcatgtcatttacgtgttgaagaaatgggtcatttgttctgtagaatttcccacgctctagagttggcagattgtatccttgtgattttgtttaatgtgtttctttaccctctctatttttggtaaactggtagtgcttgaataaattcaagtttaaattttttgccaagaaagctttataggtaatgctttgtacttctgtttaatcacatcagagtcatgtaaggtctgcctgtctattttagtcagtcatgttaataatctgtgggctcaggtggtatcagtctgatccatctgttacacaggtcactcaagaaccttttacctaatggctttagccatctcttatctgaatgccaatttgtctaaccctttgcttgattctagaccttctaaatactgctctttaactattaggtatgtataggaaactggctgtactggagtctggagtctccaaaatggtggtctgtaagagataggtaaataaactggacagactgaacatagccatttccaaataatgaaactttttccctctccactactacataaagcccttttgtgagcttcatattaacattgccctttgaagaaagcccaagttagtaatctttttagattgaccatctttttttcttctcaggttgcccaggctggagtgcagtggcactatctcagctcactgcagcctggacctctcgggctcaggtgattctcccacctcagcctcccgagtagctgggattataggcacatgccaccatgcctggctaattttttgtatttttagtagagacagggttttgctgtgttgctcaggctgatcttgagctcctggactcaagcagtccacccactttggcctcccagagtcctgggattatgcgtgtgaaccactgcacttggccactgccactgtcttttgatagtttactgaactgtcttttgcactgtcttttgatagtttactgaaataagtaggttgagaagaatccattcctttttatctttttctttctttcttttctttttctttttttttttttttaaatgtagagcgtcttgctctgtcactcaggctggaatgcagtggtgcaatcatagttcactgcagcctttacctcctgggcttaactcatcttcctgtctcagcctcccaaatagctaggactataggtgcatggcactgcactgcacctggctaattttgtttttttgtagaaatggggtcttgctttgttgctcaggttggtcttgaactcctggcctcaagtgattcttccacttcagcctcccgaggtgttgggattacaggcatgagccaccgcccccagacctaaatcaattactaataaagatttattctttaaaggcagagaaagagacattgctgtcataccgaaacatgattttgaacttactgaattttgaagcctgttagtctcattgagtcatatgcccacttcacatagctgtaaatttgagagtgaagatcctgcaaatgatacggcagctttattgaaattcaatcacttgtaaaatagcatggctttcctgcgatagtcactaaaggtttgagatacatggaggattttataattgctgatctactttttcattaaaatttgtttttggattgatctgttttctgaatatctataattctccttttttctctcattttctttcttgtactttctctgcagaatttaacatgccatataaagaatattttgttggttttgttttgttttgtttgagacaggatctctctgttgctcaggctagagtgcagtggcaagatctcggctcactgcaacctccgcctccgtggcacaagcagtcctcccacctcagcctcctcagtagctgggactacaggagtatgccaccacacctggctagttttttgtatatttttttgtaggtacaggttttctgcttgttgcttaggctggtcttgaactccaggactcaagcgatcccccttcttcggcctcccaaagtgttgggatgacaggcgtgagccaccatgcgtggcccatttttattttttaacttgtcgttttgaaaaaatttcagacttaataaagttgcaaaagtattgcatagagtttctctataccctttatccagagtccccaaatggtaacatcttacataataatagtatgatgatcaaaaccagaaaattgccccaagtaattctgattggttatctgttctgacttgcaattgcattggtgcttgtggatggccatctctgttgatttttgtgatttgggttgcttgtgttttatttgaaaggacaaatgagagaagtgcttttcatataattttatacctttgcaaatgggttaaacttttcattttggtcaagaagatgccattgtttaaaatggtagttcttttttttttttttttttgagatggagtctcgctctgtcgcctaggctggagtgcagtggcatgattttggctcactgcagcctccacctcccgggttcacgcagttctcctgcctcagcctcctgagtagctgggactacaggcgcccgccatcatgcctggctaattttttatatttttagtagagacggggtttcaccgtgttagccaggatggtctcgatctcctgacctcgtgatctgcccgccttggcctcctaaagtactgggattacaggcgtgagccactgcacccagcctaaaatggtagttctttctaaattgtctctccaaattttcccatgtatacaaatgaaataaatatgactaactttgtgtgtgtttattaatttttgagactgagtctcgctttgtcgactaggctggagtgcagtggtgcgatctcggctcactgcaacctctgcctcctgggttcaggtgatctcctgcctcagcctcccgagtagctgggattacaggtgcgcaccaccaagcccggctaatttttgtgattttagtagagatgaggtttcaccaggctggtgggttgcccaggctggtctcaaactcctggactcaagtgatccacacacctcgacctcccaaagttctgggattacaggcgtgagccaccacacccggctaattttaaaacttcttttttacattgtggtttcaccagataatttatttttgcttgtaactgttttaacctaagtaaggtagtaaggctttggaaatataaatgacagtaataggattgctttattaaagaattgctcctggcctgtgcggtggctcatgcctgtaatcccagcactttgggaggccgaggcgggtggatcacaaagtcaggagtttgagaccagcctggccaagatgataaaatcctgtctctactaaaaatacaaaaattagtcaggcgtgcgcctataatcctagctacttgggaggctgaggcaggagaatcacttgagccagggaggtagaggttttagtgagccgagattgcgccactgctctccagccagggtgacagagcaagactccgtctcaaacaaacaaaaaaattgctccatctgcattatatgttagtccaacttcgctttgaagaccactgtggtcagaaaatgctgtctctcaaactttttgttgtctccgtttgtccacaaaaatgtttctggaaataatgttttttataattagaattttgaaaatgtttgcttttttcaatagaaccgcattgacagatcagttgtaggatctgtatccttcctctagcagcctttatcagatggtgatgatattttccatattttatctctgaacctggtagtggttggtgaacctgacccacagtagacttattttgggtctatctcattcacatagcctcaaataatgaatagtccagattattaaattgtttgcagcttgatcttttcgtgtagccaagtttttgtcttttgttctacttgaaaaatttctttgtaagtccttggaatgcatttctcttttagattaatgtaatatctaagaatttctctgtactgtgttgttttccttggttctttttattggccttgagaaaaactttatttgctgctgcttcttaggaaatgtttatagtaactgggaaaaataagacaatgaaaaaaattaatttatatacaggtgatggtaatgggaatttaaaccataaaattatccttgacacttagaatgtcgctttagatgaagatgctattgttttatgaagcaaacggggaaaaatccagatttcaagatcccataaccctgtatgacttaacacttgaaagttgaaattaaatgtaaaaagccatacactcttttccttttgtttgtgagttaggcgaatttggtaatatataggaagagatgacaaaaatagactccattatgtcctgcttggaaccagttttcatataaaaatttaaaagcttgatatggaagaacatttttagctatttttcactgttttttttcccgattatattttggtaatatattttggatatggcctgtcttggtctttgtcatttttatcaattttgatttttcccttgcaaatgagagctttgtccagccaacatggagaagtacatttctagggactaaacctggctcccgggttgtttgctgaggtcctttttgtgtggaaagaatggttattaccagggaaggttttccttttgttttacttgctatccagatgctgctcagactctcgctctcgcacaggatcacagtatggatattccaagtcaagaccaactgaaggtaaaatcaccacacggtgacttcttttgttgtacagagtggccccttctctgtacctatggatcttggactcccaagacctttccctgaatgtggtaagaatttaataagaaaggttcttgggagttcacagaccagggacagagtgaaccttctctgttctgcccataacagagttccagtctctgaacctttctttgggatgtagcacttctgatcttcagttcttccagttgcatttttctttgggtttgtgtgtacctgtgtgtgtgtgtttgaggatattgctttattagattttaataggcgtgttgcagttaagttcatgtcaggccatttcctaaagcttccccaaacctggggaaactttatagtcatcttggtacgtggcgagggtttcatatgttttctgaattatgcctaattttgtagtagactggagggtttatacagatagcctgtttttaacagtagattttggcctttgtgcagaggttttttttccccccaggtttgggattcttctagctttgctcacagtgggttgaggagaggtgttgcctttatttgatgactgttgtgaacttgagttctctttcttgtgtgtaacccattgtgttgcacactaactggtgagccagaatggaactgctacatcccctggtctcagttatttctactgcactgatggacacctttcccttctttcagcaaagtgcagaggaaagttccacttccagaaaaagaactacagaagacgatatccccacactgcctacctcagagcataaatgcatacattctagagaaggtatgttttggattaaggctatatagacttttgttctcttcctcttccaacctttttatttttaatctctccgtatgtgaagtaggagagggatatgtcacaatttctcatccttttctgaaaacctttttatcagcctagttactaccattgttagctttgaagaggtagtgctattttagcaacccgtgagtactaggatggtgcaagacccttccatgagctagcatgctactagaaaatagctacacatttattgatttgctaccaggtgaattttctacatacatgaattcagctgccttagacttttcaatcttagtattcttgtatgtatatgatttggttagaatttttattttgatttatctacttgaggcaaaggccaattttcatacttttttttttttttttggagtcagagtttccctgggtcacccaggttggagtgcagcagtgcgatctcagctcactgcgacctccacctccttggttcaagtgattcttgtgcctcagcctcctgagtagctgagattacaggtgtgtgccaccacgcctggcttttttttttttttttttgagacggagtctcattcttgttacctgggctgagtgcaatggtgtgatctcagctcaccgcagcctccgcctcccaggttcaagccattctcctgcctcagcctctggagtagctgggattacaggcgcacgccaccacacccggctaattttgtatttttagtagagatggggtttccccacgttggttaggctggtctccaactcccgacctcaggtgatctgcctaccttggcctcccaaagtgctgggattacaggtgcatgccactacgcctggctaattttggggttttgccatgttggccaggctggtctcgaactactggcctcaaatggtctacccgcctcagcctcctaaagtgctgggattacaggcgtgagccactgcacctggcccaatttttacacattttgaagtttgcaaagatgacataatatacttaatcacaaagccaagaatgagatataagaagcctggtataagttgagcactctaaatttgaaatgttgagcattctcaatttgaaagatggtaatgctcttttagcaactcatgagtactaggatggtgcaagaccctttcaaaggatcttagaataagttgagcatccaaaatctgaaaacttgttttttttttttgttttgttttgtttttttttttttgagacagggtcttgctctgtcaccaggctggagtgcagtggcacagtctcagctcactgcaacaacctccacctcccgtgttcaagcgattctcctgcctcagcctcctaagtagctgggattacaggcgtgcaccactacgcccagctaatttttgtattcttagtagagacggggttttaccatgttgaccaggatgggttgatgtcatgacctcgtgatccacccgccttggcctcccaaagtgctgggattataggcatgagccaccacacccagcctctgaaaactttttcacatgacaccacaagtagaaaatttaacacctgacctcatatgacaggttgcagtgaaaacttagtttcatgcacggaattatttaaaatattacaaaaaactgtcttcaggctatgtgtacaaggtgtacatgaaaacttgggtcccattagccgggcgcggtggctcacgcctgtaatcccagcactttgggaggctgaggtgggcggatcacgaggtcaggagattgagaccatcctggccaacacggtgaaatcctgtctctacttaaaaaaaatacaaaaaattagctgggtgtggtggcgggcgcccgtagtcccagctacccgggaggctgaggcaggagaattgcgtgaacccaggaggtggagctagcagtgagccgagattgtgccactgcactccagcctgggcgacagagcgagactctgtctcaaaaaaaaaacaaaagggaaacttgggtcccatccccaggatatctcattatgtatatgcaaatattccaaatccagaaaaattgtttttgcccttggatggtagtcaccagatctttgccattccattagatatgttgtggtcaggctaatgagttcatccatattttccccaaaactctaaaaaacactttctaggctgggcatggtggctcatgcttgtaatcctagcactttgggaggctgaggcaggcggatcacctgaggtcaggagttcgagaccagcctggtcaacatggtgaaacactgtctatattaaaaatacaaaaattagccggacatggtggcaggcgcctgtaatcccagctactcgggaggctgaggcaggataattgcttgaacccgggaggcagaggttgcagtgagccgagatcgcgccattgccctccagcctgggggacaagagcaagactttgtctcaaaaaacaaacaaaaaaaacactttctaaaattagttttttgtttctgtttttgtgttggcgaagatgtgtaaaatcataaattccccaaagtcattttatggcatgatggcttctagtctaggcatgtggaccaatggcaggttaagcctctagttatgtctgagaaactttggctgctgaagttattttaaaagcttaaatttgaataagtttatcatgctggattgttttctttacattgcatttgagcataaactgaattttggtctacctagttactttgtaactattccagtctatatgatattaaatgtgtaattttattccttaatgcaaatccttgcttattttgtactcaaaaggcaattttaagatatataagaacatggctgggcactgttagaaaatcaaggctgggcatggtagctcgtgcctgtaatcccagcactttgggaggctgaggcaggggcattacttgagctcaagagttcgagaccagcttgggtaacatagcgagacctcgtctctacaaaaaatcagcccagtagaaaattagctgggcatgatggtgcgcaccagtcgtcccagctactcaggaggctgagatggaaggatcacttgagcccaagaggtggagattgcagtgagcggaggttgcagtgaatcaatatcatgtcactgcactccagcctgggcaacaaagtggtgccctgtctcaaaaaaaagttgggggcaagggcaggtatttaagaatagccaactcaaggggggatatgtagtttgtgatgaaaatttgggaataaataatagtattttcaggaagacctataggtagaagggacagaatttttatttgtggaaagaatgacctattttcatttccttcataagttgtagagctcgagtagggaagaataactttaatatggcaccatttcaagaatttggcttctgatagtttcaataatgaataagtggaaacataattgaagtttccctggccacagataagccttttagtcagcaatattgacataatttataagtaaatagggtaaccttatgttctggcaaggacccatgtattgcagaaattctttcaccatatgtacttcagcacacgttaaccccatggttgctatgggcaggcctaatgtattgggaggaggtagaagagaatgagaaagtaagaaaggagcagtagagcccaacaaaagactggagtatgggaaagaaaagagtatcatgtgataacaacagacttatgttaattagctgccctcagtgtcattcaaatgtacaatgtgagatcttttacttgaaataacgtggggtcttagtatttgtggtatgtctagatacttaactctaagagcccattgatccagcgagggcatatgtatgtatttggacaacctagagtttagtgttttatagtggttgttacctactaaaacatacgaattattgagaattgacccagaatatgtggtaccagtgagattgcctggacaaccttgtgatcacctattatggtttgtattgccttgctttgatcttaagggttagaccactatgttaccatcatttgcaatgctgttaatcaaactattatcaggcactatgtactagagcaagtaattctatagtttatacatggtaggagtgtttaaaataccagtaaatgcccatttagaaattcttttagcacaaggtcattgttcagatgcttttagagtcttttttttttcctgtcttctcatagaagacaatgcttttagagtttaaacttgataaacgatgatctgtttgtagtgtcattacttgctaatgaagtctaaacaagggaggagatttgagctctgccactaagacagatacttgatttctggttctttctttcttagaacaggaatttctttttacctattttataaagaagttttaagtattctaaagatagtcttagttattacgtattgtgcatagttatcattcttttcatttgacttctatagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggtaaatttcacatttgaagggaagtggttttttttcttttgaaagggtaacattcttggttactcttgaccacacattatattctctaagaattcttatttactcctatggcgttaaataccatctgtatgcatgtgatacccaaatctgtatctctagtccttacctcttccctaaatgcccaacttcagtttccagatgcctatttaactaacaactctacttagaggatttgacattgaacaatttcaaaatggagcctttggctgtgcgtagtggctcatgcctgtaatctctgggagtcccagcctataacactgggaggccgagacaggaggattgcttgagcccaggagtttgagaccagcctaggcaacatagacaccatttttacaaaaaattaaaaattagccaggcgtggtggcgtgcgcctgttttactatagtaataactgattcagccccctccttcctcacttcctgtcattcttctttgttcactacatgcgttttggatatactaggctcctttctgacactgtagcccaaaattgctgccttcctcaggcaccttaagtttgttctttactctttctggaacactgttcccccacattctttctttgccttctcatgatttaggactcacctcaaatgtaatttcttcaaagaggtcatccctggccacaaaggctattatgttacacagttccagtaggatccattcgctttttgttttggagctgtgtagctataggtggtggccctgccaaacccatccctagttaaaatagcctcctctctagccactcttctcttttatcctattttattctccatagtacttctcactttgtaaaaatattgctatattttatgtatgtgttgtctgtttaccactgaaatgtaaggccagggcttttgtattattcactactttttccattacctggtacctagaacagtatgtggcacataataggtattcagtgagtatttgtttaataaatggatgagtatttaatagtgtgcaaaataataaattgtctctcatgaatgttgtagaaaagcatgtcatgaaatattcatagatgaatgcagaaggttagttctatatggagttcagaaagtgtcaggacaaaaggtttgggtgaccatcagtatttctcatatttctttaataaacatccttgaccattttaagggaaagaatatgtcagaactaatggaatgttttgtagcttcttagagtgtcacctgtagaagggaatttagggaatagattctatttacttgagcaactacaagtccttaccttttaaactcttcagtactgtttcttaggtgttatacctgatttagtgttaaaagagaaaagtccatgcctgacaccattatatccatccattagtttatccacagtaggtgtcaagtagatatatgttgaatgaatacatgtccactgaataaaggcaagatgttctttggcgatgtagtgtgacgacattgagttttgggttcatttgtgttgtttcaacatctctgataaacctctgaatacagaaactcatgtttgttttttttctgttaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtatgttgtggaaaaattccatgttgattctgtttgtgtgctcatagtatcatctgttgagatttctttgtatctgtttttacaacagattgctcacataatcccctttttaactttaattaatttttcaatccaattttaagattcacattaagtaatgttaaccagggctgccttaaaagcccctacttagtcaaaagcagtaagctactcttttttcccctgattatagcaacaagctaccttttctctccctttgctaacaaggtaaggtgctaatcaagcttgtccaacccacagcctgtggaccacatgcggcccagaacaactttgaatcaacacaaattcataaacttttaaaaaacattatgagttttcttgcgattttttttctccttttagctcatcagttatcattagtgttagtgtattttatgtgtggcccaagacaattcttccagtgtgacccagggaagccaaaaggttggacacccctgttgtaaatgaacagcagtctgtaggagaaaacttatttcttggaaatcttgatagcttccataaccatgttgtacctaaatggaaagataagattatttctttgtagctattttagtgttaaaatagtagaaaagaggggagattgaactctgagtacatacatatggtatgtactcatgaagtactcatgtgtatggtatgtactcatgtacagatgaagagtcatacaggcaacttgctcaagactcagaagaaattggggaggagatccagtggccagcatgtagaagagtgttggtaaacatccatcggataaatacagcaaagaaaaaattgggtcatcctttttagttatttaagggattttcataagaattttgagttcctgaaggataccctagtatattcgttgtagtcaaatggtacctgggttctcttagactagttatatgggtagcattagaaggaatgcaggtggcttgaattaagacaaaagtgacatttggaaacttttatttatttatttttgagatgggatctcactgttttgcccaacctggtcttaaacttcttagctcaagtggtccttccacttcagcctcccaagtagctggggtcacaggcatgtgcagccatacctggcctaggaaacgtctatagagagagatgggacttaaaatacttggccatttgtgagaaggttgctgtacagaggttcataattgtttcataattggttttattctttttattggaccacaaaactagggctttaaatttttaaattctaaattttaaaatttagaacactccttacttttgaaacggactttttttgtttgtttctgtttctgtgggcatgtttttataggacagccagagtatcacataactagtttcacttttgaaagtgaaaagtaaatttttaagatactttgtttcattcttcctgtctgcttagataaaaaattgcacgtttaacaatttggagcttttctactctgaaattatttatttatttatttttaaattgttttagagacaagctcttattctgtcacccaggctggagtgcagtggtgagatcatagcttactgcaagccggaactcttgggctcaagcgattctcttgtctcagcccccaagtaactgggactacaggcgtgcaccaccacacctggctaattttttttattttttgcagagacagggtcttgctctgttgcctaggccagtttcaaactcctgggctcaaggtatcctcctgccttggcctcccaaagtgctgaaattataggcacctggctgtaaaatagccaccatgcccagctattttctttaaagtcataaatatgggcatcttctctcttctgaatgcaaaatttatttggtaactcttctgggtgcttttctgtcgtttgtgctactactgaaatgccaactagaagtacagaatcatgtgtttggtcttgcatttaagctgtctccttaagtgctagagatgggagaagaatgtgagttttaaattgaagcagttgtcttttttgcttttagttaattagcctcatctaaaacaagtaaacattactaatgagatgtttttgccttcacaggtgattgaagtgggaaaaaatgatgacctggaggactctaagtccttaagtgatgataccgatgtagaggttacctctgaggtatgaatctttagcaagaactattttgcaccagccccatcttcagatgatgtaatcccagcagttcacttgtgttgaagagtgctgtttacccctcatttctgtctcccttgcctagttgctaagtgatgttggtttctttacatttttttaagagatttttattggaacttaagaagggaaggggataatttgatcttatcctctccctaccttgaaaaggatgagataaatgcctctgtgtgcctttctccctgccatcaaatctctctggagacacaaagttattcaaaatagtcttgcactgctttccctgactcaacacctctctgcaatcccaaagacagacccataggctatctaaaattatttgttgaatataaaaataatattgtcattgttttcttaaaaagaagcaaatggaaaacagcttaatttccacacagattagtattaatggaggactattaaagaagacttgatattccactcttaggttaatagggatggatttgtcactagttgacaactcaagtctagacccaaatgtataccttgcttttttgttgctatttccccatgtttcttttagtcttgccacaggtaacacactatgggaaaaaggttggtggaggaaggataagaaggggattttacattttgctgcttggaaagagaaacatttttaggttgtttctggtgttgatccttcccccattcccaccacaccactgttgagcattatggtagttcattgccaatgatctgtgtgtagcttagtaataaagtaaaatatattggtccagtaagtgttcttgactgtaatacaaataacagagataaatgtttccatctgtttttttgagatggagtttcactcttgttgccaaggttggaatgcaatggcataatctcggctcactgcaacttccgcctcccggcttcgagcgattctcctgcctcagtctcccaagtagctgagattacagacatgtgccaccatgcccagctaattttgtatttttagtagagacgaggatctccatgttggtcaggctggtcttgaacttctgatctcaggtgatccgcccgcctcagcctcccacagtgctgggattacaggcgtgagccaccactcccggccatgtttccatcttaatcagacttctgtggctacttgggtgcagaaaacctattaagcaaatggactgtatttcatcatatcaaagatgccattgaatttaataagccctattattttatgtcctactaagaaaaagtgatgccaattaaactgtggcacaccatcactcatgaattccaaatctttatgaagttcctttgattatttgtatagcattttaaatgagattggaagatcttagactggcaagagtgttttgaggccatctggaatcccagtttaacacatggttgtgcccttgcctcagtctggacaattgagttatgacttctagacttgaagtgcttggcctttgacctaaaagtaatcaagttcagcttatgtcaaatcaaatcctgtcaaagccagttaaccgcattaaatattctttcttgttccctgtagctatttttgaattaagcaaagcatttaaaattcattgagatctagtgtctcctaatttgaatatggagaagtagggaaaaattacttggcattcaaggacaataacatttatttttcagagggcatgatttaggcatacagttacacctataattctgggtgcaatgagagtgcatgagtaaatttagtcgttttcaaatctcatttgttttagctttcttttttgccaaactttataacatttgctattagtgtagaaaagaatgacagagtattctcttcattcttcagcctcttgcccgataaaggagtaagttgtgcaaagaaaaataactccaaagaagcccataaggtacagcaaacaatgtaaatttcaccgagatgaggtagaaagccacctttcttaaagccactttcttaaagataactatatcagattttggcttgaaaatagcagttgtggcactatcagtgtaaaccttccaaagactttccttcatgtggctgtagaatttgctcaaatcctaggctagatcactggtgtggaatagcttagtgagaggatgtgaatgaatttgacctcctttcctttttctcagcatcatattaaccccctgagtattaattggcttcacttgtctttgtaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctccttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgcc

SEQ ID NO: 12090 - DNA, 10143 bp, Human
aatcccagcactttgggaacccaaggcaggcggatcagctaaggtcaggagcctggccaacatggtgaaaccctgtctctactcaaaaaaaaaaagcaaaaattagcctggcatgctggcatgtgcctgtaatcccagctacccgagaggctgggttgggagaacctcttgaacccgggaggtggaggttacagggagccgaggtcacaccactgcactccagcctgggcaacagagttaaactccatttcaaaaaaaaaaaaaaaatcagccattgaaaaaattaaagttagttttattgagtcttactgaggactgcaccctgggagagggtttcagagagtttctgttagactgcgccaaagcagcatttcagcccacagtttagatacagaggcaggcggttctgtgtgtgctcagaagctatggtcaggcacggtggctcacgtccgtaatcccagcacttttggaggctgaggcgggtggattgcttgagctcaggagtttgagaccagactgggcaaacacggcaaaaccccttctctacaaaaaatacaaaaaaaaaaaaaaaaaaaaaaaattagccaggcatggcggctcttgcctgtagtcccagctacttgggaggctgaggtggaaggatcacttgagcccaagaggtgagctgtgatggtgccactgcactccagcctggatgacagagcgagacccggtctcattaaaaaaagaagaagaaaaatttacatcaaatgtcttcagaagctacactagtgcaaatctcgccaaggtttgggttcgaggatgcacctagttatatagattatagaggcataatcgtcaatcctgtcaggtgctatcttatgtacaggaaaaggcacagccaggatcatttaacttatattttctaacaatgcagtgattcaggcaagaggcgtgggagcctgtgttctgccctgcctgccatcttcaaggcatccttccgttgggctgcccccagtcactgagtcagggctttgtcagcttctgacaagcagaaagagcaaatgcggtttcttgggattgcaacttggtctcacagtggcttaggccagggtgggagcagtgaacggagtcacaaaagaaatttttcaggtagcattcacgggtgggtgctggattagatgcagggctaagggcaggggaggaagcctgggtaatggaaggctgcggggccaaggggggactgggaatcctggagggccaggtctgggggagagttaggaggtcgtgaatttggacttggatgcttgttgaagctgatgcatcttgaggacatttgtgggacacataggctgggtcagggctgaaagaggtgctggttatggccgggggcagggactcatgcctgtaatcccaacagcccaggaggatgagacaggaggaatgcttgaggccaaaatttcgaggccggaagttccagacgagcctgggcaacacagcaagaccctgtctctagaaaaggaaagaaagaaccgctggttgtggaagccagccatggcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacacccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacaggtaggcgcgggcctggcgcttgggggccccggggggcggtcaggggcgtcggcgggtcccccggcgcgggggcgagggtgccaggctctctgggtcctcgatcctggggcagccgcggaggttcctgaaccccgcgccttcagagcggaggccaagggggcacctggaaagtttggggttgctctgcagagagaacgcgaattgggaagggcggggagcccgagtttggggggagccagaggtgaggtcgtcgggggatgggacatcttttgttctcccggggaggttggaatgtggcgggtggggtggggggggggggtccggtgggaatggccgagacagagacgcagagagacaaagagagatcagagacgggagcgcgagggcgcgcggagcaagtttccgcggctgattgttcccagctgtgcggcgctgcaacatctgggtttctcccgccgggacccctccccctgagcccggctctggagccggcagagccctccctccgtctgatgtctgagcgagcgtcggggccccctgtcccccacctcccaggacgcaggggagtcgggggtgggggaggccgcagctgtggaagaggccagaggtgggggtggggcagcctcccaggcaggtcctggcctcccgcacgccccaaaaccccttcgtctagaagagctcggagatgtggtcccgtgggaggagttcatgaactccacactgacttctctctttcctgcctccccgctagcccgtgggcctccttcccccaataagcctgggttcgggggccagtcctaggggaggaagactccccgcagggtaccgacaggcatcccccaacaccttgcaacccctcttgccccaattcagcgccttctgctgagcagcgggggctccgaccgacctgacggatggggagaagggcaaggaaggctctctgggtcttttcatccccctcccatgaggaggtcaagggttttcagaatggggtgtggggagccagctatccctcgcctctggggcagcttggtcctgagcttcgtctcccggctcccactccaccttagtgaggtgcctaatgcatgagaggagccagggggtcaggaggcctcaggattgagaggaaggagggaaagacctcctgctttctcccctttccctcccctctccctggactcccagtggggaaaatagaccaaagttggggtttccagctagctctctgaaaggacttcctgggttgcagccgggaggggccctcctggatggaccccgccctcgcagccctccctacagaaggctgacggacctgaggtggccctccactgagctggggctggatgtggggaaccggaggctcccccaagtcccaccgtgtagccaggactggaggctgggctcttgaatgtcaggagcctgatgaaagccacggaccccatgccctctccctccaaatgacacacacacttgcctacagtgtcagggggtgcagaacccccagcctgggtgatgtcacggccccttcagtgctgcctttctgggatccagaggagccccctcaggcttcactctcgtgcttcctgctgctgcaaatagcccgggtctcgtgagcctgtgatgcacacagccaggtcttgcgaggcctggaggcctggcaggagaggagtcttctgggagctgggagccctgcccggcctggccgctctgggggccgggcaggcccatgtgtatgtggtttcctgctgagcaggatgcttagggcccaggggctaattgggagcaggtggtggcttggcagaagctgctgagtccaggcggtgatgccggctggccagggctggggtcccaaggatgggcctgggttcagtgattcacgcagtcagtgccttggacacccagggagccactgggccagagggctgagcacgggtgtgggtgaggacagaatggcctgggctgggagcacattaggaatgtccccttagtgagcagggcagggtccgcccttccctgaccacatcaagtacacccactacacggggtttgcttgtcaggatcagccctggagctgggttggaggccttgtcccttgtgacctgaacacctgggtgggccagcagggactgggatgtccctccactccagccctcccatgcctggcttctattctgggtgccaccttctccagggcgaaatcaggggatcaaaggtgagctctgctgtcctgggtgtggccctgggtagagctctcccaccggtctttccccagctgtcctctctgacaccaccccggcctgcctctttgttgccatgagagctgcctacctcttcctgctattcctgcctggtaagtggctcctggggcagggggtagctcctcttatgtggggctgaggagtagggttagtagggggaattcatagtgagcctttgtcacgacttatgaccagaactcagctccccagctcccagggccttctgcctgcttggaccacagactggaccagccaaccctggcagcatctggaggcagctcctggcccttcccccagccttccacagcagcaggcaggcagggttctggagggcacgtcccaggcacaaggactccgtgggcacaaggcacaaggcctctctgggagccgatgtgcaggtgcaggggcacccaaggcagggagtccggatgcttgagttctagatccattcagggcccttctgctctatacagtcctgaccttgtgggggtccctactggccaaatgaagagaatcaatgaggaccacaaaagtcctagcagggccaacattcattcattcagcagcgatgtgttgagtccctaccacgtgccaagtgctgggctaggccctggggattcagcgatgaaccaggcagacacatcgttgctcctcatcatgctgccagtccagggaagggagacaaataggaaacaagcagacatgagaaactccagcatgtgctgagtgctggacagaaatcagcaggagggctggtgggctggaggtggggcggcatcttggcacagctgaaattccagggaagacctgaaggagctgagcaggcctcacaggcccagggagtgtcaggtgcaaaggctctgagggaggcaggagcatgtggagtcctaggagcagccaggaggccagcaacaggaaggggcagggtaaggtcagggaggtgacccatgaccagggtggggaagggtctttaccatcgaagaagagtctggatcctctaggaatctgcttgtggggtcctaggctcttatgggcctgaccttgtgacccccgcctccactctccagaagcgcctcgggcccccgttgcccctcccgatggggtaccctacatgctttgcctccccacagcaggcttgctggctcagggccagtatgacctggacccgctgccgccgttccctgaccacgtccagtacacccactatagcgaccagatcggtaagggccttgccgggtcaccgaggcctggctgctcagatgtgcctggctcagccagggaccgcactggacacgctgatgggaactctgggggttggtccctggctcaggagggaacttgtttgccccaggggctgggggattagccttactcccaccaattccactttcatctttgtttgcagacaacccagactactatgattatcaaggtaacgggctaggggtaggataggacgggccggcagctggggtggggagaccccctgggaggggtagagggagcagacccccttatcctcccctggctgcagaggtgactcctcggccctccgaggaacagttccagttccagtcccagcagcaagtccaacaggaagtcatcccagccccaaccccaggtaggccccagaccctgctcccacccgtctcagctcctgcctcacccctccccaccctgtcaaccctgggagtgggggtctgccagggctgggagaggtgactccccttgccctgaggagacccctcccagtgatgtctgcctacctctgtctccacaccagaaccaggaaatgcagagctggagcccacagagcctgggcctcttggtaagggctttcttgacagctggaaaaatggaggcacgccctgaagttggggtggagtagggggtggtgctggtgggctggaggtctttggcccttgcccatgtgggctcttggcagtgtgggcagtatgactgccgtaggctggcatcaccaggccccccaggcagctccaggaggtcccacctgtccccagtgtgcctggctggaggctaaattggcagcctaggaaggcccctgacctcacagatactgggaggggcagggagtgtgctgggggcttcctgccagccagagagactgagtggtgcacatgtggaggcgaggaagggccagggagtgcaggctggctgagcggtgccctccggctgccctagctgagagcttgaaagaacaaggtgtgtgtgtgcaggagaatccgtgtgctcactctcgtgtgggttggtgtgagcgctcctatgtgggcttctgtgagcgtgggcacgtctgctcgggagttggtatgggcttttgtggcgatgcatgggtgggtgcaaatttctgtttgaacttaggcttctatagtaagtgcggttgtgaattgatacgtgaatattacagccctgggaagtctgacaatgctgcgtgggtctatgtgggcatgtgtaggtatgggtgtctgcacggggcctgaaggtacaggggggactaggccctgtgagccagcctcaggtgggtgaggctgggggccgccccccactctgggctcctagtctgaccccacctgtcaccagactgccgtgaggaacagtacccgtgcacccgcctctactccatacacaggccttgcaaacagtgtctcaacgaggtctgcttctacaggtgagcacagatgggcagctgtcgggaggattccggagcatggggggctagagggcacaggggacagctctggcccgccaaggtgggagttggaggaaagatagtgagtccttaagttgagctcagttctgtggttgagcctgggccagggacctcctccactcctgggctccagtgccaggttctgtccgggctcccgtgccaggttctgtccgggctcccgtgccaggttctgtctgggctatcccagtgggattgggtggaagtggggctgagacctcccgtgccctgtccccgcagcctccgccgtgtgtacgtcattaacaaggagatctgtgttcgtacagtgtgtgcccacgaggagctcctccgaggtaggaaggccacctccccaagacctcccctgtccccacacccgcatcattatctggccacctagccacccacctgatgtttattcaacacgtattatccaccaggcccacttccaggacaccctgagctcccctccttgctacttttcatcctcaaaacactcccatcaccagagttgggggaggggcagcggttcccatcacccagctccaccctgaccctgcctccttcctgcccccaatagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaagatcgagtcactttttcggtggagagcacagaggggccagccaagtgcccccaacgcggactgtcctgagaggctcctgaccccttggagtgaacgatctgctcaggtgccctgtgcttccgcagtcccagccccaccgccttacccgccggctccagctctgccctgcccagaacgctgcgtcatgacagtgtacgcgcgcatgcgtgttgtgggaattgcacgggagatggaaggcttcagggacacagctttctgatgaccggggctgcttggtgagcacattgagttcccatcaccagaggaacacagcaaaaatgggaggccgcccatggggtggggggggcacagggtcaaggcaggcggactgacatccaaggcctttgtttgggaagttggggagatgggtgccattaagagggcaaaaaaagcggggcacagggactcacacctataattccagcacttagggaggctgaggcgggcggatcacttgaggccaggagttcgagaccagcctggccatggcgaaatcccgtctctagtaaaaatacaaaaaaaaattagccaggcgtggtggcgtgtgcctgtaattccagctactcaggaggccgaggcacaagaattgcttcaatctgggaggcggaggttgcagtgagccgagatcgcgccactgcactccagcctgggcgacagagcaagactgtgtctcaaaaaaaaaagggcaaaaacaagcaagccattgtaacacctccctccaaccagcatgtggggcctgggctctgtgtgtgaaggctcacacactcctgtttagccgtccgaacaggcatatgtggtggatgcaattcatatccccttcttagagacaggaaaactgagcccagagacgttaagtaacccacccaagggtcccacccacgggtccacagctatcagtggcagtgctgtggctgaatcggtcagctggactccagcaggtgaggatgagtgttaatttctccttcggacactgactgagcacctcctatgtgaacttccccagagccaccctatgcggttaggttcccattttacagatgagcaaactgaggctctaagaggttaagcagctttgctcaggatcactcagcggtgccagggcaagaccccacgttcacatccaaacctgcacttgtttgccatgctgcctggaaggcctgtcactgtcccgagggtgggcttggatctaaggaggggccagagaaaggggcaagaaagcataggctggaaagagtcgaggtgcacaggctgggcccagtcccaggcctcaacagccccatctgttccatgggccgggtgaccgagtaccccagaggcctccccatctgacattctgtgaggctggtaagttcccttcccaataccggcctctctgctctccctgccgcctccccaagcacccctccctagagggccccatccctcttgccccagaccctacctgtctccccccgacgtctcctccaattgtctagaaaagggacacagctgtacaaacttttttaaaaacaaggttttgttacaaaaaacagttctgaacagttaacattgtaaaaaggtataaaaatacagggactctgagcactctgaggaatttcccgacacatgctcttaactaaggcggagagatctctgggaagccgaagtcagggcctgggcctctgacccctgccctgggcctggtccccctcctctttcccacgatcccatgctccagggctgaccagagacaagggctctccccaatcctggctacggctcagcctctcaaggaggaactttaatgatctacagtggctcatcctagaagaggggggctggactgcaggtgttgctgggaagcctctccaggcctggagctggagtacccgtcctcagcactgccagcagagcgcctcctcatcccaccccagcttgaggcccccaagggaccgggctctgggggggggggctgtccaaaa

SEQ ID NO: 12091 - DNA, 54033 bp, Human
gtgcctctccggcgttaacatccacacagcctttaagtttgagaagaaacattttacaacctcttctctctgaccctagcaccggaagggttcctgttcaaataagaacttgagtcttcacaattctttatcttaacccagacattcttttctattgatcccaggactttaaagaaacccaagcaattgccaatcagaaaattctaaaatctacctataagctggaagcctcctgctttgggttgtcccgcctttctggacaaaaccaatgtgtctcttaaatttcattgatgtctcatgcctccctaaaacgtataacaccaagctgcaccccgaccaccttgaggacacgttctcgggacctcctgagggctgtgtcatgggccatggtcactcatatttggctcagaataaatctcttcaaatatgttagagttggactcctttctctttttttcttttttctttctttttttttgagacggagtctcgctctgtcacccaggctggagtgcagtggcctgatcttggctcactgcaacctccatctccccggttcaagcgattctcttgcctcggcctcctgagtagctgggactacaggtgcacaccaccacacgcgtctaattttgtattttagaagagacagggtttcaccttgttggtcaggctggtctccaattcctgacctcaggtgatccacccgcctcggtctcccaaagcgctgggattccaggcgtgagccaccgcgcccggcctagtttgactcttttcgtggacagtttgaagtgtggaatgcaagaatattcagggttatttgtcaggctgcaaagttgttccactaccctgcaggaaaatggatacaattttaggcttaggtgttaacagataacattgttaagtgtgggaagggcgacaactgcactgcagctgtggccagtggcgcgggagggtgtctaaactcaaagcccactggaaggcgagtcgcccatgaccaggactagggcccaggtgccccagatagaaggcacctcgttccctattgcccctcactaactcccgtgaccaggagtccccactcccaaccttgtcctggggattctggggagaaactgccccagcgcagaggctactccaagggttgtccttggtccggcgcaaagggttcgtccgccaccctcccggctgcgcaccccgcgctcggacgctctagaaaggacttgggacgggggttgcctgtggagcgggggcctaggcttcctgagcagggagaggattgcactttgctccccttggggaactccctgaggtgagcagcggggaggggcccccatacttttcccagcaggggagccgggagtttcctctgctcccactgcagagcaggggagggtccctgctaggggcggagaaggggctgcaggggcgagtggggaggggggctacacgtttccaagaagggcggcagtttcgtgtcgctacagttgcaggcgtgcatttaggaggctgtagacagggagggacccgcactttcccgagcaggggagctgctgggaaagtttgtttttttgctcccactggagaccagggggtgaggggcggagaaggggctgcaggggcgagtggggagagggggctctatgtttccaagaagggcggcagttttgtgccactacagttaagggccgccctcgggcgtgcattcagagggctgtaaaccgggagggacccgcactttcccgagaacgttgtagttcactttgcttcgggtcggcgccgccctggctacggccctgtgggtgggtgagggggcgtgggcagtttcctgagaaggggcggggcgtgtaccgtactcccctcggcgctgcctgggccacccccgcccgcctaccccctctgtctcctccccgggcccggcgttcccgccccttctgtgcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccgggtgagcgagcggagggatccgggttgggggacgcggagggcgcgggccgggactggggatccgcttgagatgcggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgattcttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaacttcgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttataaattcttttttcaatggtcagtgcattttttgctcttcgtatgggcaggcttttaagtagaccggcttgcgggcagtgtggacttcaggacgggccttatcagggctggacgtatttaggaaggagacgcgggaacgcccggccctggggaggacggaggaggcccgatttgtgttgataggatctagctcagcctagagcggcggtgactaggccgggtctctatttttagggaggagttgctaatggatttacaccctctttaaaggggtcccgggtatcctagaaattgtgctttcacttggtagagattagagataatgaagcctgctccgtagaggaaaacttggaggactttccagcctgcaggggaggttccaagcagagcttcctgtttctcccttttcttcctaaatgtccttcttgcgggcaacctgtcaccacggacgggatggctctgtagggttttatcagctgcatttgttccccaggcacctgcagatgaacgggtttttcacttgtctctctgcgaatgcattccttcatccttcatgcctgccttccttcttttgcacctactgtgggcttggggtcagggaaatatatccaagggagtgctggtggcctaagaattcagtttcctggagaacagaggcatctgaacaggcagacgggagacagggccacagggacctttatagttccatcacgaaataactcaggggttcccagtggtaaatcttggtgaggggcttggctggattttgaagccctagggacagatttgccggctggtctggcgttccaggtcattggagcagagtgagtggaaagccttatattctctaagccccaaacaagtcgttgcacagtttttttgtttttgttggtggtggtggttttttttttttggacggagtttcactctgtcaccagtctggagtgtagtggcacgatgtcggctcattggcgttgcacagtttttaaacccacagcagtgttcatctggaactcctgattttggaagcagactgggcttaggaactccagctgctgatgctttgagtaaagggaagagtacctgtctatggggtgggtgggtagggaagagcagtgggataggggcataacaggggccaacctatccttccaattgcagaggagggcctggccgtcagcactgatggatctccttgagggacgcttctcaccccttctttgcagtctgaccctgctagagatggagacagaaacagcctgtcccaataatattaatacacgtttcatcgggaaagttgacttttgagttggtgatgctcagaacacactttcttatagcaacgtgcatcaggctgcaaaaccccgttgagcctgaagtaggttctcagactggtgctgatagctctggcctgatctcagagtgttggggaccctgtgttccttggttccttcataaattctcaggggtacaggtgggatgtggtgagggatggatggacagagggaggtgtatagaggaaaagaggaggcttcagctttgtagagagcaggatgtccccacagggcgacgttggccccgaggagacactttgtgatggttgcagacatttttggttgccaccctggggtgggacatcccaccatcctgcaatgggtggggcagcttagggaagctgctcagaatctttcaagggccaggacggcctccagcacaaagaattcatctggtcccaaatgccagtggtgttgagggtggaaaaccctgaggagggcttgggagttgcatgtatgcgctgattcagggctgcccctgcagttaggagcctgccgtcccgacagtagagtcgcacacatccgatgcatccctgctctctggcaaaggctgatttgccccaccccccggggcaacggcacagcggcctgtgcggtttgaaaaactccaaacatctacggaaccgacatctcttgaacaataccaggcctcttcaggattccctcgccccagtagagcaagtgtgggcttcgttgtttttttttttttttaactctctccagagctcttgtctcctgcccctgtgggtgtgtgtggaagttattaggagaatgtttctgggcagaggaagtgggttttatcatccagcgagtttgccttgattttccatcagcgcgtttggctctggtaaaagttgattgctttgcatttaactccctactttaggccgagcacggtgactcaggcctgtaaatcccagcactttgagaggccgaggccggtgggtcacatgaggccaagagttcgagaccagcctggccaacatggcaaaaccccgactctactaaaaatacaaaaattagccgggcgtggtggtgagcgcctataatcccagctactcaggaggctgaggcaggaaaatcacttcagcccgggaagcagaggttgcagtgagctgagatcgtgtcaccgcattatggcctgggtaacagagagagactcagtctcaaagaaaaaaaaaaacttcctgctttagctctttctcctttctctgtgtatgagacagagttttcatgtaaagacaaatacatgtctttacactttggagatactcaagtaaatgattgtttgtctggaaatcatttttcttcctgaaggtcctatggtgggtacatgctgtcatttagaaagaaatgcagctcatacaatacttttcccaattcagcatttaggaatcatggcgggatttcatggatactgtctggaatgttttcggactcagatatcttcccccggggaaatagacttctcagtagccacgtggaccttgtgctggttttcagtcctgctgaaaatgttctgagcactcttgttactttaggggaaaagaattacgtgtcctttgtgatttatagacacagtaagaaataagacctgtgtgtctctcggggtgcgaaggaggaaaagtcttttttttttgagatggaattttcctctgttgtccaggctggagtgaagtggcacgatctcagctcatggcaatctctccatctcaggttcaagcagttctcctgcctcagcctcccaattagctgggactacaggcatgcactgcatatctggctaatttttgtatgtttagtagagaaggggtttcactatgttgaccaggctgaaaaatatttttttgaggtggggtctctgttgcccagactggagtgcaggggtgcaatcagggctcactacagcctccacctcctgggctcaagcaatccttccacctcagcctccgtagtagctgggactacaagcacacaccactgtgcctggccacttttaaatttttttgtagagacagggtcttgctatgttgcccagactgaaaaaaaagtcttttttttttttttgagacagagtctcactgtgtcacccaggctggagtgcaatggcaggatcttggctcactgcgacctgtgtctcccgggctcaggcaattctcctgcctcagacacctgaatagctgggaatacaggcacatgtcaccacacctggctattttttgtatttttagtagagacggtgtttcaccctgttggacaggctggcctcaaactcctggcctcaagtgatctgcccaccttggcctcccaaagtgctgggattacaggtgtgagccacctgaaaaatcattgtaaaaatcaactgtcctacattcttatttggaagtgactcctctaaccaaagacagggaaaaacaaaccaaactttattaacatgcgtttttcattgatacatgggagatacctagaaatgggtagttttcaagaaagtggcttggattctagctgctctagtaccctcaacaaagaacagtccatttttagagaattggcagagaaagacaaaggactttgagtcttcaggggcagcaacgaaatggcagagaaaggctggttattgaagcttgttcattctgagtcctgtgttccatgtcccaggcccatgtggattttctgctgtcttccgtgcttcacctctgttctcccagttggggaggtggggttcggattgcttgtgaatgtgggctcatcgttgctggtgtagctgcaggctgcaggctgtccagggcttgaggatttgctgatattctttcttttcttttctttttattttgagatgaagtctcgctcttttcccccaggctggagtgcgatggtgcgatctcggctcactgcaacctctgcctcccaggttcaagcaattctcctgtctcagcctcctgagtacctgggattacaggtgcccgccaccacacctggctaatttttgtatttttttagtagaggtggagtttcaccatcttggccaggctggtttcgaactcctgacctcaggtgatccgcccgcctcggcctcctaaagtgtattcttttttgatttattcccagtctcttggctgaaacatggtagctcaccagcatttctactcccatttgtccaactgacggtatcttttcacatctctagagaccagaaggacttcctcttcttgaatttcctgttcagtattctttcttggcttggttccttggtgagttttgaggagatggtgcatgggtgtgtttttcggctttgttttagtatgactcagggttgccaccatgccttgtacggtctcctagtcatagtattaaagtttccgcttagcaggaaaccagaaacttcctttcttctcccccagagtcagattcaaaccagtgtttctcaagtgggctgtgaaagtagcttgcagccacccaccttgcaaagaagaaaattcaacagaggagaggagaaaatgcccacagggtacatggaaagccttgctaaagaagccgcatgggcaaagcttttgttccgctccctctgtcccggtgggctgggctgagatataatatatgtttgtcattgtggacggcagctggatgagtctgaaagcggttgcaaacccctttaattcactttgctttctcaactttgaatggtgtcgtgggctggggtgggtcccctgtttttgagaatcacctgaaagagtctgattttctgcatcttttcggggagtaaagctgttgctccaaagcgctgtttaaaagctgataatagtgtatctggttgagctaacagcccttcttgaggaggcagcagactggccagagggttctgcaggcattactcatcagcgacacctgagcttgcccaggtagcctgactcttgtttgtttctgctttgcctgaccctgcaaaattattgtccaaatgcaccctggcaagaattgatccacgaggggatgctgaccagaaggagctttcgtttctgcacgatggactggaacacgatggactggaatgatgacaagaataaacacactgcattgtcttttagggccaatggacttggaggcatagagattttataactactgccagaacccaaatattgccagtcggcctcttctgctgctgttgctagctgtcttcttctgggggaaatgggttgggttctaaatatgaattaacacagggctgtcttcgatgaattcagcacaaaatgttctcagcaattgaacactcggagagaagtgttaggcatttagtgcagactcatagaatagcaggacagggagggatttggatctgggcaagcaggagatggatatgaacacctgtcttttgagaccgtgccgaggtggcaatgaaggtagaggccccctgtgttgaggtctttactcaagaggctgtggtcctttgggactaacatagcatccgatagacagacaagatggacagctacagccacctatgggaagcggtttctactcttaaaccacaagcccctagacactcatcatatcataaacatatcaccgggcagtggcttgcaatctttttttttctttgtttctttttttttttttttttagacttgcccaggccggagtgcagtggcacgattgtagctcactgcagtcttgacctcctgggtgcaggtgaatctctcacctcagccttccaaggagctgggaccacaggcatgtgccaccctcagctaatttttaaaatctttttgtagaatcggagtctgactacattgcccaggctggtcttgaactcctgggctcaagcaaacctctcgcctcagcttcccaaagtgctggggttacaggcgtgagccaccatgctcagcctgcaatcattttttttgagacaggatctcactctgtcgcccaggctgaagtgcagtggtgtgatctcagctcactgcagcctcgaacccccaggctcaggtgacctgcccaccttagccttctgtgtagttgggactatgggcacatgccaccacactcaattaatttttaccttttttgtagatacagagttttgttctgtcgcccaggctggtggacatattttaatcctacagagtccaggctaaaaacacaccagtaactgtgatgtccatccctcctgcattcctgatttctgagtgatggtttcagacacaaacctgcttgaccaccctccagtagctcttgctgacctagatccgaggttctcagctttggccccgttgcgggaagcttggaaacgtcactcttgcccagggttacctgggtagtctggtttatagacgtgttaggtgttttaatttttttttttttttgagacaagattttgctctgtcacccaggctggagtgcagtggtacagtcatagctcactgcagcctcaacctcctgggttcaagcagcccacctacctcagcctcgaaagaagctgggaccacaggtgcacctcaccatacccagctaatcttttctttctttttgtttttttcttttctttcctcttcttttcttttcttttgttttctcttctctcttttctttcttcttcttcttttttttagacagagtcttgctgtgttgcccaggctggagtgccttggtgcaatcttggctcactgcaacttccgcctccctggttcaagtgcctctcttgcctcagcctcctgagtagctggaactacaggcacgcaccaccacgcctggctaatttttgtatttttagtagagacggggtttcactatgttggccaggatggtctcgaactcctgacgtcgtgatctgcccacctcggcttcccaaagtgctgggattacaggtgtgagccaccgcgcccagccttttttttttttttttttttaaattacagagtctcactctgtcaccaggctggagtgcagcgatgcaatcttggctcgctgcaacctctgccacccaggttcaagtgattcttctgcctcagcctccctcaggcgtgagctggcacgcccagccaaatttttcattttttgtagagacagggtctccctatgttgcccagtttagtcctgaactcctgagttcaagccatccacctgccttggcctggcaaagtcttgggtttataggcgggagccactgcatcccgctattaggaatttttaaaaagcccctcggagggtcttcatgtgtggctgagttgtcaagaatcattgttattttactagatattctgtttcttccctcctacatgagatttcccatgaccgcctctcggatgtgaatgtctatgccatggattacatttttcaaagagcattcagtttgttatttcatcttcagcgagcccttaagatatttctcatgggccttttgtagataaagacactggggtcagagagttcaggagcttgctggtgatcacatggtcagcatggggaaaaatgcatgtggacatgagttctgttggtggtgagacgtgggcacaggggttgctgggcttgggagttggtggctgcgtgtgtgggctgaacagagctccccaggcacggccttgtggaccttgagggatgcctgccttcaccactagtgtgacttgaaggggaggagaatgtcctgaatcagtgatgggcattttgatatggaagagaactcccttgaatcctggtggtgaacttagaccagtcactgaggcctctccagctcctcagggtctccgtgttctaggtatccatgtgtccttccatccatttatccatccatttatgcatccatgcatccatccagccatgcatcctccttttatccatccatccatcaacccatcctcccattcatttacccatccatccgttcgtccatccatccatccatcaacccatcctcccattcatttacccatccatccattcatccatgcatccatccatccatgcgtgcatccatccatccatttatccatccatccatccatccatccgtcgtcccattcctttatccatccgttaatgcacctgtccatccatccatccattctccattcatctttccatccatgcatcatccatgcatccatccttttagttcatccagccactcatcaattgatacatccatctgtccaccatccactcatctatccatccattcacccatcctttcatcaatttacccatctaccatccatccatttatccgttcacccattcatctatccatctgtccatccatccacctatctgttcatccatccatccattcatctatccatccatccacctactcacccacccacccatccatccacccacccaaccatccatccacccaaccatccatccatacctccatccgtctacccacccactcatccacttaactacccatccatccacttatccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcacccacgcatgcatccatccatccatccatccacccacccatttacccacccacccatccatccacttacctgcctgtccatccaccctcccagtccatggctctttcatgtattccttcagccagcataggttgaagttaaatgtactattggtgctatttgctgtggtccctgttttttgttctctgctttggaggtaacaaccagggcatcaatttgggcataaaagcaccactgtggatggaaggcctggatgtctggaggcacagagcagggactacacttgttcagggggtcagagagagttctcccaggaggggccctccctggacactgagcttccaagaatgagcagaggaaaccaggtgtaaggaagaggaagggtgtctcagcctggtagacaagcaggaagagtgatgatggggcagctgcagttcatctcagactagaggagctgcaggggccagatggtgggcaacctctgttgccactgctgaggagtgcagatttaagctcccctgaagggtttgacgcagacagctgtgcggggacgcttaacctgcctaaggcccgtctttgggtaacagcatgcagaacaggtgggaggggctggggctatttttggcagagcgtggataagtcagtggagatagaagagaaggcacaagctattttaggagatattgaggaagttaaaatctgtaacaggtccctgcctgcagagttgaccacacgtttgcatcacatgggtaggctttaaaatatagatgcctgcatctcaccttggaaagtttctgatttaattagcctgggcatcaggacttaggaaaaccccacagatgtgtgtaatttgctgctggagttgagaactggggtgcggagctgtgctccttaaactgtaatgtgcttacagatcacctctggtaatacttgtgagaaagcgcttcaggtgggctagggagaggatcacggagggcttcctggagaaggtgacattctcccagggccttgaggggtgaatagacattttccaggttcagaaagaaggaatgggctttcatggccaggtagaggatccaatgaggcagacgaggggcccaaattctgtgaccccctacccctaccccacccccaggatgcccctgtatcagtcccatggtgtaacaaccaaattcacaagatgctgcagaggggaagagattttaaattttctgagaaagacaatgatatattttggacaccatgagaaatactgttattaacttgttttaacctaggtacacgcaatcttcatcattcagtgattctgtatttgtgacttgcctgcttactaaaatgtatttgtcatccccacatcaatattcctggcatttaatttttttattttaaactttcattttaggttcggggatacatgtgaaagtttgtgacttaggtaaacatgtgtcatgaggttttgttgtacagattatttcatcactgtggtattaaacccaggacccaatagttaccctttatgttcttctccttaccctcggctattttgttcatgcacagaacggcaaaaaaattgaactttttttttttattttttttggatggagtctccctctttcgccaaggctggagtgcagtggcgtgatcttggctcactgtaacctccgcctcctgtgttcaagtgattctcctgcctcagcctcccgagtagctgggattacaggcatgggattacagccaccacgcctggctaatttttgtatttttagtagagacggggtttcaccgtgttggccaggctgctctcaaactcctggcctcaagtgattcacccgcctgggcttcccaaaatgctgggattacaggcgtgagccaccgcacctggccagaattgagcttctcaatagcacatgttctcagctgaggttcaacaaagccagaccctgccttctcgggccagcgcgtactgtcaacagggttctttgcaaggtctatttggtgtcccgtgttttgtgttttcgtgctttttgtcagtgattttgcgctttcaaatatccccaagtcggtgctgacatgctacctagcgtccctaagtacaggaaagctggcatggtctcacggggaaaatacacatttgatgagcgtcatttaggcacgagttatagtgctgttggcttcgagatcaatgtgagtgactccacaatgtctattcactgcggtgtctttaaacagaaacccacataaaacgcgcttaggtagtgattggttcatgacctctgggaacgtagtcctgtatttacgtgggagcaatagttcactattcgctaattcagtgttcgctgagactttataaaacgtaactgctttgaataacaaagctgtaattaacaaaccgagctgttaagtgtgtgtgtgtgtgtgtgtgtgtgtgtgtgtgtgtgtgtgtgtgtgtgtgttggcctcacatcattttacagagacacacagggctctgtgaactgctaatagttgggaccggcggaggggttatttcaagctagtccaaaactgcagggcagagaccactttgaaaggagatcagcagtcggggagtggctgggatgaagttggaaaaagtgctgaggcccctaagtcagtttccggtgtttccacgttagccttggggggtgatcactcagtttcctgtagggatgggatctgggctggcatctgcctgtggaaggggtgacagggacggagagcagggaaccccgagcagccctgccttgctgttgtctgagcctcagaactcctgaaggcggggtccttcagcatcaccctggagtttgttaaaaatgcaggctcacgagcctcaccccagaccacagaacgaaaatgtctgggggtgagacccaggattccacgtctccccaggtccctcgcagggcgattctgagaactgccggtgtgaggcgtgctcagcccagcccaaacattcacaccattctttggcctcttgtaaaacttggcgtagctcaggggacattcccagagttatggcacacgaacaaaagaaagtttcccacttcttaccaaacatattgtaaaattacaggaaagagcttgttctttcacgtctatacccttgtgccgtcgtcctagttaggatgaagccgagatgttaccttgtaccttaggccaccgcagacaaggaagtatatgcagtttaaccacctgcatataatctttttcttttttcttttctttctttttttttgagacaaagtctcattctatcacccaggctagtgtgcagtggcacagtctcggctcactgcaacctccatctgccaagttcaagagattcttgtgcctcagcctcccaagtagctggaactacaggtacacgccaccatgcccagctaatttagcagagatggggttttgccttgttggccaggctggtctcgaacccctgacctcagtgatctgcctgcctcaacctcccaaagtgttgggattacaggagtgagccaccatgccctgcctattttttggaggcagggtctctctctgttgcccaggctggagtgccgtggtgcagtgtcagctccctgcaatctcaacctccacaagcgcaggccatcctcccgcctcagcctcccaagtagctgggaccatgggagtgcgtcacaacacctgtctaatttttgcattttttgtagagacggggtttcatcatgttgcccaggctgctgttgaactcctgggctcaagcaatcctcccaccttggcctcccaaagtgttgggattataggcgtgagccgctgtacccggccacctatgtataattttcaagctaagaagacagagagacgagtttaactattgctacagacatgaagcccttccctttccatagtttgctagcagagagtgtttccagggcccggcggccactatcacccactgcgttcatagctttccatggggtgaacagattgcgctggactcagcggttaaatctaaagtgtaggatgtttggtgaactcggagttccttgcacttgtctgtgatctggcacattgtgttttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgccagatttttttaaatgatgtgtttatttcttttaattgacaaatacacattgtatgtgtttatgtggttgcacatggtgtcttgatgtatgtatccatggtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtctgcccggtgttaaatgacacatcttgaaaaagaggacaatacttccagagcgattcggttttatagcaacagaaaagtaagggtgttttgaccatttgaataaaatagtaaaatgaaatgtatcagctgcctcctgctattcccacacaggaggacttccggtgcttgctccaatgtggaggcattttctcttgcagcattctgagctacaattatctctaggctggggacccttcccgaggccccccaaacctggaatgaaagtttttagggtcagaccatgtgactggttccactcgacctccaaaacgttaaaaagaaaaaaaaaaaaaaagagccgggcgcggtggctcacgcctgtcatcccagcactttgggaggccgaggcgggcggatcacgaggtcaggagatcgagaccatcctggctaccacggtgaaacccagtctctactaaaaatacaaaaaaatcagccgggcgtggtggtgggcacctgtagtcccagctactcgggaggctgaggcagcagaatggtgtgaacccgggaggcatagcttgcagtgagccaaaatcgggccaccgcactccagcctgggtgacacagagacactccgtctcaaaaaaagaaaaaaacaaaaaacaaaaaacgctttgcctttgcttggcatcagaggactcagcagcgagtaaagagcacacacgtgccctctgcaccacctcctcctccttttctacaatgtcctgaaagtttcgtgtttagtgggctttggaaaagggtgtggaaaaccagcaggagcagatgagtactggagtggccagcagcaggtgtgaacaccctggggtgatgctggggctgagtgaattggacatttttcagcagggacacccaggccagtggcgggtcttcatcctcccacccttaatggagatgaacggcattattgagaaagctgcaggcacacacagagcactgcttaaatgatgtccctggctgctgctgttactatgtaatgattgtgttattcttatgaaaatctgaaagttacaggaatcttggaactgcctaattttttttaattaattaattaatttatttcgagacagagtctcactctgtcgcccaggctggagtgcagtggtgcgatctcggctcactgcaacctccacctcccgggttcaagcgattctcctgcctcagcctcccaagtaactgggactacgggcgtgcaccaccacgcctggctcatttttaattttatgtgaaacacctgaatgatgtgatgatggggtttaagataacccaagtgttcgggcgcggcggctcacatctgtaatccctgcactttgggaggccaaggcaggcagatcacttgatgcccggagtttgagaccagcctggccaacatggcgaaactccatctctactaaaaacacaagaattagctggatgtggtggcacatgcccatagtcccagctactggggaagctgaggaaggagaatcacttgaacccaggaggtggaggttgcagtgagttgagatcatgctactgtactctagcctgggcaacagagcaaaactctgcctcaaaagaaaagaaaagaaaagaaaagaaaaaaacagcaaaaagagaacccaggtactggctctcctcctgcgtttgccacggttgagtgcattcctgcattagtgcaagccttagtcacgttgcagaggaactcacacaccccatgtggcctcggggacttcactctgggttcgtcctgttttttgagttgcctggctgatgagaaaaagtaaacatggtttgaatcagtagaaagtgtcttgtcagactgactcatgccatctgtcgtccgttccgccttgccctgatgagccattaccctgtcccggaaacatctggagctttgagagggccgggtggaaacagcagtggcagttgggggttctgctgagggtctggtctctttgcaaatttgcagagaggctgaatgccgtaaacgtgcaacacaggcacctgagttctccaccaggctccttctctgagggcatggttgcagctcttgctgggtgggttttgttggtgttttcttcacatttgtagccccggaggtcgttttcaggagcaaaaaggcaagtgggggtgtctgctgtgagcccgcaatttcctgcctaccacctgaaagctcagggaatgtgatgaattgggagatgaatcctaggcaataaagagagcagtggactgagttaggagacgatagcttcatttacagagattcctttactgactgatgatcattgattgggtttgcttccccatgaggcttcaagccaatagcacgtgcatttgcatccatttatatacacctgggggactgcctccctcacacacacctgggggactgcctccctcacacacacctggggaactgcatcccttcacatacatagggaactgtgtccctcacacacctggaagattagcctcagaggtgtctgcagtaccagattccaccagggagtgaacgtctgattatgggtgattcagggtgcccacgtctatatgaaatcgagagcgggtcacctccctttcctccctactctctgtggggtggtgtttggggagctgtcttaagtgttagtcacccgaggagaaaatggtgagggtgggactctgtatctgggagaaaggagaccttggaggcaggggacagactgacagagccttgagcgatggaagctgaggtcgagggcccaaggtcgatgatagaatgcttggggttgtctctcctctggtgtccttgtccttcaggcatcctggagtgacattgaaattgtttcaattaaaaactgtagaaacagcacagagataagaatggaagacaagctccaagtgcggggctgaggcgagttctccaagggctagggctaagggcagagggtgggagaaggggagaagggcgtgaggggcatactgtgtcctttgccacccactctcagacttgttgtcttggacctccgtcggctgagcttggggtccggggagcagtgggtttggacactcagtggtgacgtcagccgtagtcctgaagcagaggggaagttggcaatccaggcttgcctgggggtgacactggtggcgggagggcctgtgccctcccctgtaactgggtttgtgtggggtccatgggggcattggggtcagtggaaggaacatgaagtgagccagagcatcgtcactgtggcctctgagggcaggtggagcaagaaaaggaggaagcttctaagtgacacctggtcccagctcagtggctatgaccagggaagtcatgtggaggaaaaggctggtggactctgagggtgatggaggaggatgggaggggcaagctaggctggggaggtggcaggccatggacacacaccagacagacacacatgtgcatgcacacatacacaggcacatacatgcatgcacactcatgccatgcatatatgcatgcatgcacactcatgccatgcatatatgcatgcatgcacacgtgtgcacccacacagcaagtcacatgtgcacgtgagcacacatgaaaacacacaagcacatgcacatactcctgcagtgcacatgcacacccatatatgcatgcacacaggtgtgtgctcagatagcaccctcacacatatgcacacaagcacacaggcaaacacgcagacacatgaacaaatgcacatatatattcatgcagtgcacttgtgcacatatacacatgcaaacaggtgtgcattcagcacactcacaatgcacatgaaaacacgtgtgcacacacatgcagtgcaatacatatatgcatgcacatgtgtgcccacaccatacacccacacatacgtgcaggagcacacacgtgcacacacagaaaccacatgaatgcatgagcacgcgtatatgaaatacacatgtacacatgagcacatccacacgcgcacatgcatgaacatagacacacacatgcatgtacatagacacgcacatgcatgtacatagacatgcacacgtatacccaggccctgcattggaaaaaatccaaaatgtggcttggttgcaaagagcacatgaagagctgttgaatgcagaggtgcccagcaagaagcatggacctaaacccgaaggtggttgggggaagcttggggacacctgggtgggcaaatggcccccctgaggcccagggacagatgcaaaaacccagcaagccaggagggtctttgaaaaaaaaaatgtgtaccacatgtgacatttcccatgtgagggaagcatcgagatcatactgtgttttccctgtgccctgcgattttgcagctgacatgccctttctgtggaaatatatagcagtcctcatgctaggattgcgtgttctgtgtcaggcagctgggcatgggagtgcagggtgtggggtggaacctgggaggagagttcctagttttaccactgtgttccggccgtggggtgtcctggggaatggaggccacctcctgacactggagtttcctgggttctgctgtgagcgaggagtgggagaagacaagactctggtcttagaaaccttccgagtctcgtacgcccttgactgccgtttctgagtatttcctgaagcttgggaaggatgagtcactttcaggggattgtcctatgttgctttgttttgtttctttagtgacggtgtctatgatcatcttctttttatgagggtgaaattacagaaataagaagggttacacttaaaataatatctgtactttactttcacgtgtggggtttttttttgtcattgctgctgcttttttttctttaacattctgacagttctgtctgcttattattaagtcttcctacctttctaaagagaatgtctttcttgctaaagaatacattatggactcttggaatctctttgttggggtggagggggtggggacttgccctgacttgctgggaatgcccatagggtttagaagtcacgtctaccgctgaggcactaacaaaggtaagccttcaaggaagcactgtcatttccggggaagagagttttgaggaaattgaaacagttacgaattgatctagcagtccctctactaatgtatctacatatgaagatatgtagagatgactttttttttttttttttttttttttgagatggagtctccctctgtcacccaggctggagtgcagtggcatgatctctgctcactgcaacctctacttcccggattcaagcgattttcctgcctcagcctcctgagtagctgggattacatgcgcatatcaccacgcctggccaatttttttgtatttatagtagagacggggtttcaccatgttggttgggctggtctcgaactcctgacctcgtgatcctctcaccttggcctcccaaagtgctgagattacaggtgtgagccaccgcacccggccccagagatgacttctaaaccttcagggtattcccagcaagtcagggcaagtctatatatatataatatatatatgtgtatatatatatttgtataaatatataattcgtatatatagtatgtatatatagtatatatagtatgtatgtatatggtgtgtatatatgtagtgtgtgtatacatagtatgtgtatatacagtatgtatgtatatagtatgtgtatatatagtatgtgtgtgtattatatatatatatagtatgtgtatgtgtgtatatatatatatgtttatttgggataaggaaaggaaatcagtatgtcaaagagacactcccctcccatgtttattgcagcaccattcggagtagccaagacatgcagtcaatggaagagcccatcaagggatgaatgcagaaagaaaatgtgctatatcaactctgtacattcactaaaagccattcatttgcacagtgagaataagtgcctttcatgctatgtaaactatgcctcaataaagctattaaatgaacaaagaaaatagggtatattcacaatggaatggtattcagctttaaaaaagaaggaggttggctgggtgcggtggctcatgcctgtcatcctagcactttgggaggctgaggcaggtggatcacctgaggtcaggagttcaagaccagcctggccaacatggtgaaaccccgtctctagtaaaaatacaaaaaattagctgggcatgatgggcgggcgcctatagtcccagctactcaggaggctgaggcaggagaattgcttgaacccaggaggcggaggttgtagtgagccaagatcatcgcactccagcttgggcaacagagtgagactctgtctcaaaaagaaaaaagaaggaagtcctgccatttgcaacaacatggatggaactggaggacatgatgttaagtgcagtaagccgagcacagaaagacaaataccgtctgacccaaacacgcttacgtggaatctaaaaccactgaactcacagaagcagagtggaatggcggtgaccaaggggttgggagtgaggggtgggggaaatggggaaatgatgggtaaagggtacaacatttccatcagataggaagggataagttcaggggtctactgtactcagggtgactgtggttagtaagaatgcgttgcatacttgaaaatgcctaagacagtagctttgaactgtttgcaccacaaataaataggcgaggtaagatgtaaataaagaaaaaaatacttcaaaaaatacaattacagatttctatggaaacatatgaacatgagtgcatatatatatttatatgtgcgtgtgtctgtacctgccttatggtttattctggatcagtaggatcctcccttgctaccgtctaaagatctgccgcgtgctgcaggaggagctgtaattgcatttatgatgtctggcaagtgtcctgttgtggaaacagccatttcagggctctgaggttgtggaaacgactccactctggttgccggcatggggcccacagagctgttccgagcgttttgtctactttctacttattgttgacacacacagaaacacacacgcagccatgagtacacacacacacagacatacaagcagacgtggacacacctacctgtatgtacatactcaaaacacaccttcacactatactcacctacccatacacacacgtgcacacaactacatgtgtgcacacaaacacatgcatacatgcacctatgcatatgcacacgtggaaacacacctgcacactacacacacctacacatacacacacaaacccacaaatgcacacacccacacaggcacaaacacacaaatgcacacacccacacatgcacaaacacacctacacacataaacatattgacacatgcacacatgcacatgaaaaacacatatacacactacatccgcctacacatacacacacaaacccacatatacatgcacctacacacatgcacacataacacctacacacatgcatacagaacccacacatacatgcatccataggcacacagaaacacacctacacactgtgcacacctacatatgcacacacaaacccacatgaacatgcactgacacatatgcacacaaaaaacacactacacacacagaaacccacaaaatacacctccacacttacacaaaacacgcctacacatatgcacatacacaaacccacacatacatgcacctgcctatatgcacccacaacacatacacatatgcacacacagaactcacctacacaccccatacatgcacacaaaacccacaaatacatacatgtgcactgcaaatgcccaaatatacatgcacactcacacacacatacccctgtgacatatgcatgcacgcttcatttatacatgcaggagcatagcctggtcgtttgcacctgttgtggaactggacacacttccggtgttcacagggctcctgcgggttgttcttggacccctcgccacccaccgccaggtgcttcctgacggttgagagatgttgtatgcctttggtgctgaggagtggggacgctggatgttgacgattatcctaactcttcctccagttgaccaaacagtccaagtcgacttttccaaattttcctgaatttggcttttcttcagtgcgccagagatggccagccacgttgaagtagcattgaaattgttgtaattaaagactgtagaaacagggtagcctatcaataattcagcatgccagtttcctcattccgtgggattccatgagatttttttttaatgcataatgcacgtgtctttctgggttgtctagtgtttctactatattttggtttgtaattacaggaaagttgccaataaaaaagggagaattttgttccccatgttgttttcagtacatattcaaaattgttattcatctgtttgaaaggaacgacctgttaagaataatacacaaaatgatcgtgtttttacactattttaatttctactaagcttgaaggtcatcatttatttaaaacctaggctaacatattcttacttttaggcatggaagtgaatatttagaatgagaagagaaatcacgcaccttgtaaatttttttaagttgctgttttaaatatcacaaaaagaaaaatcgcatatcttttttatctctataatattcaaatttatttttatttttcttgtttctaagttgactctttttttctctcttagatggtggtttcgatttatctgatgcccttcctggtgagtatcaacatcattttttaaaatcccgtcaatattttatgttaacatagtatatacaggcatatcccagccatttccagctaggttctagaccaccgcaataacaggagtcatagcaatttttggcttcccagtacatataaatgttatgtttactctcaactgtagtctattaagtatgcaatagcattacctctaaaaacagtatactccaattgaaaataccttattgctaaaaaatgcagatacagagacaggaagtggggcacgtgctgttggaaaaaatgatgccgagagtctggcttgccacagggttgctgcaggccttccgtttgtaaaacacacagtatttgcaaagcaccttaagacaaagtgcagtgaaggaggtccgcctgtatgtgtccacctgccttattataaaaactagactcatagatgacgaggaaaagcaagatgcccttgttaagataaatgaaccaccctggtggaataattcacagtcctgtgatggtcagaggccgagcaaaaacttgccaggtccttggggaggggtctagaggaggtgagcaaatggaggtccccaggagagaggggcatccagtgctggcatcctccctctcgaaatcggcacccgctgtctccatggggccactccttccttcttctgcagctcttcctgtctcccgctcctcacccagagccctcggtgaagggcatgggaaaaggaattgaaggaattccgtcttatcactctatcagcttctgggtcttgtcatccctttgtatttgttttccggggctgccataaaaaggtgccaccaactgggggcttaaaccacagggatttatcatcttccagacctggacaacagaagtctgagatcaaggtgtagacagacccatgctccctctaggggctctaggggagggtccttcctgcctcttgcggcttccgggagctccaggtgtccctggacttgtggccgcatcactccagtctctgcctccttctccgtggggcctcctcctctgtgtctgtgtctccttttctttgtcttacaaggatacttgtcattgggtttagggccactctactccaggattatctaatctcaagatccttctcttaagcacatctgcaaagaccctatttccaaataaagtctcattaccaggttttaggctttaggatgtagatatatcttttgcggggaccactgctcaatccactgcagttatatccagttctttttggtggctctaggggaggatccttcctgcttctcccagcttttgagggcttcacgtgtccctgtgcttgtggctgcatcactgtaggctctgcctttgtgaacgctggtctcttccctgtgtctccatgtatctaaatttccttcctataagggcaccagtcattaggacctatcctaatctattataacctcatcttaactgattacaactgcaaagaccctgtttccaagtaagatcacctattgaggtttggggtgggtgtggatcttggaggaatgcttttcaacccaggacagccctcttcattttttttttttttttttccgagatggagtctctctctgtcacccaggctggagtgcagtggcacgatctcggctcactgcaacctctgcctcccgggttcaagtgattctcctgcctctgcctcccgagtaactgggattacaggcatgcaccaccatgcctagctagtttttgtattttcagtacagacggggtttcataatgttggtcaggctggtttcgaactcctgaccttgtgatctgcccgccttggcctcccaaagtgctgggatgacaggcatgagccactgagcccagccaccctcttcacttttttatgttttacttttttttttctgagacactgtctcgctgtgttgctcaggttggagtgcagtgttgggatcttggctcactgcagccttgaccgtctgggctcaagcagtcctcccacctcagcctgctgagtagctgggactacaggcatgtgccacctcacctggtacagtgagcaacacggggtctcactgtgttgctcagattggagtgccacggtgggatcttgtctcactacagccttgaccatgtgggttcgagcaatcctcccacctcagcctcccaaagtgctgaggcgtgagaggattgcagacacgagccactgcacctcgccagcttttaattttatgtcctgtggtgcagtgcagatggtttgagcggaaacagtgctgatggggatcatctctttcctgaccacctaccccttcttggcccttgggaacaaccattccctgcagtgggaggtgcccttagtcttacagcctccacctgatttgcctgattggcttccattctcagagggggcagcctaggcagaggcctgacggggccaaaagtgtgtttcatatgagaaatgtgaacagcctttcagccatcaatccggtgtctctccttctcatgcatagatctcgggctctgaaaagggcagtttttctcctaactttgccattctcctgccttcctggcttatgtctcagtcatagtcccattcaacgtcaagaagtggagaagggctgggcacggtggctcaagcctgtcatcccagcactttgggaggacgaggtgggtggatcacctgaggtcaggagttcgagaccaacctggccaacgtggtgaaaccccatctctgctaaaaatacaaaaaattagccgggagtgatggcatgcacctgtaagcccagctactcgggaggctgaggcaggagaatcgcttgaacccaggaggcagaggttgtggtgaacggagaccacaccattgcactccagcttgggtaacagagcaagacttggtctcaaaaaaaaaaaaaaaagaagtggagaaggggctcctggtctctgtggaaaccatggccggtagcagcctctgtgtctgtcttctgggctcaagagtcgttctataaacctcagctcggtgtgggcaggtgagaaaaaacaatgctaaaaacattctccgactgtttccaagaaaatgaaacatccttaaccacaaaagagttgacacttgttttcccagctgcaacttttactaactgaaatatcttatctctttagacaatgaaaacaagaaacccactgcaatccccaagaaacccagtgctggtgagaagggcttcttcctagtatgcaaagaaaaagagcaaatcattttctcggacagcaggacgggacttaggcaactagaaagaagacagaagtgatttgagtgctccggctggagtctggttaatagttaatactggaattgtgttatgatgttacatttcatgtagtgattccagtaaaagaatggttgctgatgtgaaatgtttcggggccatttggacaacatctctgtgtgcttttattctaagggtctgagttactctgtctttagattttcttcccttttttttttttttttttttgagatggcgtttcattcttgtctcccaggctggagtgcagtggtgtgatcttggctcactgcaacctccacctcccgggttcagtgattctcctgcctcagatgcctcagtagctgggactgcaggcaccagccaccacacctggttaattgttgtatttttagtcgagacgaggtttcactatgtcggccaggctggtcttgaactcctgacttcaggcaatctgcctcccaaagtgctgggattacagcggtgagccaccatgcacggcctgtgtctttagatttcaacttcctaggagagagagcatttggtgctgagatctcccccatgatgaccaacaagtgaactcatctctcaacctgtgggcacacacctcatttgttctcagtgcttgctgttctttctttctttttttttttttttttgagacggagtctcgctctgtcgcccaggctggagtgcagtggcgcaatctcggctcactgcaagctccgcttcctgggttcacaccattcttctgcctcagcctcccaagtagctgggactacaggcagcggccaccacgcccagctaatttttttgtatttttagtagagacggggtttcaccatgttagccaggatggtctcgatctcctgaccttgtgatccacgcgccttggcctcccaaagtgctgggattacgggcatgagccaccacacccagccctcaatgctgttctttcaaacaaaagtcagaaacgaggtccacgtgatggaattgcccaagggtcaaccccactggcggataaacagagtaaaaatgatgctaaaacttatggcatcagtgtcttacagctaagacactgtcttgtcttagcacttctgagttttctaatataaaacattaatagctccacttcattattgggcttcctgtctagagtgtcagctcatgagcaaagggaccctgtgtccccagatccttgaactaagcaatcatgcagatagcaccaatgagtaggtgttgagcgtctgaatttatactatcatagtctccttgaggaagggactggaaattcccatatgtcactcaggatggctcagtacatgctgttgggtggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatggtgagtattttcctttaatctcttctgctgctgatctgcttattatcacccaattatgatcatttcagagagaattctcccatttaaattataaagggaaccagttttcacagtggaaacctagggaataggtgtgtcggtttgttcttgctgttgtcgttgggtttttctttacaaccagtacgtgtgcttttattttaaaactcttacagtctttggaaggacatgagacaaatgtgcctaccctggccagggctggcttcaccagcatgtgacctgtgcagtggcacaggaccccatggcatgttggtttggcatgggaaccatactggtttactgctctgttgccgccatcttggaatacttaagaaaatttgaaaaatgggtcccacctttttattttggccctagaaattctgtagctggtgtggacacccgctttaatttttattaaacatagttgacattaagaactgtggctgaaagttgatgggaggaaactggcaggagactgtgtgtgtacaggtatccccaccaggacaaaggccaaggtccaatttctgttcagggaaccatctgtgtgtaaactgatgtttcattttctttactgcaaggcacttaaaattgcaactctcatctttcacaaacagacgacccacgaccaccgaacccacccaaaccgatgccaaatccaaaccccaaccaccctagttcctccggtaagagtctctgaccctgtgggatgtcttcatgttgttcagaattcagcgatatttatgtcagctgagaggaggtgatttcagatgagtgtgtgcttactgttgactgcctgtgcagtgtaatgcccatgttcatgtaatggaaaatgtacatttcaaaaatatatatttagcttggattttatttttagtttgcttttttttttttttttttttttgagacagagtcttgttctgtcacccaggctggagtgcagtggtgccatcttggctcactgcaacctccacctactgggttcaagtgattctcctgcatcagcctcctgagtagctggaattacaggcacacactgccatgcccggctaatttttgtatttttagtagagacagggttttgccatgttggccaggctggtcttgaactcctgacctcaagtgatccacccaccttggcctcccaaaagtgctgggatgacaggtgtgagccactgtgcctggactagtttgctacttttgtttccaagttccatcttatggaacttctaaaaaattgcatacaataatttaaatgtagacttgataaagagaaaagtattggcatacacattccttgtggagaagctagtgtgttttaaatctttctgcccttaaatatttaagtcagtttttctgacatatcacagcattttcagcgtaattcgaatagcaccagttttttttttttagctgaatggttgtcgaaagtttatatgtttaggtttttttgtttacatatttaatttttaacacagaagaatattaatgatgtccatatcttgttgacattttgatggctatttgtgctagtattttatatatcttttttttttcttttttgagacagggtctcactctgttgtccaggctagagtacagtgctgtgatcatattaaacataagagcataccacagcctccaactcctgggctagagagatccccctgcctcagcctttcaagtagctggggctacaggcacacagcatcgtgaccagttagttttttcattttttgtagaggtggggtctcagtatgttgcccaggctggtctgaaactcctggcctcaagcagtcctcttgcctcagcatcccaaatctctgagattacaggcacgagtcacctcacccagcctatatattaatctaaatgaaataaattttaaataaagttccaagtcttttgtttgtactgcattgtaacattactttttgcttactgatagtccatgaacattttttcatgtcatgtaatcatttctatcgtatgagttttactgataatcatgtactattacatactacatatataattatattcttcctgtaactaatccctaattctgaaaatgttatgtttcttctggcattttagaattatgaattaacaaagcaaatctgagtcaactccatgcgctatttttattcctttgaagacatttctagcattcaaatagtttagatcaacgtatatgagtactttcgtagcttttgacctggttgttaatttgctgcagatttttaccaatttattttgatgccaggggtgtgtgcaaatgtccctgtcttcacaccatctccaatattagttatcacctaggaaacctttgcaaatagtgtgaaattttctatcaactttctcctggtttcatgactttacttttaaaattaaaaaaaaaaaacaaacctgcatcaattggccgtggatacttcttattttgtgtattgtatgctttgccttttattcttacattctgatatgacattattgatttataagccttcttcatttatttacagacataaatattgccagcatgcaatattatgctcacgtttttccactttatttatggttttttgttttgttttgttttgagactgagtttagctcttcttgcccaggctggagtgcagtggtgccatcttggctcactgcaacctccacctccagggttcaagtgattctcctgcctcagcctcccgagtagctgggattacatgtgcctgtcaccacatccagctaatttttatattcttagtggagatggggtttcaccatgttgatgaacaggccggttttcatgagtttttcctttattctaagacatgaagacccttggaggagttccaggttgacaggtgatgctgtattttctttcctaggtagcttttcagatgctgaccttgcggatggcgtttcaggtggagaaggtacagttatcttgttttctgtctcttttctctctccatcccatgatgcccacctgctctgtagaatcactacagggtctaaactgtcagctctctgtgaactcacagtgaaatgttcagccatctctgtgggaactccgcctgtttgctgaggcttcaaggatgtgggaagtaaaggctgccccgtagaggttcggtcctcggagaagagttcagggcccaggcagctgccccacttttctgagggacagggcgtgatgaatgggcccttgtcaccacctcctcacccatccgttcacctgtgtgttcttgcaaataactagtgttgtttcagcttcattttattaggctgttttctgtaatttaaggaatgtgaatattaaagccctgagaatagtgataatgcctgggagtatgcgttctcagagtacccctagagtgtaacaggcagcacctcagctctgtagctgtgtaacatgcacccttagagtgtaataggcaggaccccagctctgtagctgggtaacatgtacccccgtagagtgtaagaagcaggaccccagcctcttcacggtcctggctgtgaatttttccttgaccccaaaccttcccattgcagacgttgtttttgtcttgcaggaaaaggaggcagtgatggtggaggcagccacaggaaagaaggggaagagggtaggtgcacctggcttctgtcttcttgtctctcccacgtggtgttgagaaggggaagcagaatgtctgagagctggcggactgcactggcattggcctcctaaagctactggcaggaggcacgggtgttctgtgccaagtgctcccaagtgatgtagctgcagaggtcccccagcaaaccagccctgctccgggtgcccacgtgacgcggattttatgtttggtcacctgcccacgatgccctggctggcgacccgacccctacatcacgcttcgccttgtccttgtgtttacaaaagctcctacactcaccctaacgatcagaggcttgtgacgcagtatcctcggttgcgcttggcccttgagaacgtcagtaaccaggtgggaggtgggaatgtggatcgcttccaccctggctgtaacaggcattgtgttctccatggaagtgccggtgatgtatctcctgtctcctttttcataaccttttcccttagatgggacaagaaaataatgacagacagaattccttttaaaactgtaaagaaaacaaaatgaggtaagaaagagaaacagagaagtagggaggaagaaaaaagggaaggagggaaggaaagaaggaaggagggatggagagaaggaaggaaggagggaagaagggaaggaaggaagggaggaaaagtgggtagtctacccttgttttaggtatttattatttttatgggtacagttcttgaattctaggctttctttgaagaggtagtaatctgtagccctcacctaggactacaaggtcattttttaaaaaatagctaagaaaacacatgtctggcatgtttatctcaggccatcgttcttggccttctagagagttaatgtctactatgtcacttcatcagggaggggtagttaagcttgaaaaatctttctatgacatgactgtgtcctgcacatattaaaaactggccgagtgaacacaccaccgacaggccatgtttggagccagtgtttttgctgaaagtcagacaattctccttccccgtcgtggagggcggagaagattctatctggagaagggtcctctgaagctcacatctggcatttggaatgaataatctcttcaatggccaggcacgctggctcatgcctgtcatcccagaactctgggaggctgaggcgggaggattgcttgaggccaagagttcgaaaccagcctggccaacatggtgaaaccccttttctacaaaaaatacaaaaattaggccaggtgtggtggctcacacctgtaatcctagcacttcgggaggccaaggtgggtggatcacttgaggtcaggagttcgagaccagcctggccaagatggtgaaaccccatctctacaaaaaatacaaaaattagctgggcgtgtgccatgcacctgtagtcctagctactcgggaggcacaagaattgcttgaacccgggaagcagaggctgcagtgagctgaaatcgtgccactgcactccagcctgggtgacaaagtaagactgcatttcaaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcaagactctgtctccccgccaaaaaaaaaagaattattgctggaataacataaaaaaaaaaaaaaaggctgagtgtggtggctcatgcgtgtaatcccagcattttgggaggcctaggcagcaggcaggttgctttaggctgggagttcgagatcagactgggcaacatagcaagaccccaattctataaaaccacagtaattaaccaggcatggtggtgcacacctgtagtcccagctactcggaaggctgaagtgggaggatctcatgagcccaggagtttgagattgcagtgagctgtgattacatcattgcactccagcctgtttgacagagcaagaacccatctcaaaataatacacaataataataattaattaaatagagatagatttaaaatgtctgcattgaaacccaaagctatcttcaaggggtgaaaaaggagcattctaacgatacaaaacgcattggcaaatgccccaagcattgcaggtctttgcttctttatcttctgcccctgcctgggctccttcctccaggtttgatgtccagctctctctttcttttttgttttgttttgttttgagatggtgaattgctctgtcgcccaggctggagtgcagcggcacaatctcggctcactgcaacctctgcctcccaggttcaagcgattctctggactcagcctcctgagtagctgggattaaaggcacccacccttactcccggctaatttttgtatttttcgtagagacgggttttaccatgttgaccaggctggtctcaaactcctgacctcaggcgattcacctgcctcggcctcccaaagtgctgggattacaggcgtgagccaccacgcccagccccagctctctttccatctgtctttgtctttttttgtctctgccttggttctgctgagcttctgcccgtacctcgctggcctctcttcatgtctcttttctcctgctccactccctccatggtctgaccaggtctgcccagcacgtgcgatgggagattgtgccttgctttgccttcctgtgtatcattctcggcatgcttcctttgcaaatcggtcagctcaggcgtctgagatgttctgaggatcttggtgctctcagactgactgtctctgccagccactgccccctgggatcttctctgcaccgtgcgtgtctcaatcacgatgctgtgtgcttcctcctgcagccgacgccccaggcgtgatccccgggattgtgggggctgtcgtggtcgccgtggctggagccatctctagcttcattgcttaccagaaaaagaagctatgcttcaaagaaaatggtaagtctcagtccgccggtgcctctccttcatgccttgctgattggaaaactgtgctttctttaaaaggcagaaaccaaactcgggctggcacgaaacaggtgcacgatggctgatggttcgtgaaactgctaaaattctggaatcgaaccttctggctttgatttcagggctgttctgccttgtgttttgttgtgtgaaagtttacaagttccccactgctgcagtgcttgggttgtttacgtctaccaagtgggaaatggttggtacatatgccgcggaattgttgctggggttagagacagtcctgcaggaaagccgctacaagttaccctgcagagagcaaaggtggaagacacttagctctgatcattcctgccctgttatttacaaccgatgtcatcatcaggaggagagccgtgaccagggggccgccacggtcctttctccactgagagttaagttaaaagccggcacaaggccggacatggtggctcacacctgtaatcccagcactttgggaggccgagacgggcggatcacgaggtcaggaggagatcgagaccatcctgggtaacatggtgaaaccccgtctctactaaaaatacaaaaaattagccgggcatggtggcgggcgtctgtagtcccagctactcggaaggctgaggcaggagaatggtgtgaacctgggaggcagagcttgcagtgagctgagatcatgtgactgcactccagcctgggcgacagagtgagactccgtctcaaaaaacaaaacaaaacaaaaaccagcacagcggattccctttctgttagtaccgaaaacccacaggcacccaggacctgggaagtttcttggatcgggactaaaatttacaggggaattaggaggaggacgtactcaccattgcaatcctcctaggtcagctggcaggctctttgggaccttgtattgggatccgccgtgaagctgggaagtaagccctgctatttggaacacagctaacgtgcatgcatcactgggcacttacatttagctcttgccttccctcttgcatgaccaagcattgtggtttgcaggaatcccatcgaccgggaacagctactcttattttttatttcttgagacagagtttcgctctgttgcccaggctggagtgcagtggcgcaatctcagctcactgcagtctccaccccacaggttcaagtgattctcctgcctcagcctcctgagtagctgggattataggcacccgccaccacgcccggctaatttctgtatttttagtagagatggggtctcaccatgttggccaggctggtctccaactcctcacctcaagtgatccacccgcctcggcctcccaaagtcttgggattacaggcgtgaggcaccacacctggccaacagctactgttttatggaggagcccctggggtccctcacgcctctgggtgtctgaacttctcaccctacttagatcttaagtccttattcattcttggtcactgatgtcattcactcaaagcactgcctcctgaagattttagagggattcctagaacatttgaatagatgctggtgtggacaaagttagactgtaggggtggagtttccccgtaatctcccatcattccagcatttgacatccacaaacattatttagagcgtgaaatggagagtcctaaacagctttcggatctcaagactttaaatgagctgctcgtgtttatttccccgttcttgctgtggggttttgggcagtgcgtggaagacagttgcctcctacctggtgggcagacgagtgggaaatggtgtttggttgtttcttttttttttttttttttttttgagatggagtctcactctgtcacccaggctggaatgcaatggctccatcttggctcactgcaacctccacctcccgggttctcctgcctcagcctcccgagtagctgggattacagatgtgcaccaccacgcacagctaatttttgtttttttagtagagatggagtttcgtcatgttggtcaggctggtctcgaactcctgaccttggatgatccgcctgccttgacctcccaaagtgttgggattgcaggcgtgagccaccgtgcccagctggtgtttggttgattgaatggcagttttgagcgggacccaaatggacagatgaccacattcaaggagatgcctgtaagagacgtacgattagaatcacgttggaaaaaagcaaacagcataacattcttctcccctcttgcttcttctagaagtagcggaggggttaaaacagtagggactcaatggaagggaatttttgtttgcttttcaatgacatttctttttcttttctgaaactgttcaactcacagcataatattcaaccaggaggtaaggaaggcttgtttgccaggacaggatgcgtaatattctagatgttgtatttcaaactctctggcttttttttttttttttttttgagacggagtctcgctctatcgcccagaatggagggcagtggtgcaatcttggctcactgcaacctcgcgggttcaagcaattctcctgcctcagcctccgaagtaactggaattacaggtgtgcatcaccacacccggctaatttttgtatttttagtagagatgggggttcaccatgttggacacactggtctcgaactcgtgacctcaggtggttcccccccgcaatcttggcctcccaaagtgttgggattataggcgtgagtcaaagcacccggcctcttttttagaatcccagacaattgttgaacacttttgcattaaactacaaagtctctgattgatgattctctgaaaatctttaggtcaacccaaattggattcatgagttgcaaaggatgtttattaccttgtgcgtgcagacgtaggaacttttgggatcttgtaagcctatttcatattcacatcctgtattagtccgttttcacactgctatgaagaactgcctaagactggataattcatgaaggaaagaggattaattgattcacagttcagcatggctggggaggcctcaggaaacttacaatcatggcagaaggggacgcaaggcaccatcccattatcacgagaacagcatgggggaaccttcgctatggttcagtgaccccaacctggtctctccctggacacatggggattatgggaattacaatttaagatgagatttgggtggggacacagaggctcaccatatcacatctgaagacacacaaacttgggaaagcacccaggaggcttaatagacttgattttgtcaaaaattttgaaatagaattgggaaaaggaaaaacaacttttcctctaccttatccgccccgccacccctgggtcttggtcttgggtggaagcattatctttttttattgcaggaggtggggcaggcatgaacaatgaaagctctcactgggtagaaacaattttcctagattcttcaagaacaaaagcaaatatgtcctggcgaggtggccgacacctgtaatcccagtgctttgggagtccaaggaaagaggattgcttgagcccaggagttcaagatcagcctgggcaacatagtgaaacctcatctctacaaaaaatgtaaaaaattagctgggcgtgcttgcgcctgcctgtggtcccaactactctggaggctgaggtgtgaggattgcttgagcccaggaattggaggctgcagtaagccatgattgcaccactgcactccagcctggacgacagacagagaccctgtctctagatataaaaataaaaataccttttttttttttttgagacggagtctcactctgtcacccaggctggagtgcaatggcgtgatctcggctcactgcagcctctgcctcccgggttcaagcgactctcctgcctcagcttcccgagcagctgggactacaggcgcgtgccaccacgtccagctaatttttcatatttttagtagagacggagttttgccgtgttagccaggatggtcttgatctcctgacctcatgatccacctgccttggcctcccaaagtgctagaattacaggcatgagccaccgtgcccggcccccaaaataattttttttaaaaaagcatcctttctgaagaattggctcaggggagtccaagattcactttatactaatgagatgctaggctaattttcttctaatattttctataagtctcttattctgatgccaaattaacagaaggtccaactttcaattcctggtttgctttctagttatcctgggattgattttcttggccttttgtaaatgcacaaagcaaagggccaaaaagaaaataaaataaagtataacaaagagaagcaagagatggtgaaaccccgtctctactaaaaatacaagaattagctgtgcgtgatggtgggcacctgtaatatcccagctacttgggaggctgaggcagggaattgcttgaacccgggaggcagaggttgcagtgagccaagattgtgccaccacactccagcctggacaacagagtgagactctgtctcaaaaaaaaaaaaaaaaaaagagaaagaaaacaaaaacaaggcactcttctataaataccaagaccctacctcaaaagaggacctttccaactgcatccactcacagcttggtttttatacctgaattataaaatgagtttaatatttatctcagtgacatgattttgttagtagacatggaattgtgatgttggatcgagttatccggaagacgaaagatgtcagagccctcagcctctggggcaggattttgctttatgggttcgatttccgggatggtgattttgagatctggcaaccccataggttcatggggagcttggagatttcataagaaggatgtgagtatagcatgccctggtccttcaagaaaccatgggccaggcgcggtggcttacgcctgtaatcccagcactttgggaggccaaggcgggtggatcacctgaggtcaggagtttgagaccagcctggccaacatggtgaaaccctggctctactaaaaatacaaaaattagccaggcatggtggtgcacacatgtatttccaggtactcgggaggctgaggcaggagaatcgcttgaacccaggaggcagagttgcagtgagccgagatcgagccactgcactccagcctggggacaagagcgagactttgtctcaaaaaagaaaaaagaaaagaaaaaccatgcccagttttggggatactgttattctaccagacaggctcattttccgggactgtgtcattgcattgaaatctgtggtgtttgttaaatttgtattaaaatgagtcccaggcgagtgagtagacataggtgagtcttcggcatctttccaacaaggagatgcctttatcaaatcctgtgacttgatatagatttactgagaagctttgcagtgttatattttggggttcacggattagaaactccttgtggaatcagatggctctgtctgttataggttggtgcaaaaataactgcggtttatgccattaaaagtaatagcaacatagcaagacctcgtgtctacaaaaaacgtaaaaaaaaaaaaattagctgagtgtggtggctcccagctaattttttacctttttttgtagagacagagtcttgctatgttgccattacttttaatggcaaaaaccacaattacttttgcaccagcctccgttcctcccttcctacagatttgagtttgtggtgcttgggcttctcctggtttttgtccatgtgatacgaaggggcctgttgaagctgcttctctcatgcactcggggtctgtgacttcgcatctgggtgtgttggcttcgcgggggacctggctcagaccactaaccgcacggagcctgaccacttcccacagagcccagcttccgtggctggcaaggggtgttcaggatgctgtcctttggctgtggtggctggtcctactgctctgtttgccagggtcctgggctcacagtgggtttcttgaggctttggcaagatgggcgattggctctccctgtctccttctttctctttcttcttctctgcctttcttccttccctcctcctttctttccccctccctccttcttttctctcttccgtccctgcttttctctttcttcctttgccctcagttctccctctctctctcttttcattctttcttgaactctccctctttcttcctccctccctcccttcttcttttcctccttttcctttttctctcttccttttctctatctcttcctttcttccttctcttttcttcttatgtacctctttcttttttctctcttctttccttccttcctttctttccatccctccctccttctttccttttcccctctccatcccttcctcctttccttccttcctttctttttttcctctctattctttgtctctcttcatccatctctccttttcttacatgcctcttttcttccttccttctttcttctctccctccttcccttctttccttccttccttcccttcctccttccctctctccttcccttcctccctccctccctcatttccttcctccctgcttcacttcttcctccctcccttcctccatacctccctgcttccttttttccaacctccttccctcctcgttccttccctctttctgccttcctcccttccttcctcccatcccttcttcctgcttccctcctgctctccctgttccctgcctccctccctgccttcctctgtctctcccttcctccactccttaattttggtttccacttcccactctcacactttgagcctctatcccattacttccttgctcagagcagctctttctaacacctccctgctgctgggagccccagcgcacagcaaaagcagacccagcaccagtttactttttgtattattattttttatcgttttcaaccttccatttcagatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcctgatcttcacactgtaaggcgtgttgggaattggtgggtggtcaggtccctattcacacatttgagcacggagcctctgcggccgtcttccttggattctctcatatccctgaaaaacacaaattgtacctggattttccttctgtttccaaagtccaccaacttgttcttcaatgtaattgattttaacttgttttctttcttttacttttcttatttttttctttcttttcatttttttcttatttcttttccttctatttattttacttttcttatttgttatatgttatttctttttcttttcttacttttcttcttttttcatttttcttttttaaattggagtctcactctgttgcccaggctggagtgcagtggtgcaatcttggctcactgcagcctccacctcctgggttcaagcgattctcctgcctcagcctcccgagtagctgggactacaggcacacaccaccacacccagctaatttttgtatttttagtagagacggggtttctccatgttggccaggctgatctcgaacttctgacttcaggtgatctgcctgcctcaaccttccaaagtgctgggattacaggtgtgagccactgtgcctggccctttttcttttttctttttttttttctcttatttcttttttcttatttgttttcctttttgctttttctttttatcttatttcttttacttatttttcttttttttacttttatttcttctccgtttttcctcattcttttcctcttatttctttgacttttctgatttctttttttttcttattttcctttttttttcatattccttttaattttttcttacttcttttacttttcttatttgccctcttgtggaaatgaggcacagcctcccttatggttgagccgtagttctagctgagcacggatggtttgatcctcctgtgttggggcactgtatggtgtgagggcacaaaaccttgacccacatgggtctggtcaccttctcacagaggtcacctttacagccccccaactctttgaaggatgtgtcccaaggtgtctcaagtctgatgcaatgaaagctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtccgtgatgttggaactgttgccccagatggactttgcccttgtgagactttatacttttcaatggagtttttccctctttaaaactcgccagcttttatgtagtgttttataaaattacaggaataaaaagaatatcttttatgctttttaaccaatgaggggagagggagaaattatttgtcctctgaaatgaatgcaggttttcaatttctagccaggacagtttgctgcaaaatgcacccgtgttgacaacttgtgactggcagaacaaatgacatttgtggtgaacattttcggatcatttcgaatgttcttctcttcagggggttttcctctctttttcttaaatcaaagaatttggccctttatgtgggagtcatttagtggttagggagaacagttgaaactgtggagttcacgtagcataaactggcgaggctgtctctgctgctgtcattaaaagttacgctgctggcttggcacggtggttcacacctgtaatcccagcattttgggaggccgaggtgggcagatcacgaagtcaggagatcgagaccatcctggctaacatggtgaaaccccgtctctactaaaaatacaaaaaattagctgggcatggtggcgggcgcctgtagtcccagctactcgggaggctgaggcaagagaatggcgtgaaccctggaggcggaggttgcagtgagccgagatcgcgccactgcgttccagcctgggcgacagagcaagactctgtctcaaaaaaaaaaaaaaaagaaaagaaaaagaaaagttacgctgctgcaccatacaaacgtgttcctttatgaaggcatttgaaccacagatggggccgttttacaaatagcacggtctttgtgagggggaaacgcatggccacagattcgatgagcttctgctgcttccctttgtgttgaaaacgtgggtgttccttcacaccaacactggaaataaatgaatacctattgatctgtgcatctcttacgcgtttccaattctgttggcttatgctgtgggtcagaaaagaagcgacaccgacaacatttggggacttgaccctgtttgcattgcggcatgtttgaaacattttttaatggaaatttgggaatagagggccgggcgtggtggctcaggcctgtaatcccagtactttgagaggccgaggtgggcggatcacaaggtcaggagatcaagaccatcctggctaacacggtggaaccccatctctactaaaaatacaaaaaattagccaggcgtggtggtgcatgcctgaaatcccagctactcaggaggctgaggcaggagaattgcttgaacccgggaggcggaggttgcagtgagctgatatcgcgccactgcactccagcctgggcgacagagcgagactctgtctcaaagaaataataataataataaataaataaataaataaataaatttgggaatggaaacaagactgggaaaaaatgctggaggaggaagaaaaccgggtacacaagacgccttggctgtcttgtcctttgatggctggggaagctcttagtgctcggagtcctcactcacctctctgcattctgagggaggtagaaggggggacaggagagccaattcaacctgagaaggatgatcggtggaggtgggtaaaggaagaaagtcccctttccctaggtactgaaaagatgctaatctgctgagattctctgtatttatttttatttattttaatttttattttgagacagtcttgctctgtcacccacgctggagtgcagtgccacgatctcagctcactgcaacctccacctcttgggttcaaatgattctcctgtctcagcctcccaagtagctgggactacaggtgcacgccaccacgcccagctaatttttgtatttttaatagagacggggtttcaccatgttggccaggatgggctcgatctcttgacctcgtgatccgcccgcctgggcctcccaaagtggtgggattacaggtgtgagccaccatgcccagcctctgcatttatttttatttatttatttttatttttattttgagacagtcttgccctgtcacccaggctggagtgcaatagtgtgatctcagctcactgcaacctccacctcctgggttcaaacgatcctcctgcctcagcctaccgagtagctgggagtataggtgcacgccaccacgcccagttaacttttgtattttttagtagagacggggtttcaccatgttggccaggctggtctcgaactcctgacctcaagtgatccacctgcctcagcctcccaaagtgctgggattacaggcgtgagtcaccacgcccagccgtctgcatttgtttgatgagtttgggggcagttataaataagaatcttattttcacagatgcacgtactttttttttttttatagaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtggacatggagagccaccggaatgccaacgcagagccagctggtaagaaggacggggaacgatggcttgcacacgtggccagtgttcccattttatcttctccatcctctcccatcttgctgtcctgctcacattctcaaatttggttgcatggctttgaatgtcttcctttatgtctcgttgctttggagggatactttcaaaagacaatgaatgtgtaaacttcctagggcctgggccttcagagaagacctatatgtgcctaagtctctgtttaacaaaatattaaggaagttttcccaggagttcgagaccagcctggccaacatggtgaaaccctgtctgtactaaaaatacaaaattagctgagtgtggtggtgggcgcctgtaatcccagctacttgggaggctgaggcaagagaactgcttgaacctgggaggtagaggttgcagtgagccgagatcgtgccattgcactccagcctgggcgacacagtgagacatgtttcaaaaaaaaaaaaagttccaagtggcacacgattggtgcatagttgggaagtccacagctggctggtgtgcactgggaattaaaagtccatctcctgaaatataactcgttaagttttgctgtcaactttttttttgttgttagagatagggtctcactctgtcgcccaggctggagtgcagtggcacgatcataacttactgcagcctcgatctcctgggctcaagggatcctcccacctcagcctcctgataagctggaaccacaggcgtgcaccaccgtgtccggctgatttgttgttgttttttttttattttgtagagacaaggtctcactaggttgcccagacagggtctcactatgttgcccatcctgagctcaagcaaccctccgacctcagcttcccagagtgctggggttctaggcgtgaactaccgcacccagcctgctatcaccttctaaaaatcctctcaaccaggtggaaaatgtggttaagaagagactttaattcgtgagaaacttctcagggtaaaaggcaggcattttgccatcagaaccacttttgaaaatggcaagaaaaaaatgtgtgtgtgtatatgtgcgtgtatttttttattttgtttgtgcatacattggaaccttctcatttgcctgagagatgcagtgcttatttttaatagcagctgtcaaattgagagggatttttaatgaaatgatttaaaatattttaattttttttctttttgagatggagtgtctctctgtcacccaggctggagtgcagtggtgcgacctctgctcactgcaacccctgcctcccagtgtcaagtgattctccttcctcagccttctgagtagctgagaccacaggcacccgccatcatgccccactaattttctttctgtttttactagagacggggctttcgccatgttggccagagtggtctcgaactcctgacctcaagtgatctgcccaccttggcctcccaaagtgctaggattacaggcatgagccaccgtgcctggcattccattttaaagatagagacttctacaaagttagtgtctcgccagacgcggtggctaatgcctgtagtcccagcactttgggaggctgaggtgggcggatcacctgaggttgggagttcgagaccagcctgaccaacatggagaaaccacgtctctactaaaaattaaaaaaaaaaaaaaaaaaaaaaattagccaggcatcgtggcgcatgcctgtaattccagctactcagaaggctgaggcaggagaatcgcttgaacccgggaggcggaggttgtggtgagccaagattgcgccattgcactccagcctgggcaacaagagcaaaactctgtctcaaaaataataataataataataaaagaaagttagtgtcttgttgactgctctttcgagtcagggaaagatgtttagaacaagctatatcttaaagagaaaaggaagattccttctgcccactgcaatgaagttgtctggcttcattagccagtacattggtatatatgtgtggagccctcgttacttgaagggcgtggcattccagtgttttctgccaccattgttcttaattccttcttccaaatcccagcttctccctccaaaatagttttaagactgacatgcagaataaagtttccaaaacttaaatgaatggaccagaaaatctcagcccagcatcattgcaaatcaataaaaactgcacactctcatttagaagatttattcttccatttggtaagttataggcatttgttagtgtctctgtgacgtcgttagtggaaattgccttctgctgttttccttctgctttttctgcagcatccattttttttaatgaatggcatcattcaatgaaattgattgaattgattgagatttagggttttgctttctcgtgatgagttttgggcccatttttcttatgcagaaataaaaccactggctcctgaaagttgtaggaactgtgtccacgtgagtgctcagggacctgggaatgactttcttttgtctctgtctcccacagttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaagtacttttttttttttacttaaatattttgccgtgggtggatgttaaagaaggccgtggtaatttacaggatgggttccaagttctcttcttctggggctttaaggcagatttccagcctaaatgctagctctttatttccaaaatgtccttgttgggctcttttcctttcccgtgtcctgccacatcgggatgggtactcttctgcacccagatactcccagccagatactctcctccatccagatactctgtttccagatactctccctgcagctagttatccccttgagtccagatgctgcctgcttccagatactcctctgtatccagatactcctctaaatccaggtactccctacatccagatactgtacttcctaagatgtacaagatgtaccgcattttcccaacactgaagacttgaccacagcttaagtgggttggttaaatacattatggcccagattgcaatggatcttctgccttgttaaaaagaatgaatgagtcaagggtctttttgtttactgacactgcctagcatgtattgaagctcagtaaacacttgcagaataaatcacagaaaagcctctctccttaacaagttaagagattggctctgataccaacaactaccatactattccaaatacttttatttcaaaaatttataaagtattttattctatgttctattagccattaagtaacttttttttttttttttttgagacagagtcttgctctgtcacccaggctggagtgcagtggggcaatcttggctcactgcaacctccgcctcctgggttcaagtgattctcctgcctcagcctcccaagtagctgggactacaggcgtgcaccaccacacccggctaatttttctatttttagtagagcctgggtttcaccatgttggccaggctggtctcaaactcctgacctcaagtgatctgcctgccaaggcctccaaaagtgctgggattacaggtgtgagccactgtgcctggcccagcccttaagtaactttttaatcatcattcccaaaatcataggactttctttacatagaagttccaaaataatgaaacaaaagacttgttttacccaggtatttaatgatccaacaagccgtataatttaaactctatttttcaagtaacccactttcaataaaatcatgtttatttttatgtccatgagaaattaaaatcagtcatctacaaagatggacatccaccctccacaaaaaaataagtcttgttgacacatttcttggaagtatagatttatttataaataagccctaatttgacatatctaaaaaaatacctttttttttttttttttttttttttttactattcttctttttactcttctgcttcttgtttaatgagccatttctgtggatagtatgattacaatgagccatttgtgtggatggtatgattataatacttacaaaaatgtcagtgttattcatagaatgacaacagatttaatgcattttttcttttttttattctaaagttagtcaatgtgaagaatctgacctcaaagacaattcttgataattcattggggaggactagaaacaccaccctctaactttataacgtgtcattggtcactcagcaaagcggccaggcatgctggtttatccagctttcagcccttgaagattcaccagactaaggattaagtgaaaaagaatatctgccacctacttcactgaggcgtaaacagtccctatagatcaatgagaaaaggacccaacacccgtataaaaacaaagggcaattcacatgttttccagaaatggaacgcagatgattttatgaagatagcccatttgatgtcgtttttcaactaagagattggcaataatcagaaagtttgtagggctcttaggaaacagatctg

SEQ ID NO: 12092 - DNA, 10061 bp, Human
  misc_feature (1)...(10061): n = A,T,C or G
atgacgtttcttaacttcccctacaactaggtgtagccatgtgattaaggcctgcctccatgggaggtgatagaaaatgatgggtgcaacttctaggatgtctaaaaaggagggacatgccctttttctgccttctcatcatcctatacctggaaattggacatggtggcaagccacctttggccatgtgcatgagggcagcaatctagagatggtgacaacacaagaaaggagaagcctggaagacctcatgggaaagagccactatccaagtgctaatccacctacatctctcagggagaaataagcttctatcttagccactgttttctgttgttgttttttttttttttatttttccataagttattggggtacaggtggtatttggttacacgaataagttctttagtggtgatttgtgagatttcggttcacccatcacccaagcagtatacactgcaccctatttgtagtcttttatccctcaccccgctcccactcttctccacaagtccccaaactccattgtatcattcttatgcctttgtgtcctcatagcttagctcccacataccagtgagaacagatgatgattggttttccattcctgagttacttcacttagaataatagtctccaatctcatccaggtcactgctaatgccgttaattcattcctttttgtgactgagtagtattcgattgtgtatatataaaccacagtttctttattcactcattgattgatgggcatttgggttggttccatgattttgcaattgtgaattgtgctgctataaacatgcatgtgcaagtacatttttcaaataatgacttcttttcctctgggtagatacccagtagtgggattgctggataaaatggtaattctgctttttagttctttaaggaatctccacactgttttccatagcggctgtgctagtttacattcccaccagcagtgtagaagtgttccctgatcaccaagtccacaccaacatctgctgttttttgattttttgattatggccattcttgcaggtgtaaggtggtatcacaccgtggttttgatttgcatttccctgatcattagtgatgagcattttttcatatgtttgttggctattcgtgtatcttcttttgagaattgtatattgatgtccttagcccactttttaatgggattgtttgttttttacttaatgatttgtttgaattcattctagattctggatattagtcctttgtcaggtatatagattgtgaagattttctcccactctgtgggttgtctgtttactctgctgactgttccttttgctgtgcaaaagctctttaattaggtcccagctatttatcttcatttttattgcatttcttagccactgttaatttgggtctcttacatgcaactgaccccttattctaaccaatctattagtttaaaaaataatactgtagcaggaatgatacagaatgagcttaccactagtagaaaatgacctggtcccagaggaaattaaggtgctttaagttgttaagtgggcaatataagaaaatatcaatgtagccatctattatacagaagaatatgccataaatagtaagggaatttgaaaagtatattatttatctggactttaatatttcccatctggaaaccacatctccaacctttgttgtataacattagtatattcattatataacctattcttcacacaggtgagcaactgtgaatgtgccaaaggctatcagtgttgctagtttcacatcccttactataaaccacccatttatgtgaaatggaaataaaaacatgcagaaattcccttggatctgagactagggtttcccccagcacaatcaagtttgtggtcaatttagttagctcagctaaagatactagccaatcagagtttaggagagaaatgaatatcctaaataaatatgatccccaaaatgtgttctctaaagaatttctcaggctcaaaatccaatacaggagtgacttggaactccattctatcactatgaagaaaagtggtgttcttttcctcttgggcatcatcttgctggttctgattggagtgcaaggtaaggggttctgagttaggttgtaaagtaagagaagtgattcactgtaaaagaatcttgattagccagataaaggtgaatgttctgcctgcattgaagagtaatatttggtcagtcataaaagcttctcagtgacatgaccagttatccaaagttcataacttcgatctgccaagtcaaacacaagtctttgtagtctaggtgtatgaattcctagtaagtgttcaataaatgttcattgaactgggtaataatgagaactctatctcctaaattattttcttctccctgatactgttttttgctaagtatatctgtggctaaccaattaaggatccaaccaataatcagagaatttgtccctaatctatttactaactatctttgttaccttggacaaattacttaatctttctagacctcagtttcctcatcatctgtaaaatagaactttgtagttataccttttctgactgctacacaatgtatggcatatggtacaataagtaccaagtaaatatatgaatttaagaattaagataatgtattttaaggggttttcaaaaatttaaaacactattgaaaagcaaggcagtggggaggagagaggatgaggatgaaagtggtgattggttacaaaggagtgctttctattcaacaccaacaccagttccattccttaaggtcagataataaataatagatggtttaggagttgcttaagaaactgtgatcagcatagcatacatgaattagttatctgtttgtcttgtgataggcatttattaaatattgtgaaagtctctttttctcccacggacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgactttgttcttaatctttctgaaccttagtttccttatgtataaaatagagatgatacctccttcaaaggtttgtggtgattatttttaggcactcggtaaatgatagcaataatcatgactcagtcaagtgtatcattttgatagatcacctaaactgaaacattggcctatactgatgtgttctatctttttctttccctcaggaaccccagtagtgagaaagggtcgctgttcctgcatcagcaccaaccaagggactatccacctacaatccttgaaagaccttaaacaatttgccccaagcccttcctgcgagaaaattgaaatcatgtaagtaacaacccagctaacatgcatgcaccatattggcaagaacattaaatttagcatgagttttacccttggagtgcttgcccatacaaacacttaaaaatcagatggttaccccctccataaatttgggcagctcctttcttttcttctccttaaaaatgcaaggaatttctggtagattaggccccaagaatgacacatgtttattgtacaaaatgtttaatgcaggtaacacaatagaagaaaataaaaatcacgcataattctacccttgagtgacaaatactgttaaccccttagtatacagttttctaaatcttccttacttgcttcgtgtgcacataacatagatatgtttttacatacacgtatataagcacaaaaattaaatcatatactatacactgttttgtaatctgctttttcattaacactatatcatgaacattttctcgtgtcagtaaatctctaataatgtcatttttacttaatgtcatttttaatggccaaactgtatttcatcatatggataaaccataatttatatgaccaggattattgttggaaatatagattatttccaaatttttactgctgaaataaaacttactgtggcagtattgtgtctgtaattctttcctttctagagattaggattgctaggttgaaggatgtgtgcatattttgtctttataagtcatccttgactactcttattctcagactatacagaaaaattaaaggaacatttaaattatttccagacagtctactgtaagtaatttttaaaatttaaccagggccgggtgcagtggctcacacctgtaatcccagcactttgggaggctgaggtgggcagatcatgaggtcaagagattgagaccatcctggccaatgtggtaaaaccctgtctctactaaaaatacaaaaattagctgggcgtggtggcgcatgcctgtagtcccagctattcgggaggctgaggcaggagaatcgcttgaatccaggagttggaagttgcagcaagctgagatcgcaccactgtactccagcctggcaacagagcgaaattctgtctcaaaaaaagaaaaaaaaaaaaattcaaccagtgactcatcttgtcctaggaaataattttaagtagtttcattagaaaattcagcacaattcatactgattttcattatttctgagaagaagcatttaaattattaatgagaaaaaactatctcattgctatttctttggcagtgctacactgaagaatggagttcaaacatgtctaaacccagattcagcagatgtgaaggaactgattaaaaagtgggagaaacaggttggtgaaaaggaagatcaaaattttctttcttttagaaattaactttagaagacaaagaatctgctttttcattaacactataagaatacataacttttaagaatacatttttcattcatattatggtgcttctattttgttcctaggacaaaattaggttcctacatatagtatcccctctctgtctcccactggaagaatgtgtgttccttgggggtacagagcttgtccttatttaatacaataaatatgtaatgaattgaatggtagacacaggatacaaagataataaggtatagtcccttcctgttgtagtgcatatgctaataattatggtacaatgtgagaaatataaaagtatgcacaagaatcttgacgacatagaggagggagtacttaactttgctgggggaatggggcaggagaaagtgttaaggaagatttctcatgtcaggtgatatttgatttgggtcttgaaggataaataatttgccaggaaggtaaggacagcatgagcagaagagtagaatcatgagagaacctgctgtgttcagggagcctccattaatgtggctggagtttgtgtgaagagagtgaagggactgaggcagaaaagtagatcaggacaaagcgggaggaatcctgcatggcatactaaggagttggatttgaagagagccacagaatatgtgggtgggagattgggttctggagtctcacagactggaggttctgccacatactagctgtctagatttgggaaagtcaccctctccagaactcagcctcctcctatgtaaaacgtggatgataatagtgccaccttcagagggttgtagctggggcaggtgagtggtaagcaaggttgccaggagaatgtaataagccagaagaatagacaaaagacagccagtttgaaggctgttgcctcctcctcaaagtgagcaaagtagagagaatctaagggagcccctctgagagtgaagtgactttaatgtggttttgagactatgtgggtatgagacaatgatcaggagagtccaaataaaaggaagtaaaaatggtaagattcagaaacattgccctttttccccttcttctcacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcagaaaacagatcttgattttttttctcttgaatgtacccttcaactgttgaatgtttaatagtaaatcttatatgtccttatttactttttagctttctctcaaataaagtgtaacactagttgagataacacatgaaagctctttaaagggtcgatcgggaacaggaaaaaaaacctatggaaaatatgacaacactgccttacaacaacactgatttaaaagagttatgtggggctgggcgcagtggctcacgcctataatcccagcactttgggaggccgaagtgggcggatcacttgaggtcagggatttgagaccagcctggccaatatggtgagagcccatctctattaaaattacaaaaattagctgggcatggtggcatgcgcctatagtcccagttacttgggaggctgaggcaggagaatcacttgaactcgggaggtggaggttgcagtgaggcaagatcatgccactgcactccagcctgggtgacagagtgagactctgtcaaaaaaaaaaaaaaaaagcattatgtagaattcaatgtatttcctaatcctcaagagtaacactattccaatgaggtgtgtccccaggaagccaacacgtcttcttttctatccctaaaattgtatatgtttaaatattgtaaagcctcaagtagttatgatggagacctaaacactgaatgaattatttaagggtccaggaaacttgggctggaggcattacgcagcgtggagtctctaagaaggttgagagtggaacgaagagcatcagcctgtacacttgatgtacactttagaggccagacaggtgtaatattcgggcagataacagctgctaatggtagacatgaattctcacaagggccttcacctgagaggcaacaggactctggaaggagctaagatcctggattctgagatatcctggttagaatcaggggcccactacttattaactgtgtgaccctggttaaagtataatatttaacctcccagtgcatcattttcctcattccagattgttgtgaggagcaggttcagcataggtcttggtgcagagaaagtcctcaatgtttgtcccagatcctccctaaccacttacctctgctgcatcttccttgcagcagatggatcctacatctcatagagagagaaatgtttccagcactgaaaaaacatgttggagaaatgagactaaaaggcttcctgaccagttctcaatatctgtattttataatcctagtccaggccatcattgtctctttcctgagctacctcagtagcctgctgttttccctgttggctcttcttctcaacatttctcttgcttccctaacttccatgacaactagaataatctttttaaaaaataacttacagaatgctgccaccttgcttaaaatcctgcagcttagcattaagtcaaaacataccatgagctggcctaacataagctgggatctgcctgcttatctaatcatgctccctctaccctcccctcctttgttgagcctcagcatcaccttttttctgtatgtctcttgagcacactgaattcattgccttctggggtttttgttccctgtggttctgggttgtactatatcaacttggttagtcttacaactacatttcccagaatctccttccctgtgtggttccaggttatagttagccaaagaagaactcatgtgagatttggaaatcaaaagtgaaggagtgacccttaatcttgattagacatattgacagacacactggtagccagtggatcccagcttgtccttgctcttttcctccacgttcagcttatgctcaggactgctggcctcatgatcagtgatggtcccaggccccccacccagatatttggcagtggacccacagaggcggtagttacacagaagcaacagctcccatagaccctagcagccccaatttggcgctgaacgggcttaacttcttggatttttcacacaagctctattt

SEQ ID NO: 12093 - DNA, 20481 bp, Human
ccccggggcccggcctcacgctcacgccatggcctcccccagcgggggaggggggctcggccgcgcgagggtgcgagcagggggcggggccggccgggacagtcagtggtgcaaggcccggacgcgggggtggggctgcatcaggggcggggtccgggtccccactcctggcccagaattgctccgaggggccgagccggcaggcaggcgcggggcacgggccgggtacccgtcggcggcatccagaggtggtcgtggggtgggtgctcccggggtgcaggcgacagctccctagtctccggaccagggagaaccccaggatctggggtccactttcggggtcgcaggtcacttgcttggggctccgcgctcgcccggcttctgctggtgccggcctaaggaggaggccggaagaaggagccgcgaaccgccagcctgcagtggcgcatgcgcccaacgattccaattgggacccggaaaaggaaaacttgacggcatgaatgcgcaagcgcagaaaggtgatggcgcggtaggacgcgaggggtgccctttgggcgtgcgcagactccaggactaaagcaagttcgagcgtaaaagcgtttgggcgcatgcgtagacccaggcgttgccaacccagggtagacgactgggcggaaccaaagagacagttgagtagccattgggtaacggcaaagtaattggcgcacagctcttccaatgagttacaggaggcggggaaaaggtggaggcgtggactcccctagtagcagcgagagttctgcactaccgaagcacgcccctctcggcccgccccctttaatgctggacctcgtacgtcacgaccgatttcgctcccagcggcgtctacttccgggtcagagctcagacctagggtgtagagaacaaccttccgtaacaggcaggaatagtcgaaataggatagcgtcgtctttcttaaagtgacaggctcaaagcaattggggcagccctatccagaagttgtgagggcgactcagctattctgaatccaatcctgggcaaagttctggacaagtctcaggtttctgccaatggggaagggatatgaagaagcggattgtttcccaggtgaggagaagaagagagccttaggcaatccactccaagagcttgaggtgcagccagttccgtctgtcctccagtcttccccaccccatccaactagctctacgaggcagagctttctcgtcctcatatcatatatgaaaagaatggccgggcgcggtggctcacgcctgtaatcccaacactttgggaggccgaggcgggaggatcacgaggtcaggggtttgagaccagcatggccaacatggtgaaacccgtctccactaaaaatacaaaaattagccggccgtggtgccacgcgccggtagtcccagctactcgggaggctgaggcaggagaatctcttgaacccgggaggcggaggttgcagtgagcttagactgcgccattgcataccagcctgggcgacagagcaagactccgtctcaaaagaagaaaaaagaaaaaaaaaagaaagaaaataatgaggctcagaatcgatggatcgcacagtcccacaacttcgcagccaagaccagactcgggttcacccccttcccaagtgtggttctgtaaccccgttttgctgccgccgatgcggatgcagagggcagagatggcccatccttagcagagaccaacctccaccctaggcagcagagcacgcagctgggggcttttctttctagatctcaaaagcctgctgtgatgggggatctggttctgccctttccctctctgcctctcctggcccgcctacccgggaactccccgcctggagcctctgggaggggagcggtgcaggccgcccgcgtcatctgatgctgtttcctgcaggagggagaagagcggaaaaaagtgaaactccaccctccacctctgcctcccgcccccggggccaaagtacaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacagtgagtttctgggggcatggttgggggtggcatggctctggtacacacctgctcccaaccttccactgagcctagcttagggtctactgcaggtaggagctcccaccctagggggtcccagctgaccaggggtgcccatgggctcaagctagcccccaaacagagccccaggcacccagcagagtcttcctgcgccagcttcagaagtccttgaccccagcctgcagctgcggtttggacgagttaagaaattggtatctctcaggtgggccataagcatcctgcccagccatggctcccacctcaaggaagtcctctggaagctcgtgctcctcatcttctcctcccctaaattcatgttcgtggagttggtgctctgtcctcccctcccgtcgtcatgggcagctcctccagaacagatatctcagagagggaagccctccttggcagtcaaggctaaggccagggctggaattctggcctagccctccctggcttcatgacctctagctggttactccaactcggagcctcaatttcagaatctgtaaaaagggagagtgaaacagctcaacagcttgggcaagcccgacctgcgatccccaacccacagcgggtcctcagccatggagatggacatttgagggctggatcgccaagagggcctagcctgaaatcagtgcttgggatgggagtgctgggctaagggagactccatctcccatcatttcaagcccccgacacgctgcccatcatggcccaagagaagtgagtgacagcttcagagggtttcctggtgcacgcagcatttagagagagaaggcatggaagcaggacccagcacacagcagggaccaggagcaggggcctcctagagcccagagtgcaggctggagagcagcagtaggaaatgcaggaggggccaggctcagtgtggtcactggaaaagcatgagacattcttagaggggggtcaacgtggatattttgagcctcctggcctgggctgaccatggacaaggggcttgcaggaaacagagtgctgagccccagatatccaagttcttgccaggactgggggagccaggagaggcctgccaaccatcctacccactcttctcatccctggtagggtgcggttcccacctctcagcctcaaccctgggctctaactatctagggacccccgctacctgccccaatctgagggggattccccgaaggcacagggggaggggactcccatcttctgtttttcctccgttttctttccagaaaaaatggaacaatagcccaggcccctgctccccaccctccccactgcttcctgcgtttcctgctgcccctgagccggcttcctgtccctgctccagcccctgctccctccctagcccagctgcctgcaggggaggaaagagcttggggtggaggacttgcgggaggaaggagcctggaactgctcccctactcccctctagttcccctgcttccctctcagagtctgggaggtggtggtaaagggcaggcaaggtgccctcagcctccctgagcctggcatttaacctcggagaccccagtcctaggcccaagttgctgtctgcaggattggggtggggggagtccctgggctggtggggggcacaggcaggaaacaatggcatgattttcctggacaatgggggccttgtgaggaagcctggcggggagaggagggggaattctccaggcccacgagtcacaggactgaccagccagcccggcctgggcctgacctcccccagttctccccaaaaggactccccctcccaagtgggagacctggcccaggcctcccagaaaggagaagtagggaccacgggaggaaagcggaagaggtgtgagctgcccaggccactcccaagccccacagaggccagcccagggagggagctggtggccaggtccctatcagaggccagggagccctaaaggggcactgagagcttcccccagtttcggggtctctggcccattctcctctgggtgacccctgacctcccatgcctgggatctacatcagacaccagaacagcagttcgagttgggacagttgaaagcacagagaggagcttggagagaaagcagaggatggggcttagcagctggcagagccaggagcggggaggtagcagaaagaccacaagtacaaagaagtcctgaaactttgggtgagttgttgcccctctctgggcctcagattccccacctgaaaaaggtggagagtggccacccggcctgagatactggaacagcactttgccagtctggggtgccacaagtggctagagacaggccaagaagcagcaagtgttggtcttcaaaggggaaggtgggccctggcaccaggggaggtgcccatttccactccacccactgccccagcctgctgtgtttcccctttggaatgagcttgtcgtcgggggcttgctaaatgctcaggtccccgcctccagcagccagaccagaggctgttttgaagttggcagtaaggagtgacagaggagggagaggagggcggagatacgataagtgctttaggacaactggcctttaggatgcttctgccaggtggcagcccccatgcaaaaactttaaaagtgtggtcttgtttcatgctcgtgacagccatctgaggagggttttgttgtcatcctcagcttgatgaagtgttcaggactcagctccaaggtctggctcagaggagtgggtagattttgagaccattctctggattaggaaaaattgcaggaaaatctactgggcatgccgggatagtaaaggtggtcatggagggcacctggacatcaggtagagctgctgaaccaatttgtctggcctggagttgcaaatgtggaagatgccagtggggagagggagctggtacctggaagaggctgagtcagccaggggcagtgggcagaggttgaggagaggtcatgctctgagaagcaccagcgccgaaatggctgaaggtggaggacacagaaacagagccaagcagccaggggctgtgggggctgaggacggtggggcagcggggacagctggcagcagtgccagatgcctcctcaaggcccaggtggcctggccagcagcaggatcagggcttgttgctttaagccctgaaaaatgagcaccctggttctgccacctcctctgggaagtcttccctgactcaccaggctgtattaggtgcccttcccatctgccccaccccctgtgccctatgctgcccccatgacagccgtgtcacacagggcaggagagctgagaggtgtgccctgacatgggtccagaaacatggttgacttgatattgcttctcttccacagtgcagttggctgtaacctgaaaagtagaggggcccttcagacccttcatgactctatgactttgtcctctttctattcctcgaaaacttctctcatttgagccattcctgtcctggtgagagatatgcaagttgctgcttctcctctttgtaccaagtacggtggccccatttgggttaaagccatgagcccctgccaagtctgaccatccacgcctacatttaccccaagctcctcctttgtggccaagaaccatcactttcttggaccccaccctttctcttcccttccagctgcattggtaggtatcttttggagtctttgctttgggagtggctgcacttgccacagtgtgatgtgggcactaggggcctgtggtacctgctgggcttcttttctcaccaagagcttccctcttgctccccactctaaggggggttctgattcacgctcctgcctcaacaaaatgacaggagactcacagatctctcttgaaatcaaagccataaatgtccagagctgccaccttgccagttttgcttcagtgtaatattagggaaaagctagaacactggtttcagagccacacagaccaggttgtaatctctgctgtatttgttgtatgacctctgccaagtcatttccctgcttggtttcctcatctgtgaaacatgaaaaatattatttagctcataaatggttttgagtgctggggttgagtgtgaaatgtttggcctcggccaggtgcagtggcctgtaatcccagcactttgggaggccgaggcgggcagatcacctgaggttgggagttcgagaccagcctgaccaacatggagaaaccctgtctctactaaaaatgcaaaattagtcgggcgtggtggcacatgcccataatcccactactcgggaggctggggcaggacaatcgcttgaacccaggaggtggaggttgcagtgagccaagatcacgccattgcactccagcctgggcaacaagagcaaaactctatcttaagaaaaaaaaaaaaggaaaagaaaagaaatgtctgacctcaagtaggtcctcaagatctagaccaagtcacctctgtgcccccaggacccagccaggatgtccgtcagatgagtttgctcccagctcttaccctgtccccaccacctgatcctggagcatccacaatctggcccctcttctctagttttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggaggtgcggcccttggtggggctggacgggctgctacggggctgcagagggcagaggtggctgcctaaatctagggctgggccaagtccagggacagggacccaaaccacttggctcctagttgcttttgggtgaagtggcagtaagggggtgggggttgggagagaaaagggaacacagacctgttgtctcgcccacagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccggtaagaggacggggagggcaggtgaggtacagagctccctggcccaggacacatccacccacggaccccttcttattctgtccccgctgcacgccgtgcccctagactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggtgcgaggaatcaagggacccagcgttggaacgagtgtctccccgatctccctggggcagagtcggggcgggcgctgccgggattggtgccaggctgacctctccaccatcgctgtctcgggcgcaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcggtgagggccgggccccggggcgtcccccgccattggctgcgggggtgggggtggagccaggcctgtgtgctcaccgcgctgggattggtttagggtgttgtgggtgggcccgtgagatgaaggctgggaggggtggagccaggagtgttttttttctgtctgtgggcgggttctggcggaagtatttgcatgtcggtctgggagtgggaaggggtggggttcacgaaagttctgggaaggtctagtgggcggggccggccggcgccagggcatctccgactcagacgagtagctttccttatccagacccaggggctcaagaaagcagtgaggctggtcacagtctcacagccatcgtgccgctccctatgtggcctgggagctggccttgggcccctgcaggttggggtcctggctctacttcatcacaaacctgaaccctgctccccccaacccaaatcccagacttcaagcaccgcatcaccgtgcaggcctcacccggccttgaccggaggagaaacgtcttcgaggtcgggcctggggattcgcccacctttccccggttccgagccatccagtgtaagaaacttcacctctcatgcccctctccgccccccagctccttattctctgtcagaccttattcttggaggcggagcccactcactatcccctcttcctccccgcccccaggctccctgccttaggtctagcctgttacctctgaactccccaagcagcattaattttacttatttttttttagtcaaataattgtatgacactatgtactactaattttctaaatgctttgctaatattaatttcttgcaataattctatttggtagttatttttgttgttaatttaagttttatggatgagaaaagtgaaaaaagtaacttgttacacagttaataagtggaagagccagaatcaaactcaggcagttggtgtcagtgtctgtactaattactaagcagcaaacttcagcccaagggctagatgagatgccccaccccactgttggccccaagacccaaacccatctatcttgcccaaagctcaccctgggaatggtacagggcccagcctgctccccatactctaaagtttatccctgaagcctgactgtgatgatggagggagaataaagattatctccgatttcatcggtttcccctgcagtggagcctgcagagccaggccaggcatggggccgccagtccccccgacgtctggaggactcaagcaatggagagcggcgagcatgctgggcttggggtcccagttcccccaagcctggggaagcccagaatgggaggtgagtacctgagtgccccccagacccagcatcatttgctttccccaagtcctgaaattcctaaagcacccctccttgccctcccatcaccaggagaaggtcccgcatggacgaagccacatggtacctggattcagatgactcatcccccttaggatctccttccacacccccagcactcaatggtgagtggccttcctcccccggcaggatctggctgagctccttccgtgggcaccttggggaggccacaataggctagtaggcaaagcaggagtcctgccctggttgctctcattctagagactaggaaaccaaggctgagacaagacagagccgatcctggaacccaggtctgacctacaggcccacgatcaagcggcatacagcccaggcctcggctcggggcccagagtctcatccccttgctcagacctggcctgcaagaagcctcttccctggccccatggcagcccctgtgcctttagcaggctccagggagaaaagaaagacaggaagcccacctggcatttggtacccaagggaagctggacccagatgggggaaggaatcagcctgtgtggggtggagccaaacaagtgtcagccacactgtgcttctcagagccccttctgggagcctgtaggtgaagaagagaatgagaaggccgagcaggcaggatccaggacccattctcaccacatccaggatagctcggggcctttctgttctccatgacggtaactgccctactgtgccaggcattccctccaagcattgatgaagaggggctactattaccccattttgcagataaggaaactgaggctctgagaggtgaagtaacctacctcaaacccccagctgaggatttgaacccagagaggcttcagctccaatgctctcgtagtgagctcagaagctttcacttgaagaaagggcttctcacgtatagactgcttaggaagccagagggtcaggcagaaggcagggctccagcattgcagggaggagggctcactcagctcaacactgcccagctctgagtgaggccagagagttatggcctcccttgcctgtgggtccctgtgccaacctagggaccatcctcagagcccccacacctgctgctcacagccagaatgtaggacccgcttagctgctctcagaagagtcctgttcagcaagccgtttaaactcactcctcccatcccacccagcccatcgcctcttccattccctgagctacacttgatagttgtaacaacagctaacctttgttggttctcttctatgtgccaagcagttctgtgaggggagtagtagtattggcctgcattttacaacagagaaaactgaggcacagagagattaagtggtttgatgtaaggcaaccagtagagcagggatttgatctgctcttgcctgtctgaccacagaggcagagccctgggcctccatctgccccgccatttgctactccagcagctgcactgcccccagcatctgtcctgcagggactgaactgagagctggaaggccaaggaggcttcttgaattcacttgctctaaattgtaccaggccagatgggccaaaggagaacttgagagcctgtcaacccaggtgtgtaggctgaagcaggtcctgactgttccacagaactctctggccctcagctcccagaagcaggggcacaaggggcctgggccccatcgttctcaagcttgccccatgtttttttatccaaagaatttgttaattatttatgaagagaaactacttattagcccatatattcatgaatagttcaggtcagtgacaaacttctaagtaattcaacccaaagaaattcttcatattccaaaatcactttgcattctgagagatagcagccttcctcatctcctcgaagtatttcatggcatcataacttctgtagacatctgtgcccatagaaatctgaaatgccttctttcttggtccagcccctgcaaactgagagagccgcagcccccagggatacagtgaatgctcccacaatatgaaattgcagatgtgtggccagaaggccacatgtctgaggtttcatgaaagcactggaaaccatggtagttactgttcttgataagtatgtcggcctcaacaccagtgcccttcctggctgatgaagaaatggattgccacttgccctgaaaggatgtcagctgcccagctcagtggctggctgagcatctggttcccctagcccaatcccacactccacgcatcatctgggtccatgaaagtacatgacattgacctcacagccaccccccgaaacccagctaagaatcaaataatggggcttcacagaggtcccagaccctgtgagatggtccccggcataagccataccactggagagtcacacacaccctcaccctgtccccagtgggctgttctggtccctggagagctggctgcaaggagtggcacattggcagggtgcactcagctacgctgatagcaactgccctgtgaagcttgttgccttagagccaataactacgtggctgtgtcctccctgtgagacctcacggaagcagtttcgcctctatctatctatctttgggtcaagaatagtcacgcagctttctcctaaacaacagagttgctaactcttgctgccaggaagcttagaggcagattcaaatcctagctggattatgttgaccaagtcccttacccttcagaacctcagtttctcaggccattgactgcaggaacttctgttcactctcattttgtctgctggaccctatcttctcttccctttgtctcatttctgtcttttatttttttaaagatagagtctcattctgttacccaggctggactgcaatggcatgatcatggctcactgcaaactctgcctcccaggctcaagtgatcctcccacctcagcttcctgagtagcagggactacaggtgcatgccatgcttggctaatttttatattttttgtagagatggggttttgccatgttgcccaggctgggctgcgcttaagtagtccacccaccccagcctcccaaagtgctggcattacaggtgtgagccaccacacccagcttgctcttgctattttctttttttttttttagaaggagtcttgttctgtcacccaggctggagtgcagtggtgcgacctcagctcacttcagcctccacctcccacgttcaagcaattctccctcagcctccccagtagctgggattacaggcatgtgccaccatgcccagctaatttttttttttttgagatgaagtgtcattctgttgcccaggctggagggcagtggtgcaatctcggctcactacaacctccacctcccaggttcaagtgattctcctgcctcagcctcccaagtagcagggattacaggcatgtgccacaatgcccggctaatgtttgtatttgtagtagagatgaggtttcaccatgttgaccaggctggtcccgaactcctgacctcaagtgagccacctgcttcagcttcccaaagtgctgggattacaagcgtgaaccaccatgcccggcctaatttttgtatttagtagagacagggtttgaccatgttggccaggctagtcatgcactcctgacctcaagtgatctgccctacttggcctcccaaagtgctgggattataggcttgagccaccactcccagcctctcttgctttttttttttttttttttgagatggagtctcactctgtcacccaggctggagcgcagtggcgggatctcggctcactgtaacctccgcctcctgggttcaagcgattctcctgcctcagcctcccaagtagctgagactacaggtgcgtgccaccatgccctgctaatttttgtattttttagtagagacagggtttcaccatgttggccaggatggtctcgatttcttgacctcgtgatccgcccaccttggcctcccaaagtgctgggattacaggtgtgagccaccgcacccggccaactctttcttttttttaaacatgatttcccctcttctgtttaaactcactgtaaatgatcagttcttcacctgcgaagtgggggtgataatgataacctcgtggttggtgcaaggattataaaaatggattcttcatcaaacaagaatttgcttttttttttttttgagacggagtctcgctctgttgcccaggctggagtgcagtggtgtgattttggctcactgcaagctccgcctcctgggttcatgccattctcctgcctcagcctcttgagtatctgggactacaggcgcccaccaccacgcctggctaattttttgtgtttttagtagagacagggtttcaccgtgttagccaggatggtctcgatctcctgacctcgtgatcatcccacctgggcctcccaaagtgctgggattgcagatgtgagccaccgcgcctggcccagggatttgcattttaagagccaggcatcaacatgttaaacactgccctgacctcatatgatgaagcaggcagactcataaacaagtccagtagcacctctatgaggcataacgtgagcaataactgtgtaggttcagggagattctgggagggcttcacagaggaagtgacatcccagttggtcttggatggtgcataagaggtcactgaaagccaaggtgggaaaggtcagccacccagagtgaatagtgtgtgcgcaggcatgcagctcaccatacccaaggaaaaggcaacctggctgaactccgagaagagttgagagccgaggagtctcaggactggggctgcggacaggggccaaggcacatgggtcagtagatgttgattgaatgaatgagtgaatgaagctggaagtgatgggtagtttttaagcagagacctgtctttaacaggtttgcattttagaaggattcccttgtcccttcagtggcagtggccggggtgggagttgggtgaggtaagaggcagagagtctgagtaagggttggggctgacagaagggactgtgagctaagtcctggttcatagtagaagctcatttttcccagccttgtatttctccctcccgacatccaacctgctgctgcactccaggcaggaggggaaaggcagagggacaaggccagggagggcttcagaggaccagccaaggaggccagactttctcctagtgacagtggagagccacagcagtttctagagccaaggagggatctgacaaaatcagggcttgtgagagcccatcctagagtcccttgtccttaatgaggggttccccatccctgcccaagtggtctagaatggagtcaggccaaccctagactggaaggtaggacactagtgtcttgaaatctagggcagagtctggctgggaaatggtggagagcaaaggttctactgcccttgcctggggtgaggccggctccacctttcactggctgtacagctccgcacaagccctcaacctctctgagcctggaacccctggggcatgagaatcagacaacataatgcccctatgccattcagctcaggcctggcacaaatacatactctgtaaattagctgtgaccttgggcaaggtactgacccctctgaacctcattttcctcctttctagaatagagacagggatttatgccctcagggctgccatgtaccttagagttgactgtgtgcatcttataagctacagctggagcgggggtgggtgggcagaaggggcagggctgccaagccaggaagctggtgggcacagagcacagggcgccggtcccagtcagtgggacctgccatgcccctgggcctggaggttgcccctggcaggccacagaggcccactgtgacctggccccagcctgcctccactgggactgcccatccatctttcgggtctggggtcgctggctgccattgggctttgctgccgcttcctccacctgcactgccctcccctcccagtgcccatcttgtgaaaggccagaatgtgggtatgtgatggggaggccatgggacctgtgggaccagggaagatgctagtagagggcagaactcagtccttgttccaagaccacggagaggtcttgggccctcacccggaatatgcaccagccacaccctcacctgtgccgcctctgcccgcaggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggtgagtggcctgaagccggcctgcttcacatatgggagacgggggttcccagggagggaggagtggctggtggggacatgcaaggaggcaaggccgagaccacagtcatcagctggaccctgaaccaggcattcggggtactgaagacgcatgtagggagcagagttctaagttcagctatcaggtggtccaggcaggtgggggcgatgcctgctgtgaaataaaagaagtaatcgggccaggcagtggtgcacgcctgtgatcccagcactctgggaggatcacgtgagccttgaaaggttgaggctgcagtgagcggtgatcatgacactggactccagcctgggcgacacagcatacatgtaatcataatcgtagcaaactcctggctccttacttgtgccaagtactgtttgcaaggctttcccgagatggtctcatttagtcataacaaccagagaactaagcgctcctggatgcccatttttagatgaggaaatttaaggcacagagattaagggacccacagctcccacagctagtaagtggcagggccgggatccacatccaggccagcctgctgcagaggcctcactcctaactattacaaaaaacagaggcaccacggagcaggaagggcggtggaagttgagtcaagtaggtcactgtgcacatggggaaactgaggcccagagcaggacagtgtcttggggacctcagcagttgggggttgcttgaccctgtgcccctcctatatcctcacaggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccccacatgtagcctgtcacctttcttggaggtaaccaggtgacccaacctatcatacaaccctggtgtcctgatgccccaacaataggcagttggatgccttgtactgcatgcctctcctgggaccaaatccaccagccttggtcagtcattcaaggctcttctcggccaggtgcagtggctcactcctgtcatcacagcagtttgggaggccgaggccggcggatcacatgaggtcaggagttcaagaccaacctggccacatggtgaaaccccatctctactaaaaatacaaaaattagccaggtgtggtggtgcatgcctgtagtcccagctactctggaggctgaggcaggagaattgcttgaacctggaaggtggaggttgcagtgagccaaaatcacgccactgcactccagcctgggcaacagagcaagactccgtctcaaaaaaaaaaaaaacaaaaaaccataggccgggcatggtggctcacgcctgtaatcccagcactttgggaggccgagacggacagatcacaaggtcaggattttgagaccagcctggccaatatggtgaaaccccgtctctactgaaaaaaatatatatatatacaaaaattaaccaggcgtggtggcaggtgcctgtagccccagctacttgggaggctgaggcaggagaatagcttgaacccgggcggcgaaggttgagtgagccgagattgcaccactgcactccagcctgggcgacagagcgagactccatctcaaaaaaaagagtagtaagttccacccacctcccagtatggtgacttgccatggcatctggcacccctgacagttctcttcacactgccatgggggctctggcactcccacaccataccctagggcagggtccctccctcggcctctgtccattctcttcacactgccatgggggctctggcactcccacaccataccctagggctgggtcccttccttggcctctgtcctcagcccctctgacgttagaggagttggaacccaggctcccccttcccctctcccaggtgccccatggcagcccagactctgtgtctgcagttcaggggcagggagtcaggagggcaggcacaaagcgttctcaggaagaactggcaatcgggcgcaagggtatcatctgcccgggtgctctgggcaccctggagtcctctccccacctcccacccccacctgatccttcccagctgccaccattcctctcccaccacaccacccaggccaaaatcactccatccatgacgcctacagtagcccagcgtaggtctccctggaccacatttatcctcaagggcctgtgtccttatccccccttcacccccaactctcccctgccacagccagccctctgttcctctcacaccccaagctcattcctaccttcactggcctcttactccccagctgaaatatcacctccttagcagagctttcccagtgagataacccccccgctccccgcagagctctcccatcacccagggtgtttccttcatggaactcatgacaatgtgaggttgccatgtttctttgctaagaggtttcttgtgtaaacaccaggaaggaaaggacctgtgcctgtcctcttccctaagcacttgaatgaatgaatgaatgaatgaatgtggtatgggtgcctgagtgagcaggaccttgaataagtgtgaggtcctctctaggcttcagcttcctccgcctcctcccctcaccgcagccgccttcctccacccatccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggt

SEQ ID NO: 12094 - DNA, 12243 bp, Human
tcttaggcaatttcctgtccaatcacagatggtcacatgctgctttcctgagttaacctattaactcacccttgtttcccaggcctcagtggagctaggcttgtcacgtcttcacagtgactagattccctcacagtcgagtatatctgccactccttgacttttaaaacatagtctatgttcaccctctaatatgaagagcccctttcactattttctttgtctgtgctggagtcacttcagtggcaagtgttctttggtctctgccgcaccctccctctgatgcctctgagaagaggatttccttttcgtgagaatgtcttcccattcttcttaccctcttgaactcacatgttatgccacttagatgaggaaattgtagttaaataattagaaaggatatgacttatctcaaatcaatccaagatatactgaagtattgtttatgagtaagatatcagtcttgacgcagaaagaaaacaggaatccataaggggaggaaagtgttgaaaagcaaacctgatacagtgggaaaggtgggagacaccataaggtgctgaagtgataaaacaggccagtgtttctccactgtatgttttcaataaatgcttccaaggaaggagagtggggcatgagtaggggagctacagagataaaccaacttttcttaccaggaatgctacagatagcactggtgacaccggtcaccagtacccaagacaatttaatgtggaacataagtacaggaatacacatctttcattacagagccatgtatttattttaatgggcaggagatgctaaataagatcttttgaatggaggaatgcataaatatatgaatgaatgcatacatgaaagaataaataaatgctgcctagcaccaaggagcgaagatagactcatatcaagggaaacaagtatgattaaaaataagaccccagagtcacgctcagtctctttccagccttttcatcatccggtacattcagacaagtttcagggaaggatcctatttgtcccatgataatgatgggcaaggggtggggagttatctcatactccgcctgtggatgaggggtcttctcaggtaaggctcttaaatcctaggcctgagtaaattttttcaaattttattttagacagggtccctctctgttgcctaggctggagtgcagcggcacaatcacagctcaatgcagcctcaacctcccaggcccaagtgatcctcccacctcagcctcttcagtgactaggactacaggtgcatgactccatgcttggctaactttaaaaaatgtttgtttgtttgtttgttttttacagagatggggtctcaccatgttgcccaggctgatcttgaactcctgggctcaagtgattcccctgcctcggcctcctgaaattctgggattataggcttgagccaccatgcctggctctgagtaaagattaagggaagccatggtgctatcgcaatagggtaccaggcagcttaacaaaggcagaagggaacctcagagaaccccgaagagccaccgtaaagtgagtgctgggggagctgaacttcagtcagtacaggtgccgaacagccatcaggtgcgcagtgttagtaattccaccctctgccctgggagcaaggtgtgtggagaaacctgtagcactttatgaccatcagaaccagtctttttcaaaaagaccatggagtactctttgacctgtgtatataacaagaacctttctcaaataggaaagaaatgaattggagaaaaccactgtttacatggcagagtgtgtctccttcgcacacatcttgtttgaagttaatcatgacattgcaacaccaagtgattccaaataatctgctaggagtcaccatttctaatgattgcctagtctattcatagctaatcaagaggatgttataaagcatgagtcagacagcctctggctttctggaagggcaaggactctatatatacagagggagcttcctagctgggatattggagcagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccaggtaaatgctgcattgcatgtgacaataatgtaaatttttagtttgtatttttctgcagtaatgtaatagagttttttaaggataggtttcttataaagagatttttttttttttgctagaaacagcaccctccacccaaaatgtatctagccatgcatacgctctctttttccagttggaggtgagagtgaactaaaggaacaacatccaaacttgtctccacaaattgtagacttgtaacagtatgcaaatcttgctctacaaaaattgctctactatgaagttcttacttcacaataactaatagtagggacatttctactctgaaatttcatttctcaccaaaaataaggataaaagcaactgcgaaatctaaacacaaggtttaaaagcagttctctgttttggctaaaacttaatgccatcaatttttagaataatgagaaagatttcccatgcagtgtttcgataattttcttttgtcagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggtaggcagactgagggccagagtgagagagctatttcccatgacagtggtaagaagtcatgtccaatgtgtctctattttgtttcattctaaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggaggtaagttcttcttatagcaccttaacctcaccttgcccctagatctcgtagctttgcaactggaattgattgtttaagatgaatgttgattttatgggctcgaagagggaaactgcatcacagttgatggaagtctgttggcctcttaacaaagctaatgcttgcccttctggcttagcttacataagaaccacaaggaatctttgttgaattgtttctttcagatcatcgggacaactctccttttgatggacctggaggaaatcttgctcatgcttttcaaccaggcccaggtattggaggggatgctcattttgatgaagatgaaaggtggaccaacaatttcagaggtaagccaatcaaatttgcctctctcaattctcccaccccttcatgtttcattgtaatattggttgatttagttgaaagaatgcattcatagaagtatatatttttctattaccactcagaaaattagtgatacacttagaaaagtgaaagagcggtcttttctgctagctaacaacatcttagcagtgacaactaggccactctaaaatttttattaagaaaattgttgaaaactttgatgttttaattgtgggcatcaacattgaaactttttcattagaagaaaacagtgaaatttaacagcggtcataaacttatgtggaaattaaagaaaaggaaggctttttgtgttttccaaaatttccagcagtcaacatttatcagttttgtaaataagaaaaatattaaatattaggctgggcgcagtggctcatgcctgtaatcccagcactttgggaggccaaggcaggcagatcacaacgtcaggagtttgacaccagcctgaccaatatggtgaaaccctgtctcttctaaaaatataaaaattagacaggcatggtggcacacgtctgtaatctcagctactcaggaggctgaggcaggagaaccgcctgaacccaggaggcagaggttgcagtgagccaagatcatgccactgccctccagcctgggtgacagagcaagactccgtctcaagaaagaaaaaaagaaaaagaaaaatattaaatgttaatagaacattttgcttctgtgtgaaatagtacgtgtcatttaatcattgataatattgattaatctgtggtgcgctttcagtcagctgagtttgtcttttaattgtatcaatgtaatcatagagtttaggtttcaacatgtctcttcgttattaataaatgcatgccttctgccttcggaaaaaagatatacatgcatatatttcaaaagtcactgataaaatagtaacatgagtccttgtagttgtaaattatttattagttaaatgcctcaaaactgaatacctttcaaataattacaaattgatttattggcctttttagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggtgagtatggggaaaaacattacggacaagggcctggtggtctttatatgtatttcaaataaaacagccattagcgatatccttgaagaagctgtcttcattgtttatgtagttttctaatactaggcaaaactaactccaggtattttattttccttaggacgttcccaaaatcctgtccagcccatcggcccacaaaccccaaaagcgtgtgacagtaagctaacctttgatgctataactacgattcggggagaagtgatgttctttaaagacaggtaagatgtcagttcttctttgtgatctgcatttgtaataataacaacattcaccactatgattaactattatgcttcacatgttacttatttcatgctgatttacatctataatcacatggtagcaaccacatgcatttgtgcaacataatgtacttgtaacaactttgtttttctacatgtattaggtcaactgattctcagaaaatatagttgatttagaaaatcagtatgtatgatctttttttacagattagcaaagtaagtcagagagaaggaaagagatcttttgggggcatagagctcattggtagcagagcagttattggtcttctgttccctatttcaggtctcttttcattatgccactctttatggtgataagtatcattggactttcttaggagaaagtggtcctttccatagcaacatctcactgatgagggttgcatagccatcctttaattatctcccctgccatcctggaaaaatggccctcccaaagcctattaacttgaagggtctctgttgccccctggaggcccagagaagaagagaagagagggcaccaatgctgggaaagtccccaagaactgatgaaatccctcctgggacagataggggcagccacaacgtggtgcttccctcttcaaagaagaatcctagaactccctctgcagcatgtggactcaaaaagttggggtcatctcacatgcaaggaggaggcctgctctctgtaccatagtgattcctaaaggatcaggcaaaataataacacactcttttggtgtgttattgcacaccgcatttggtgaatgatgcagtccacagaaagatcaacacatagaaattcagggtggcctgaaaggctcattctctgcagcctctcaagtgctgtggcactgttttactactctgtagtcgcatctctcctagaattcagggcactggctcataattctttctgccctctctttactttttaagtgtaaaagataaggctggaggtaaactatacagggtgtggttcaatgctgggacaagttaagaaaacacatggttttaaaggaaacctctcagtacaacaggacacacctatcaaaccaaatattactagatggaacaggaccaatttgaggatttgccagaattgaaaggacacagagatcatttaaatgtcgccatgtcgaggagacatgaaaggctagagatagagatagtaactgatttgcctaaggcatcacagccaggcagaggaaggactggacctagaagtcaggtttccgacagccaaggccgtaggcttccctgtggcctggaatctggagctcttctgtgtcagcccacataacagtctatgctgtgctgttaccctagtccctattaagctctataatccactttgtgtaaatactactaaccaagggacaacaaagggattggctgccagagcggagtttaaaaatcaaccttagcctcttaccagctgggtggccttagacacctcccttagtctccccaacctcaatttctcatcctcaaatactctcttgtagtgtccttgtgataaggtctgatgtaaggaatgggcctggtgtgttgtaagtaatcactaaataataggatattagagtcatggtccagttggtaatgtgcacagccgatccctaatggctcaccaaagctgactgttaaattttgaagaattttgcaagctagctgtgaaccatagccattattaaaaattaaattataggccaggtgcagtggctcacacttgtaatcgcagcactttgggaggcggaggcgggggaatcatttgagatcaggagttcaagaccagcctggccaatatggtgaaaccctgtctctactaaaagtacaaaaattagctgggcgtgttggcctgtacctgtaatcccagctactcaggaggctgaggcaggagaatccttgaatctgggaggcagaggttgctctgagccaagattgtaccactacactccagcctgggtgagagagtgagactctgtctcaaaaaagtaaataaataaaaaagagataaaacttaaattatataaacaaaattaaattacattaaaataaaaggtaataaaaataataaaaattcatcagtttgtcataatttttactgcatttttctacttatttatgttcttaaagttacttatgcctattttatttgtatgctatacaatggtgctccactgagactcttgaaattcatcataatgggagtatttcaagctagtgaaatcagcaaatgctataaaccaacccttctttggagagctgaatgttatacatttaccagcacaccactagtgccagcaacaagaaggagctggagctggatatctgccagagattaccagaaattagatggaaacttttcttgctttttttctaatcagattctacatgcgcacaaatcccttctacccggaagttgagctcaatttcatttctgttttctggccacaactgccaaatgggcttgaagctgcttacgaatttgccgacagagatgaagtccggtttttcaaaggtaatctttctaattatttttcactgctttaataaatcaatttttcattccctttggggctgagatataaggttactagctacattctctccagggacttttgaaaatctcagtctcaccaaccaaatcaatgaaagtccatcaacttaactaaacggtgcgtagcgcattttggagtcattttaaacaaaaggcaaatgactggagatagaacgttctggcctttttaatgaatctagatttacaaaaatattttctgcacaaactatgtatttaaaaccccctccatattcctgggagtactcaaagtaaaactcgagacactatgccacgcaccaatatttttgcaaacgtgtgtttaacgtagtacaatgagtaagacatttgactcagccatacactcaaggcaaagaattaaatgcaggtcagatgggccaaacgctttgaaacaggatttttagcctttaaattatgaaattaaatggatgttagagacagaaagtttcaaattcctttttcatgaggggtaaatagcacgtgtgtacagtaacagaaatcttggctttagtatatgagaccagctttatgtgatgaggggcttactgagtataaacacggaatctggacacagcattaattcaagtatttggaactatcttctagtcaaatgcagtgatttgaatccaggattgcaaacccttacaggttatgagtcactacagcacttcaccctttatgatacaaatggtttgaacttccacagtccatgagcaaacctggagaaccgaagtttatatcaccaaggtggcataactaactctttagtcatttgaacatctgactgtggaaagaagcccccaactccataaacaagtcattctcaaagcttgctgcagattagaatcaactaagaagcttccaaagatagacacatttaattggtctgggatagggtcctggcatcagtattttcaaaaatctccctagatgattctaatctgcagccagggtactgcactagcatgtgaaactaagaacttagctgaaaattcacttactgcctattgaagtcttaggcaagtgttttatcactctttcttgattggcagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtaagtttaagtgcagagaatgttagggcctcagttctttctacataaaaagttctagaatagcccatttcaaagtgagtctcaaactgccttggccggcatcctttccttcagatggctggtgccaatctatcatctatttagtctattgaccaataatcatcacacaatgcctgcactgggaatccagagaatgtagggggatgaattttaaaaggatgtagaattgaggacattcatcttaacggagctactttggccaaaagttacttatcttccatagtatgttacctcgataggacatagcgtagaacctactggagaattcgatgctggatttcagaggggccttaaaggccttttagttcacccaacattccaccttatcccatccactccccatttcacaaatgatctataaaatgaaatattctggttaaattcctcattgtgtattttctgtaatgattttcagagtgcacatgtttagcaaaaggtctgacactcttaactcttttctgaccaggtatgatgaatataaacgatctatggatccaggttatcccaaaatgatagcacatgactttcctggaattggccacaaagttgatgcagttttcatgaaagatggtaagtgaatatacatgtatttcctccatttcattgccgtagcaataacatcattattgttagttggaacagcaaatgccaaaaatatctgtgctcacagatgaattggtttctcaagaattcaagttaaacctagaaactacttgtataatgtagtaagtctcttttgttttgtttctaggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgttttatacactttctatatttattattgttactttctgatgacaacgccacccttacagagactgcttttcaaatttgaaatgggaagtagacaatataaaaaatgttcatgtgggaaatgaggatatacaaaaaactcaactattctctattcacatggaatttataccatataaactggggtgggggaggggaatccatttcccttgccccatttatggattccaaaagtggttttaggtaaaatcagtgacatcatggtagagcgttctaggtgtatgtcattttgtctcttctgaacatatgggagggttccattttcccacagtccaactccttgcagagttgggtggtgggcagtggggcatctgactacttctagccagagggttgagtgaagaagtgacaaatatcattttcagactggaacatttaattgctggtggaaatttctctagtagtctactccttctgtcctgtggtagaagtacatcatgagagagttgccacaagacagaacaagctgaattgctggaggtaaatgctccaaatagttacacaaacctcagtagactttgcttaagcaggaaatcaaattttaggctggccatggtggctcacacctataatcctagcattttgggtggctgagacaggaggattgcttgagactaggagtttgagaccagcctgggcaacatagtaaggctctacgtctacaaaaaaaaatttaaaaatagctgagtatagtggtacacacctgtattcccagctactctgagggctgagatgggaggatcacttgagcccaggagttggaggcttcagtgagtcataatcgcaccactttattagttcgttctcacattgctataaagaattacctctgactggataatttataaagaaaagaggtttaattggctcacggtttcaccggctgtacagggagcatggctggaaagacctcaggaaacttataatcatgacagaaggtgaaagagaagccggcatgtcctacgtggctggagcaagaggaagagagagagcaggtggaagtgctacacactttcaaacaaccagatcttgtgagaactcactcactatcacaagaacagcaaaggggaaatccactcacatgattcagttacctcccaccagatccctcctccaacgctgaggaattacaattccacacaagatttgcctcgggacacagagccaaaccatatcaccgctgcgctccagcctgggttacagaatgagattcttgtctctaaacatatatacaacttttatttcctaagccactaagattttctatttgattaatgctgcataatatagtttgtcaagataatcactagtttatcatgactaatttgggaggaaagtttatgtaggcaggagtcttgcaagtagctttacacaggcagaagcaagctctacacaggcagaagtagtacctccctcttgccagaggagcacaaactatgcttgcatggagaattgataaagacctcatttgagacaaaaacctcacaagatagtgcttgccctcatcccagattgatcttccctctgctcattattttcaggcaaatgactaagatcaggtctcagcatagttcagatcctagctatggtaggaaatataggttactaaccaaaagaattataggacctgggcattaagtatcatcagaaatcaaggaaacacatatgggagtaaatctgaaaggcatcagattaagttgggggatgtaaggctgaagagagaagaatttattgacatcgatacacacattcttgacttgggaatcaatttcctagaaaggaaaccaggagcttgtctaatactctgctgacatggattctcaaatcttggacacaatgatgtcctgtggcatatgaggtggagatgccagaatttctgtggcatgattttgaggaagaagtcagaaggcacagagagatttgaaccttaaaatgaatctattacat

SEQ ID NO: 12095 - DNA, 14112 bp, Human
attatcaagaattatgtactgtacacaattgcatgtgctagactttcgtatggcagcacagtaggtttgtttacaccagcatcatcacaaacacatgggtaatgtattgtactatgacattatgttggctacaatgacaatagctgatgggtgcttatcagctctgtattagtttgttcttgcattgctatcaaaaatacctgagactgggtaacttataaagaaaagagatttaattggttcacggttctgcaggctatatgagaaccatggtggcaccttcttctggggaggcctcaggaaacttacaatcatggcggaaggcaaaagaggagcctgcactttacatggccagagcaggagaagaaagagaggggctaggtgctacacacttttaaacatccagatctcatgataactcactcactcactatgacaagaacatcaccgatgggatggtgctaaatgggcatgagaaatccgcccccgtgatccaatcacctcccaccaggcttcacctccaacactgggaatgacagttcgacatgagatttgggcagggacacagatccaaaccatatcaagctccattataatcatatgggaccaccatcatatatgtggtccattgttgactgaaacattatacagtgcctgactgtacttgctcaatgtccagctgactttatttgagtctagttgtcagtccttctccctctgatattcaagctgatgtcaccacactgtagagcaaactctttggcaacagtaagtcacaagttgacttggctggctcagtgtatatcccagtttctctccaactctggcttggaagtctcagagcctcttggttcctggaagtctcacctgtccaggctaccttaagtagggtggggatggtgggcgatactgaaaagatcattcctacacacttattattttaatctctcatcactttgcaattatgtacttcagacatggtagagttaatttatctttagtgagagaaaaatatagttctttactataagaatttcagggttctttatattaacaggttaatttgacaaaacagttattgcagacttactgtgttactgcgtaaaaagcactttatttggctgagaaaacaagaaagaaaatactatttgtgggcaggggtggatcgttagacatgtgaaagaaagggaggatttgaaatcatttcccattacagatctcaatccatctcctcctttgtaccttaagaggagaaagaaagggggaaaagaatttttaaaagcaaagaagaggaagagggtaggaggaccatttcagtctaacatgcaatttaattttttccatttaacaagttttatggagcagttactttgaacataattatacactgggaaatggagaatgagtgaacaccaaagcttctctctttggattcttttctctacatgctccatgtccttctcacaatacccctactccacggccagtaaatccatctgaaaatcaataatagctattgtaaacaaggactcaagaagtgaaatatttgttttaatatctttgtaaataacaactcccacatttagaccacgactatatttggaatttatttccgttgacctacttaattcttacctgcttatatttaagtttaaaacataatcttcttaaaagaaaattgcactgattttaaaatgtcaaaacatttggcattttaccaagcttgtcagctctctttaagtaaatacagagacgtgaattatctagccaattctttttcgtctttacaaacacagaaatcatttcctggggattaatcattctttcaagtttagaaagttgaaggaaaatactgatgtaggctgtatcaccattacattaaatgtttgtgaacattcagacttaaaaaacacatgcatgaatcatactgttggtgatctcagcattgtctctgtataaaagaaaggccactagggggtagagctagaagcccagtagacaaagaaggtaagggcagtgagaatgatgcatcttgcattccttgtgctgttgtgtctgccagtctgctctgcctatcctctgagtggggcagcaaaagaggaggactccaacaaggatcttgcccaggtaattaacggtggcatctattgcagctactggccagctcaattgtgtctacttggtcttccaatacaaagcagaatgattagactagagatcactttgttagaaaactgtagcatcagagaataattaacaggctggaggtggaaattatttttatgttaacagagaagaaaagaaaggttcagaaagggaatataactgctcaaggttacaataaaatagtagcagtatatttgtggctaagtgaaaagaacatatggagaatatatgaaactcctctggctttagaatttatttagttaaaattattggggaggggagcatgctaagtttgatctttaaatcatatcaggtaatagttttcatatttttacttgtcatatttggacaaaagagtttaccacacttcagtcttaaaccaggtctataataacaatgtaagtagaaaaggttagtattctaacttttcacaaaactatgttaaaagagggtttctttaaaaactaacaaaaataatgctagacttgaattttcaatccccaattccttacttgactagcaaactaacattgcaataaaatttaaaaatttgtatgaaatggggagtcttaatgaaaaatcaaattaaatgtgatagcctcttttgttttaagaaactagaggaaaattacgatggattataaaagttggataaatgatggaaaatcacaaaaatgccctaaaaattctattttccattagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggtaatggttcagattagttttcacataatattgaaaccttataagttactcgtcatatttggataagtaacataaagttttctttaacaatttttcataaaggcaggagaaaataacatcctcttcaatttttctcctccaggattgtgaattatacaccagatttgccaagagatgctgttgattctgccattgagaaagctctgaaagtctgggaagaggtgactccactcacattctccaggctgtatgaaggagaggctgatataatgatctcttttgcagttaaaggtaatcaaataaagcatccatttatctggtgtattcatctgttcagactgctatagcaagttaccttagactgggtaatttataaacaacagaaatttattgctcacaattctggaggctgggaagtccaagattaaggtgccagcagatttagtgtctgatgagagcctattcctcatagatggtaccttctgtgtcctcacacgatagaaagggccaggaggttccctcaagcttctttcataaaagcactaatctcattcatgagggcagagcacttacgacataatcacttcctaaagacctaacctcttaatactatatttcattgggcattgagtttcaacatatgaatttgcagcagacaccaacattcagactatagaatctactgttgttttattggaacagggtaaaaagaaattctgaacacttatatttccattaatttgttccctatcagaacatggagacttttactcttttgatggcccaggacacagtttggctcatgcctacccacctggacctgggctttatggagatattcactttgatgatgatgaaaaatggacagaagatgcatcaggtgggtcgtaaacctctcgggaacatttcaggaataatgtccaatcctacccaaaaataattggattatctagaacgagcaataaatcgaatatactagtaactgaatttttttattacctgagttttaaacagaagtactgtttgtttcaatcattattgaagaattttataaaatgtctgtattttcatgtttgcccccaccaagtacaatattgtaaaaaccattcaacctcatctccacaactcaggatcttgtgggggtttgaggatcagcataattaataatgtttttcatcactttaatgatagatgattaggatagaatgaattccattaaaccagttccaatcctaacatttgccctcaggttttctttctttcttctcattggcctcctttttacttaaaagtagagatcaggagaaaatgccaggaactgaaaaaaaactgttaggtcatcttttcgaataaacatgtcactgtctctagcttagatgggtttttttcgccctaaattggcttggaaacactttacatctaaacataatgactaaaattaactgtatgctatttaatttttaaaatggcttctgaagtttagaaacacactgttgaaataatcactatttctgacagtgcctgggatttttaatgtaaatgcaaagaacatctttcctgagtacaagactcaggaggctgaggcacgagaatcactgaacccaggagatggaggctgcagtgagccgagattgtaccactgtactccagcctgggcaacagagtgagactctgtctcacgagactgaagtttgtgttgcatgaaatgattgccttttatttgaacaactgttcttttctgcacaattcttggagccttggttaaataatatctactactaaattcaataaaaccctttttataatatttttaaaaagctgaatctagctgtgtttgtgctgcagaaaactgttattgggcatgtttctgttttaaactaaagattgtacacatccaatggcacctattactgggaagatttttgacaatcaaaaattatttgattatggccaggcaccagtggctaatgcctgtaatcccagcattttgggaggccaagttgggtgaatcacttgagaccaggagtttgagaccagcctagccaacatggtgaaaccttatctcaacaaaaatacaaaaattagccgggcatggtagcacgtgcctgtaatcacagctactcaggaggctgaggcacgagaatcgcttggacacatactccagcctgggcgacagaatgagactctgtctcaaaaaaaaaaattacttgagtatgatgaagaggaggaagagaaaatcagactaaaccccacaagaaataaccacagtcttctggcttaaaagtttgaacgtaaatgttatatgattaattttaaccaaggttgcaactggcaagtgttcctaaatttgaacaatgactttttatttttagacaacgaagagttatatttactgacatgctattagtcttgtcctttcaaaaaaaaatcttttgaaaataatgcttctcatttgtcaatataggaaaagtgtcttagttttcctgaccaaggagggatctagggagggatacggtgaaaaactgtcttatatattgacttaaagtcaaccttgaaaaacacattaatttctataaagtatggaatgtgccaatcaatgaaccaatccacaaatactgaaaagacattgtggtttcaaggatggcctgtacagctggcatatgttctgtatgtgtatttatggaagaaagagctggtgaattctgaacatttatgattttcatacaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggtgagtgatgctggaaaaattaggcattgcagctctacaatgacagtcctccagaaagctttccagtgctacctaaagtatttctgatttggcctgaagcactttgagaatgtttgaaaggcacacaaattgacagatgcatcacatttttttttaatgtttgcatccccaaatctgtttcctttaggacctccccctgcctctactgaggaacccctggtgcccacaaaatctgttccttcgggatctgagatgccagccaagtgtgatcctgctttgtccttcgatgccatcagcactctgaggggagaatatctgttctttaaagacaggtcagaccagaaaattatattttcctatctattcttttgatgtacagtgcttagaaagaaaaacagaaacttgacagagctttttttttaattttaggttcaggggtacatgtgcaggtttgttatatagataaactcgtgtcacaggggtttgttgtacagataattttgtcaccccagtactaatcctagtacccagtagttactttttctgcttgacagagattttttaaaatataaaatttcctctacattttaaaatcattcagatctagttcttgctgaatttttaacatcttcttagaattgtccagatcattttttacagacttataagggatgattcttggtccctagactgtaagtttgattaaggcagggagttatatctgtttcgttcatttttttaaaatatcatatatcatggaacttcttcagaaagcactggtggatccttagaagcagggtggtatctttccatttactaatatatgctactatttaaattaattacttttggaaaaaagtgatatgtgcttgtggcacaatatttaaacactaccaaaagatacggagttaaaaaatctctctccagtctttggcctaccgtcctccagctcccttcatatgtgcaaccactgctaccaatttcctttgactctttacaaaaatgttctactcatatacaagcatcaatatacacataatattttttaaaatattaggacataatatgcacactgtttatggacttttagaatggaaccaagctaaataattttactggaaccagtcacaagtcctgccatcgatttcattaccctggaatcacatgcaggaggatggtttaatacagacttctatgaatgggtgaattagcatggatttaaaaaaaaagaatttttttttcacatatctaaaagagaaagacaattgcaagtaattttatgtattacagatatttttggcgaagatcccactggaaccctgaacctgaatttcatttgatttctgcattttggccctctcttccatcatatttggatgctgcatatgaagttaacagcagggacaccgtttttatttttaaaggtgagtactatataagaatttcaacttgctggaataaatcctattgcaaaaattttattgacatgagttttatccattatattaaagtttagattactgaaagaccttgtgctaacacttaaataaaatttgtacaaagaacattataaactttattttagagacctcttaagaaaataggtggcattccatattcataaaaaatgcaagatagtaaaaatgtcaatttatctatagatacaagacattttcatttcaaataccaaatgccaaaagatttttcatggaacttgacaaattagttttacaatttatatggcagaggaaaggccaagaatagccaggatgctcctggtgaacccatcttattagatgaggagaaaagccctgtgttataaaactttaatcggtaagatgtagtatcagtgcagggagagataaattaactaatggagatattcaggtatagaggcttctttatcagacttttaaactactgtttcaatttgttttattggtaatatgctattagagtttctattacttcttgagtcagttttgttaacatgtttttctaaaaatttgccaattttgtctgttttcaaatccatcagaaaaagtttttggaaaattattttgttgtaatttgaattattgctgaagttttgttttctttttcattcttaatactgaatccttttgcctttctcttttttcttcatcaatctcataatatatgtaataattttactgatcttttcaaaggactgacttttggctttatttactctctatattatattttgatttcccatttaattagtttctgttcatatctttattgttgccttaatttttgtttactttgaattgatcctgttattattgttatagcttaagtttgatacttaccttattaacttgtaacttttttcttttctaatacaagcatttatacctataaataaccatttcttctgtttcatccagcaaatttcgatatgcagtattttcattttgttcaattttaattctttaatttctcatttttattttttccctagactcataggtgataatggaatatttttaaatgtcaagctttatggagattttaaaaatatttatttctggcaatctcacttatgtgaagatcaaatgaatgtgaaattgcagtagaaattgtaaaggattacataactctaacgtattgttatcaagtaatgtatctcacatttacatatcacttgcactgtgtcagacgccattctcattggtggaggtcaggactgaaaagggctcatattctagaaggggcagcagagatgaagcctttggcagcctacatatgacaagtgctgggactgagagaaggaagggtgccatgggagcacctgactcatacccaggactcagcaaagatcccttaggggaggtgatgttaggatgggtcttaaagttctctattgttgtgcagagatgggctgggtgtacagaaagtagaaaggtctttaagaaagaagaaattgtttttaccaagtaagagcatatctggaactgctcagacagatacaagtcattcggttcagacgaagcaagagagataaacaacagatggacattttagattagtgaatctggcagtgagtgcgaagaaggaattcaggcttggggtctgggagagtgatgtaacaaagtaaatgcagagagattgatgggattttattgtcctaactcactagaatttgaatgaattccgatagtgttcacaagaagcacagattggaattggtgactgtgaaatatctcaaaggaagtgtccaataagcaactgatctattggtatgaaacttaagagagagaggtctaggtgagaaattcaggttaaaagtttaccaacaattataagaaataactaaaactgatctataaataaactataacatatagatacaaatatataagacacagaaagggcagtgaatcagagttatctactcatttattcattcattcattcactcactcattcagggagtatttattaaggactggctgtgaactggacattattaggttggaattaaaaccaagccttcctctttaccacaacaatgcactataattatttttaaaatcaatggcttcaagtaaaatgtcttggatttattttttcaataggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggaggtgagatgcaagagaaatgactttctatgaagcctgattaagaaaattattttctttctttaaggatatttccctaccctacacccaccctctaactttctctaacttcaaaatttatgattatgaggaagacagcttattgttctaccttccggatacaaaggcctctcagaatggtgatcactgggccatatactcagacactaaaagacatcaggagaggccagctgaggtccaaaggcattcacctcttattccatttccagtcaccatgtggctgccataggaagcccaggtgtggcaggctttggagacaggatctacagggtcccagtgtgactgagaaccagaggtttatttttagctaagtgatttaattaattttgcattatgaattcattatgtctacacagtctttatgtatttatagtagacacagggaaatttggtttctgtgtgtccaggcttagaaaatttacctcagacatatgtatggaacctctgtaaaatggcataatgttcctgtttctggaaaatattgttttatgtgttaaacttgtaagcccaggaaagtaacctattcttgtagctctaaaaatgtttaacacttttttacacaacttaaaaagtttgtctaggattccacactggaaaattaacatcacattatactattgtgtgtaatgggactactgcacatcattgaactgtatttctttcatttggtttagatttgatgaaaatagccagtccatggagcaaggcttccctagactaatagctgatgactttccaggagttgagcctaaggttgatgctgtattacaggcatttggtaagaagacccttatttcattgtcaatgcaggaatctccaggcatttttatgatttcaaaataaagtgcagaatcaaaacagtttttaaatcattcagtctgatatcttttttactccaaattcctgaaaatcttaactttccaatttatgcaaagtgggtttaaatttgtgtgtgtgtgtgtgtgtgtgtgtgtgtgttttcctgaataacttcctagtctctgtttcatatccgcacataaaatcaaaggatacttcctcacacagaagccattatctttcaggtcactatgttggtataaaaatacaatctgtgtgagccaggcttactgatggctggttgtcattctactctatcccatcctgttgtcccttttcttctatcccaccccaggggagccttgtctgggcttctgttgcagtctgcgattgcctgcattagtcatttgtaaataaaatactagtcctcccatatgctcaaaataggtcaaatgtgattcctggtaatgggcaaataggaaagcaaaacttgttcttgattactctgaaggaattttggagggagctgccagtgcttgacaatccaatggtcatgaggctgatgatcttgttactaaaatgacttaaccatgatggatgcaaagcaggaaatggacctctggctcatttatcatttgtctgattctcttgggtctagttgtctcccaaactgtaatttagaacctagcagaagaggggaggttggaaagaaagtaaaacaaggttttaaaatattatagaattttatctctttagaaccagtatgacgtaatgttttagagcacttcctttggagtcagatgagatggagtcctccctccttccttccttacagatgctaccttgttaaaattacaaaaccgtcttaatttttagttttgttctcattaataacacatcacagttttttgtaagggtaattgagataaagcatgtaaagcacttagctcagtgcttggcatagagtaatcacttaataaatgccctccattattaacttgtacttaatctaagttatatgtgttgcaaaatgacatatttgaagatgtctcatcattttccttatctatatttacaggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttccttactttctagaacaattcatgttcaataccctgatcatactggggactgattatttgacagatagtctgccagtaggtgtggtaggaacacacactctataaattagtcatgtggctgtcacataccctctcctattctctgcaccaacaggatctttcttttcatctcacagatattgtaagtgttccttacacacctaacaaagaaagaggtaaatcaacagttgtcctgtatctaggcaggatcaaaacaaaatggagaaatggaactctagaatgttagagcctgggaacctgcatattatttaatagactttccaattttacaggtggggaaataaaactagtttggagtccactcacctcttgttttaacccaaatctttcttcagtgggattcctttcttgctctagagactaaatttctcatctccccctcaccctcaccctcctgttagaatactctcttgctaccattttgtacatggaaacccctgagtgataacagtgcatgtgcacatgccaattttgtgacagatttaccatcacgaagttacatgcttacaccatactgacaacactatagaaacttgttccttcttttattgactaattttaatgccagactttgtcatagttgcaaagtatgaaacagtgaagaaaatacatttaactcaatttcattgagttttgtctggtgagagaaagaaatcaaatgaaagaacataaattaatgtataactacaaattataaagctgttattagagaaacgacaaagctgtaaagaagagtactgttggaggaagggttatctgttaaagtttggttattagagaaagtctctctgggaaaataatgttaaaaacaaagcatctaaatccaaatggccaggtgggtgaatgggtaggaggatttagactactctaaggaaagaaaatgcaaattagtgttgaggcccagtgggtttaaaaaaataaaagtccttggcatgttcaaggaactgaaagatgagtgcctattggcatgttggagagtaggggtggaataagatattagacaggtagacacaatcaaatcatccaatgtctttacagtatactaaagagttgtatttcacttttagtgcattgtagattcatcgagtgagtcttaaacagataagttatgccagccattatatttttgaatgattactttagctggagagagttggaaggaagtgacgacaaaagttggaacaggttaaaaatgacagggaagggtggtagggacaggggacctctgggtagattgagagacatgactggattttttttatttttatttttattttatttttggccctgtcacccaggctggagtgcagtggtgcaacaaccacagctcactgaagccttgatctcccgggcttaggaaatcctcccacctcagcctcctgagtagctgggactgcaggtgtgcaccaccactcccaactaatttttgtacttttggtagagacaggcttttgccatgttgcccaggatgattgggaactccagggctcaagcaatccatctacctcaacctcccaatgtgctgggactacaggttgagccaccatacccagccctgatatatatttcaacatcattcagatttcatgataaactagatagagttctgagaaaaaaggaaggtattaagaataattcctagattaccggcttgaacaaattcttggatcacagcagcttcaacagagtcaggggaaggctgaaagagaagcagttttgtgggagaaagttaagattcagtaggaatcacctcaccttttaaatatagaaattcttgtaagttaaccaactaaaggcattagtaggccattagatggaggaatctggagctcaaaacaaagtagataaaactgtgggtgtttggcggcatcagtcaagccatgggaataggtaagtttatatgggaagattgcagagataaaagaagatggttcaggactgaac

SEQ ID NO: 12096 - DNA, 19566 bp, Human
gcaatctccgcctcctgggttcaagggattaccctgcctcagcctcccgagtagctgggattacaggcgcacgccaccatgcccagctaatttttgtatttttagtagaggcagggtttctccatgttggtcaggctggtcttgaactcccaacctcaggtaatctgcccgcttcggcctcccaaagtgctgggattacaggcgtgagcgggcccagcccctataccccagatttctgcaagtggcaacaccactggcttcattttgctggtggcccctctggccttcccttgtatatatcacctttgcccaaagaccatgtcagccaagggactgctctcacagctccaggaatcctcccctttcaggaaatttgaggcagttgagggcatgaaagtaaataagctgagctcatcagaggccttgtattgtggtggttaaaagagccagttctaggactagaaagcctggcttgaaatcccagctctgccactccctagtggtgtgactttagcaagttcctttacctcttttgtacctcccttttctcacctgtaagatatgggtgataatagtttaatatttgttttgttgttgtgaggattaaaggtgttaatgcaagtaaaccacttagaaccacagcacatagaatatctcagtaaggtggttagttttttttattgttgttttcagagatgctgtgatttctccaaagtggctgtgatggctcggcaggctcctgaccctctctgctcccacatgcctccaccctcatcctgatctcccatccagcttttgacagcttgcttggtgctggacaattgcacacatcttaccacccccaaatcctgcccagaagcatcttgtgcataactctcctacctgaatatgcaacagggagaaagagcgtcccaggacattttaggtttttgaagaaaaaaaaacccctttggtaaaaagccagagatccacagcggccactttttccatgggattgacccctgcaatcttgactttcaaccacacagcaccagagtagccaaacattgcttgtgtccaaacgctggctgccttgaagggtgaaagaataagcagttcccaaactcagctgaccttaatgtccttctagctccttacgcccatctcggacaaaagcagaaatgtatgtctcagttgtgtttctaccccttgctgcccaatataaatttttgtgttgcccaatataattttttgtgacgatggaaatgttctgtatttgtgttgtctgatgagataaccactaactgtagtgctattgagcatttgaaacatggctagtgtaatcaatgaaccaaatttttaattttatttaattgtaattaattttaagtggccacatgcagggagtgactgctgcattggacagcacggctctaaattgagccttttttccttatttggtgaggcatacttgccttaagattgggaagtctatttttggaacctgctaccaatgctggtctcacacttgcaattctcagctgagccaagaggtgagagaaaggtcattttccattccagatctcactctcccctgtgacactgaggaaactggcaagtgatgtgaaggctggagagcgtgtcctgtatgctggctctgtcccttctgcctgtgttgactgacatagttagttgctgcccttgctggtctcccttcctccaaccttgcctctctgagcacacctgacattcatctcatgacttccctaaaaacattctttgggaacaagaaactaacaaatcccaagtgacctatcacatatacaaacatacagggcagagtttggattcgcggtagaagaaagggaggttagacattaagaagaatggtctggtgatgacagttgtgagataatagaaacaggaaaaagaaatctaagttttctttctttttttaagaaccaataataatttctctcttttgactagtcagtagggctggggtggattggaggaagcttacatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaaggcaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcaggtaagacatgttttttttcctgccctggggagaccctgaaaacagaaaggctagtttcctggggcttagctccttcaaacatcctcaagttgctatattatctttctaaaacatagacctactgacatgcctcccttcctcagaaaccttccgtgggtggttcttacagccttcaagatggagtccagactcttttttttttttgagacagagtctccctctgttgctcaggctggagtgcagtggcatgatctcggctcactgcaacctcagcctccctggttcaagcgattctcctgacttggcctcccaagtagcggagactacaggcgcctgccaccacacccagctaaattttttcttttcttttttttttttttttttttgtattttagtacagacggggtttcacatgttggccaggatggtctcgatctcttgacctgctgatccgcccgcctcggcttcccaaagtactgggattatgggcgtgagccactgcactaggcctaatttttttatttttagtagagatggggtttcaccatgttggccaggctggtctggaacccctgacctcaagtggtctgccctcctcagcctcccaaagtgctgagattacaggcatgagccattgcgtctgacccagactccttaatgtgactaactcaaggctttccttgaactacttcttacttgtctttccagctttgtcttttcacctctcaaattgagataaaataataacaacctcttggagttctcatcaggattacatgaaatgagatatgtaacatgcttagcagtgcctgtccatagtaaatctcaataaatgtttgtggaattataatatcttgtcatgtttgagactttgctctgcataatcaggcaccagtaggtttttataaaggaacccggctgtcacgtgcagaggagaaataaacagaaagtttcccatcctcagggagccacctgactgacagaggcacagtgcatccactctccaggtctaggggagaaagcagccttatttcttagtagctcagaatctgacttgagaaacacatccacatagaaaaaaacaaggaactttttcgggtcagggtccgggagccacagtgaggtggaagatacaggggaaggaagagggaaatagagccatccccagggtggaagatctcagaagagaatttgggaaacaaggtatgaacaaggactgaatagtgagaagtgatggagagacagttaaagtagatggagtgacaaaagcaaaacctctaagggtagaataggcagcaatttggccaagtcctaacagggaggcccataggaggattcaacctcaagatgctgtgccacattccaagagggaacctaaaggctgggctgaagagtcagagatggctacagctggcaaaaagatgggcagatgctgagaggagatgattgctaaaatgttctgtccaggacattcacagtatctctataaccagagtcttttttgtcgttgttgttctcaagaaggaaacttgaggccgggtgtggtggtttatgcccataatcccagcgctttggggccaaggcaggcggatcacctgaggtcaggagttcgagaccagcctggccaacagtgtgaaacctcatctttactaaaaatacaaaaattagctggatgcggcggtaggtgcctgtaatgccagctactcgggaggctgaggcaggagaatcacttgaacctgggaggcggaggttgcagggaggcggaggttgcagtgagccaagattgcaccactgcactccagcctgggcgacagagagtaagactgtctcaaaaaataaatgaataaataaaaaggaagaagaagaagaagaacaattgcaatcctccctggctctagaatgtcatttaaaagtcgagtgtcttcttccttccctgttttgaagcagcccttctcatgacaggcttgcttgccaaggttccctctgaccttaaatctcttccttttggtgtcttggacagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggtgagtagtgccatataatattaggtattaactgttgggtggccaagaacaattattctctcaactgagatgagatccctcaacccaaacatctcagtcctgggaatgatttccataaaaatgtacacatcaataaacagaaactcatgcttagggatgtctgttgcatcattattcagagtagcaaggaaattgggatcaaaatcaatgcctttgagtaggtaagtgacagaatgaacaatggtagccatactgtgaatattatgcaggcattaaaaagattattttagcactaggccagatggtttggaggccttctataaggtattattgagtgataagagcaagctgctgtaggatacaaaaacaaaaacaaaaccctagggcatggtggtttgcctcgcagctactcaggaggctgagacgggaggctggcttgagcccaggggtttgcagttacagtgagctatgattgcaccactgcactccaacccgggtgacagagcaaagaccttcacccccactccctacccgtctctaaaaaaaacaaaaacaaaaacaaaaaaacccttgggcccagcgccgtggctcacgcctgtaatcccagcactgtgggaggccgaggtgggcagatcacaaggtcaggagatcgagaccatcctggctaaaacggtgaaaccccgtctctactaaaaatacaaaaaaaaaaaaaaaattagccaggcatggtagcaggcgcctgtagtcccagctactcgggaggctgaggcaggagaatggcgtgaacccggaagcggaggttgcagtgagccaaaatccttccactgcactccagcatgggggacacagcgagactccgtctcaaaaaaaaaaaaaaaaccctgtatttgtgagcgcacacacacacacacacacacacacacctgtgcttggtcctagtgaataagcaagtaaatcaaatgtctaaatataattatagaaaggagatgtcaccttttggctgtacctccactatttcattctgcagaattgcagaatttcttttttttttcctttctttcttttctttttttttttgacacagagtctcgctctgtcacccaggctggagtgcaatggcgccctccgcctcctgggttcaagtgattctcctgcctcagcctcccgagtagctgggattacaggtgcccaccaccacacccagctaatttttgtatttttagtagagacagggtttcaccaggttgtcaaggttggtctcaaactcctgacctcaggtgatccactcgcctcagcctcccaaagtgctgggattacaggcatgagccatggtgcccggcctcagaatttcattttcaacatgttttgcatgatgggtgattttggagaatattttttgctctatcgcaggatgattaagatgtggacaaggtgaagccgatggagggggagctttgaaagttacttgctatttaattgaggaactaaactgctttgagagcctgggggtcagatcctctgccttttcctcctccccacctgcagtgcaaacatcagacaattgatcactattgtatcttggaggtgggagtgaccattgcagtgctgggaccagaagatggcattgtatgtggaacaacaaagcactatttctagagactgcctgcagggatatggaaatagctttatgtgtctcagaatgttcttcatacagctgtttttattggggaaattctacttgccgaaaagtttgatagtgagaccctctccagtttgcagatttttctccttcctgctcaacaacttcctagctcagtaactgcctctcccaacaaactccctcagtttcaccacaccaaaaaaggaagacaagccggttgcggtggctcacacctataatcccaaaactttgggaggccgaggcgggtggatcacctgaggtcgggagttcgagactagcctgaccaacatggagaaaccctgtctctactaaaaacacaaaattagcctggcgtggtggcgcattcctgtaatcccagctgggaggctgaggcaggagaatcgcttgaaccccggaggcggaggttgcagtgagccaagatcgtgccattacactccagtctgggcaagaaaagtggaactccatctcaaaaaaaaaaaaaaaaaaaaaacaaggaagacaaaaagaaaagcagctaaagactttgcctcaggggagaaagttctcttttgggttgctatccacattccaacctcctgttcccacctcttcgtctgcatgcctaagaaactgttttacaagtaaataagggacgctttgtctaggctttggagccaggaagttgagacaaatttaggaatgagatgaagtaatggtattattgcaagtctcaggtgtaactacctctgctctttctctgaagagtttctaatttctcttgtttacttatttttttcttgtcatttttgtgattttattactagttgtctctaatcctttctttaaattcttcattatgaaacataaaaacaaatgccaggcgcggcagctcacgcctgtaatcccagcactttgggaggccgaagcgggcagatcacccgaggtcaggagttcgagaccagcctgatcaacatggagaaaccccgtctctactaaaaaatacaaaattagctaggcgtggtggcacatgccagtaatcccagctacttgagagactgaggcaggagaatcgcttgaaccgggaggcagaggttgcggtgagccaagatcgcgccattgcactccagcctgggcaacaagagcaaaactctgtctcaaaaaaaaaaaaccacatacaaaccagagataatattataatgagcctccaagtgcctaccaccttgctgcagcacttgtcaatccagggaccacccacctcaccggctccccactcattaccaccctcccctactcaattactgaggtaaatcctaggcagcatgatcatttcttttttttctttttatttattttgagacaggatctgtctctgtcacccaggctggagtgtagtggcatatctctgctcactgcagcctctgcctcccgggcagaagccatcctcccacctcagcctacatagtagctgggaccacaggcacacaccaccacacactgctaatgttttgtattttttgtagagactgggttttaccatgttgatcaggctggtctcaaactcctaggctcaagcaatcctcccacctcggcctcccaaagtgctagaattacaggcgcgagccactgcacccagcgaagaacactttttaaaaaataaataggccgggcgcggtggctcacacctgtaatcccagtactttgggagcccaaggagggcgaatcatgaggtcaagagattgagaccatcctagctaacatggtgaaaccccatttctactacaaatacaaaaacaaaattagcctggcgtggtggcaggcgcctgtagtcccagctacttgggagctgaggcaggagaatggagtgaacccgggaggcggagcttgcagtgagctgagatcatgccactgcactccagcctggggcaacagagtgagactcaaaaaaaaaaaaaaaaaagccccccctccccacacacaataatataaataaataaataaccacaatactattatcacatcttacaaactcaacaaaaatttcttaatatcatcaaatacccagtttgtgttcaaattttcctgattgtttcataaatatactcttacagttggtttcttttagcgagattcaaatgagacccacctgttgacctttgcccttagggtttcccagggtctgaattttgttgacgacattcccatgttgctatgtaatacggtcctccatgccctgtgtttttctgtaaactgatagatgtggaggtgcaatgacatttgtgtttgatttactttggcaaatatagttcatcagtgatactctatacttcttgttgctttacatccggaggctgataatgtctgcttttctctcttttctaattatttgtgaaaggaaaaatgtggggggttgggagaaaaaaacccttaagtacatactcgctaaatcacattgctacaggtaacttccattaagaacttgaaagtaaaggtagctgcattttcccctagggaacacaatgatagacaggagccttagtctacagcttgaaggattgtaattatacctaagcaaccctcctggaccagtttaatgttattagctgtgatgtatccctacctttgatgtcattatccttacttagctcccttaaagcagagatcaagatgaaaagggcttcagctgcagcatggcacatggagattagagtggggcttttggatgctgaggagcagacctagaatgggaaatagatgggagccacagaagtgaaggtccccctccctcattgctcaacctactccacatctccaggtctgcacatctgttcagttactgaatcctgtgtaagctaccttctttttcttttttcttttatttatttatttattttttttttgagatggagttttgctcttgttacccaggctggagtgcaatggtgcaatctcggctcactgcaccctccaactcccaggttcatgcaattctcctccctcagccttccaagtagctgggattacaggctgcaccaccatgtctggctaatttttgtattatcagtagagagagggtttcaccatgttggccaagccggtctcgaactcctgacctcaagtgatccacccaccttggcctcccaaaatgctgggattacaggtgtgagccaccatgcccgctgtaaactaccttcttaaaagctctagaagagggctcttaaccttttgttgtgtgtcatgcaccttccgcaagctgatgaagttgatagacccatctcagaattttttttttttttttgagacagtgtctcactctgtcacccaggattggttgcagtggcacgatcatggctcattgcagcctccacctcccaggctcaagtgatcctcctgactcagcctcttgaatagctgagaccacaggcttgtgtcaccatgcccaggtaatttttaattttttttcgtagaggcagggtctcacattatgttgcccagtctggcctcgagaactcctgggctcaagcaatcttcctgccttggcctcccaaagtggtgggattacaggggagagccaccacacctagccagaagaatgttttaaatacaccaaataaaacatttataccaaaatacagttatcaaaatattaaattaacaagagttagggtgaccctattaattagtgtaatttcaaaatagtaatgaacataagtgatagtttgagatttctgtgacttttctaatgtgacgtgaaaatatttgtgatttttctttttcttttttttttttgagatggagtttcgctcttgttgcccaggctggagtgcaatggcaagatctcggctcacctcaacctccgcctcctgggttcaagcgattctcctgcctcagcctcttgagtagctgggattacaggactgtgccaccacgtccagctaattttgtatttttagtagaaacagggtttctccatgttggtcaggctggtcttgaactcccaacctcaggcgatccgcccgcctcggcctcccaaagtgctgggattacaggtgtgagccaccgcacctggccaatatttgtgatttttattgacgacaaagtcaaaggttctcttcatattattgtggtgtatcgcctacaagcataattaaaataaacactaaatttcagtttaaagtttactgaaaataaatatgtattttttattccctatttaagctttgaatcccctgacttcctataccattaccactgtcctagttcaggttcatgttgttttttactttaattgttatcacagtctcttaacatttctccctatgttctccagtcctgtaggtgctaaatctgacgtggtcacttctcagcttggaatccttcagtgcaccaccacagccttgaactacatatttgaaatacatatttattttcagtaaactttaaactgaaatttagtgtttattttaattatgcttgtaggcgatacaccacaataatatgaagagaacctttgactttgtcgtcaataaaaagtcccttgagggacttcagatgtaagtcccttagctgctcgttaaaactcccccagcctgacccaatacacaatcttgactttaaaccacttgtcattctaaatcactagcatttcctggaaaaaaaagccatttttccttcagggctaagctcagggaccaattctgtgtcaccttctttgaatcctgatgatattcacttctttatttgacctgatttattgggccccagacaccatgctgagtgttggggattcagctctggacaatgtcaaatgtcagtcctgcctttcagatcctttctactgggtgagccctggagtgctggttctcctcgcggtgctgcctgtgctcctcctgcagatcactgttggcctcgtcttcctctgcctgcagtacagactgagaggtacagggcagagggtgggtggatcaggatcctttctttaaatgagctggcttcttggagctacaccacttaacatgtatttgtgagtgacttctgggttcagaagttcttctcactattgagtgataaagaaaaaaaataactccatgatgaaagagttttacatcttacggaatgctttcatatgaataatcggacctagcatttccctatgagctaactatgccatatagtaaccccattttacagaggatacaactgaggccaggagtagttcagtgacttactcaaaccgatataacttataagtggtagagctgaggcctctgtatcatacctagcagctccatgcaacttgggagagtgtgagcttcgaagtcagacaggtctaggctattaggagttttgaataaagatactgaagtgaaagtctctaccacacagtaggcgttcgaaaattgtttcctctttctccattcaacactgaggactcaggttcagctgctgatgaagctcctcttttttgcctagagctttcattctgagccttctcctcctaccaagtgtctccccaatgccagagcaggaagagtcttcactcctccccatgccccacctcccatttgttactaagaggagaggagaaagtagcaaggagggtatggggaatgttctgggggaatgggtgttggtgcgatcaacaacaaagtcctttctctcaccttgaattcatcccagatgcctgcttgtttacttcttccacacaaaaaaaggccttcagccctcatggctgagcagaaagaatctgaatgttagagtcaggcagcctgggtttgaattccatctcaggtactgaactctatagcaaaattcttagattctccaagcttcagttgccttgtctgtcaaatagagaaaacatccttcgtcctaaattgtagggaggattaaagtcatgcaaagtgcctactacaaatccagtcacaaagtagctagctactcactaaatgttcagctcctccctcctcattcagatgggaagtggctttagataaacaaagtggcaacgcagtgggctggagcagctctgtgaactgagaatccaagaaaaggggcgaagagcagctgggatgtattggatgcttgtgctggcttggagcattgctcacattctttattcgctattgtatctagactatagctagagaaagagccgcaaccattggctttaaatccagtgctcttcctactctcctgaggttgtttccaggctgcagagaaatagcctgcacaaggggcccaggcgctgggtgtgggagggtccccaccgagagccagaacatgcaggaactaaaatgttgcctttttctattttaggaaaacttcgagcagagataggtgagttccagtcatcgtttctcccaattcttgccttttggttttttggcataacggaaatggtcccgttcttggaccgtctctccctctcaataccctgttttcccctcagtttccctttctctacagtgggtgtgtcgtgcctagaacaagttttaagtaattaaataacaaagactcaggataaaagatcctttttgagtgccctactaaatccatttccatttgtttctctttcagagaatctccaccggacttttggtaagttccggcatgtctaggccctcccaggtcaacttggtatttcactctagttccagtcacctgggggaacaaggacccctggctcctggttgagtcccttcctctcttctcttttctttctttaaataagaagtcatttgcatttaggattggtaaaatcataataaaaatactcatgtactgtttttatgtgccaggcactattctaactactttacaaaaacgttatcttattctgtttaactccttatgcacatgatctctcttttcaggaatggcaaaacagaggtaaatagatcgtttacacgtaaacctgatgtctggttggggaggtgaaacaaacagaaacaagacacaactgtatcacctgtacttatatttctgctttacaaactcaggatgtttccatgagtacagaacatgactaatcagagaagacctcatagaggaatagaaaagccaccaagccccactaggaattgacccctcaaggacatggtttctagcctttttgttcactgcagattgcccaatgcctaaagataatggcaacagaagagcacccaaatatttgttagataaatgttgcagacactagaaggtgtcattagggcacagatggtaccttctctgagcaaacttccttcacagctcctcctcccgaggctgtaggtgactctactcttgtcacctggcacacagagttctatcgtacgatttaggaaattagaccagtgtgtggaccacacacacacacatctttacacacccaaagaggaggaatagtatctttgttttggaggacttgactatgaaaggtcttaactcctttttgtaccatgaatctctctggcactccagtgaagtctaaaggacccctttgcagaatgtttttaaatatacacataaaatagaacacataggattgcaaaaacaatcattgtactaaaatacagttatcaaccgataatcacatttgtgatatagtaacataaatgtttctttttttttttttttgaggcagagttttgctcttgtcacccaggctggagtgcaatggcgcgatctaggctcactgaaacctctgcctcccgggttcaagcgattctcagcctcctgagtagctgggattacaggtgcccgccaccacacccagctaatttttgtatttttagtagagactaggtttcaccaggttggccaggctggcctcgaactcctgacctcaggtgatccacctgccttggcctcccaaagtgctgggattacgggcatgagccaccgtgcccggccataaatatttctttagccaaagtaatacattaagtaatgtagcagcaagtctaataacctgtaatttctttctttctttctttctttctttttttttgagatgaagtttttttgagatggagtgcaatggcacaatctcggctcactgcaacctccacctcctgggttcaagcgattctcctgcctcagcctcccaagttgctggaactacaggcgcatgccaccatgcccagctaatttttgtatttttagtagagacggggtttcaccatgttggccaggctggtcttgaacccctgacctcaggtgatctgcctgccttggccttccaaagtgctgggattacaggcatgagccaccaggcccagcccaataacctttaatttcaacatactaataaacataaacagtatttcaagatttctgcaataactctaatgggaatgaaaacatctgtggcttccattggtaattaagtcacaggtactgctcatattgtggttagttgtaaaatgttttggtttgttttgttttttccaagacttgggggaatgggtgttggtgggatcaacaagagtcttgctctgtggcccaggctggagtgcaggggcaggatcttggctcactgcaacctccgcctcccaggttcaagcgattctcctgcctcagcctcctgagtagctggcattacaggcatgtgccaccacgcccagctaatttttacatttttagtagagatggggtttcaccatgttggcctggctggtcttgaactcttggcctcatgatccacccgtctcggactcccagagtgttgggattacaggcatgagccaccacacctggcagttgttacatttttaatgaaagaaaatgttaaatccagttattgaaaataaggaggcagtacttttctcatccaagttcatggactttctgaattttgtccccagagtcctttggtgttctaggaccccaggttaaggaaccaaaaaagacaggtgggtggggcatgagggggaacacatgttaaccctgtttgttctggtgaacaattcagatccccactttctgagggtgccctgctggaagataaccctgtttgtaattgtgccggttcttggacccttggttgccttgatcatctgctacaactggctacatcgaagactagcaggtgcagtggctgggcagcaggcaagaccaccaaatagtgggggaccaagtcagctctgaatgggaagccaaaagagaatagaaccaggactcaagattaggggagctgggatttccttattcctctgtccccatgcccaaccccaggctcttctgagaaactgtgaagagaaccacttactggatctgtgggatcccccagtggaaagggcagtgtgggtcactccaaatgtccatagggaggatgtggggaaggtgctattcatcttccactaatcacatatttgtttctttttgttttcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaaccccttgtcttttatgtatttccttccttatccacgcacctgtctccctctactccagcctcattaccccagaggtcagtcctcaggaaaactaaacacaaagaaagagctcagtcagaaaggccatttatttatgtttcaagatgctcactgcctcctttgttttgtctcctttgcaggccttctctcttaggcctcttctcctgggggtatggatcctggggggagattgatcacctccatgcttccattcctccccagccatagtggggacatcatgagagaagccaagccactggcccaggatcacccggcatttatggtggctgctctggcacaggtccttgcctttatagcccctccagtgatccataaggccctctttctccccaaaggagaggtcacagatagggcaaaggtagctcttctgcttccagtgggtctgctggtgtctgaccagcctggaaaatgagctgaaagacttgctgcaatggaagcagtagttgggcggctctgtgaggtgggccttctggtgtctggagagataggatttcttgctaaaagtcaaagaacaatgggggcaacagaagacattgagtcttgagggcttcactggatgagagttggatctggcatcctgacagagggttccagtgatgggtgcctgggtcctggtcacaggtgcttggttcttaagtacagatgcctggttctgggccataggaccctcagttctaaatatgggttcctgggacctggccactggtgcatggttcacatccaaaagcccctggatggacctctggcttctggcgatgggtgtctggaattcagcctgggtgcctggaatcctcaaagtacactcctggtttccatccactggctcctggttttggtgtatcttctggtggcgtttgagctcagactggtcccggaagctcttcccacacacagagcatgaatggggccggtaacccagatggacgcggcggtgacgacttagtccagaagcatcacagtaggtcttgtcacagagcgtgcaacagaagggcctctccccaagatgcatgcgtctgtgatagctgagggacttggggctccgaaacaacttcccacactgactgcagctgttagtcagcttgggattgtgaacaaactggtggctatagaggtaggagcgcctgctgaaacatttgccacaggtgtagcaaaaaaagggtggcccagcctgggatgcttgaagcacccgggtcctgtccatagtcccagctggggcagatagggggcactggccggcccctctgcatgcaaggaagaccttgtcatcactagtcccctcatctctcagactgggatgttgttctcgaagctctttcttcttgccttctacagtgaatgaggaagaataacacaaaattcactgtaagaactccaacagaggcttggcatggtggctcacacctgtaatcccagcactttgggaggccgaggccagcggatcacctgaggttaggagttcgaaaccagcctgaccaacatggtgaaaccctgtctctactacaaatacaaaaattagctgggcgtcatggcatctgcctgtaatctcagctactagggagactgaggcaggacaatcactcgaacccgggaggcggaggttgcagtgagccaagatggtgccactgcactcctgcctgggcaactagagtgaaactctgtctcaaaaaaaaaaaaagaaagaaagaaaaagaagaagaagaaggagaaggagaagaaggagaaggagaagagaaggagaagaagaagaagaaggaagaagaagaagaagaaaagaaaagaagaagaagaagaagacgaagacgaagaagaagaagaagaggaagaagaagaactccaacacagcactccattcagcctaacacacttcttgtctctgcccttgctctcccacccaacacattcatccttacccttgggcctcataggctagaaataagaa

SEQ ID NO: 12097 - DNA, 10751 bp, Human
tcacagaagtcaaagctcaggaaaagcccctcgagggtttttgtgcggcagaggtgggttgtggggtgggattgtgcctgccatagtggaggggccctgcagacccagataaaccttcaagtggccagaagcgggggatggctctgctgggtgctggggctgccatgggccgtgggagccagcagtgtgcccagctccctcagggcccgtcccctaggcccttccgtccactgggccaagcaccgtccctgcccctccctaggggcatggatctgacttgagaggttgtgagagcttacaggcgctgggccgtcggggaggcctcagaagcgtaggacggctgcgcactgccgggccgtgttcagccctggtctggcctcggcctctagaggaggctgcctgcgctccagcaggcccaacccagaacgtgcgcgagctcccttcagcatccctgggcggaaagagggatgggggctctgctgcagaggcagaatccgcgccgctccctccttccttcccccgaccagcctgtgacaaccccggccaggggcgggggcctccgcacaagcctggcgtccacttcctggataaggactccccggcccactccggaccagggctggggcggcctcccaggcgctcactccgctggcaccccaccggaaaacacgtctgcggcccgccccctcccccaaagcacgaccactccgcccgggcccctcgaggatccactcaggttcacgacgggcccgtcctctcggtggtctgaccaccggctggtggagtgggctctggggccgccaggcgaccagggcgcaggcgggggcggacagctcattgggaggggcgccggggcacagtgcggggctcgccccacccccaggtgccccttccccgctctcgcctcgcaggcaccgcatcgggcccgggaatcggtccggacctggcggtgggcgctgggaagaggatccacctccacgtggcccgccccgccccgggggcgcagccagttcccggcgctcactgccccccctctcccggcttccgtccccttctgcgcaggcgccgctccgccccggtcctaggggtgcttccgtggtcggcggctgctgggctccgcgccggggtccgagtcccacgaagccccggcccgagccgccggatgcccgcgcgcagcggggcccaggtgagcgcgcgcctcggccgccccgcggaacagacgcgcccacccccaggcgcagcagcgagcgcggccgcgggagcgggagtgccggggacgggcgtagcgcccaccgccccgagggttcggggcagagccagagcataggccaagggccaagctcgggccgagagcagtggccgcagcgcccgggggctgaacccacggcgcgctggcagcgcgggccgagctgcggagacggtcacgtcagcgtccgttccaggccgactggcagtctccgttctacattaacgtcagcactcccgttaaaaataatgcatctctcccatgccaggaggacttaggtgctgctaaagaccagccctccgggtgctgccaggccggcgctcacccgccaccttcatcttcccttctcctttgccccaggacagccgaggatgtgtggttaggttccccctacccatggggaggccagaggtgggaggctggcggcctgctcggtctcagcagaccctcctagtccctcaggagaccttgcctttgccccacttgctcgttatccagcctgggccatgaagcagaggacagttagggaccctgagcacgcggtggtcaccccggtgctcatccctccctgtgtgtccgaccttggccctgctaagatcctgtgttttgaattctggcaagggttggatgaaagggcagggctccagaaaccagctcagacgtttgcttgggacctgcatgatgagtgggaatcggagggcaccagccctgctgtcccaggctcaggcccccatctgctccccaggtcatgcagcctgggcccccatgccgtgcagctcgcacatatgtggggcagagcagccaccctgcccccagcagcagccgtccatcgtcagacgtgatcatttcctgaggcctcgagtgtgtcagggtgtttgtgcctcataacaacccacaggatggtcacccccgctttgcagatgaagaaaccaaagcaggtggtcagatccagtccttgcacttcctgagcctgaccttaccacacagctgtctcctattcggatgcttatttattttttttcccattacagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtaatgtgaacatagcagcgagggccctcctgaagtgcctgtcactgcagttgtccctgaacccctgtccgctgcctgctggattggccctcagttagtcctccttgtcctcatgcatttagcggctttgctcacactggtccctgcttagcttcatctcagttgcctgaggtcatctgggaagaatgtagagattgtcagtgctgcttgcccagggtggagcaggggtgccactgtctgcccccggctctgggcatctagggcaggagcacttgcaccgttagccttcctcaccggcaatccacctcagtttttccacacgtgggaactgtggctgtggccagtgtcgggctgccccttcccgctgtagtggctcacagtgcagtgctggcttcccagggcccctgcagcttaatgtaggtcaaggatctgggctctgccaatcagacttggagtaagaagcagggactgcccaggtcccatcctggtggggcctacggtgcagcctgtccccacgagcagatgctcacacagccgtggcatcttggctggatctgttgggagcgaggtggtggcggtggtcctcgatgccaaagccccaggcctgcctttctggttctccagaggctccaaggccttccctttgtcctttaatgagcctacttttaggttataatcaccaagaagaaccagaagagaaataccagtgccaggagttgggtgctaaaggagcagaccctagaatgtgggctcgacctcatggagaacagagaacattctgtccccatgcggatccttctaaaagcaccttaagtaatgggcatttgtggccaggtgtggtggctcatgccggtaatcccagcactttgggaggcggaggtgggtggatcacgaggtcaggagtttgagaccagcctgaccaacatggtgaaaccccatctctactaaaaatacaaaaattaggtgggtgtgatgacgggcgcctctaatctcagctacttgggaggctgaggcaggagaatcacttgaacccgggaggcagaggttgcagagagctgagatcacgccattgcactccggcctgggcgacagggcgagactccgtctcaaaaataaaaaaaaaatacaatgggcatttgtgatacaacaaaacagcacgtgtggcaggtgcgtcgtaggaacagggcaagggcccagcatggcatcagggaccacaatacgtttgtctctattcagcatccttgtcaggccacagtcatgcccacttgagcccattggtggacaagatgatgtccagcagagaagagggtgtctcaccctgtgtcccttggatcagggacagccctctgccctctccataacctcctagtggatgcccttgcagacccctcagccaggcttgggtcatgtactcatccctaaaagggtcactgcagtgagttgccatgaaatcccaggccactctctgggctgaggagggtgtggtctcccccaggaggctctgccaacaaggaagaggggtgtgtgttggccatgggggtggggaggggtgagaggccccagtatctgccactggtggaaatggtatcagtgaaatcctgatcagaaatttgggatggaaaaggaaacaatgagaaaagggctgtgggaacctcctctccagagtggtagttgggcccccccagtgtgcccccatggaggcacaggagtgtgcagagtgaagcccctggaggggcattccctctaagctccagggaagatggaacagggccaccctttctcccctggacatggcctggccaagcctggcctgttcacttctgtcctcatggctctggatgcctaaggatttcgggcttcccgcacaggcactgaccccttcttcccaccaccctatctccaggaaggcctcctgaatgctccccacactgaccccttcttcccaccaccctatctccgggaaggcctcctgaatgctccccacactgaccccttcttcccaccaccctatctccgggaaggcctcctgaatgctccccacgctgaccccttcttcccaccaccctatctccgggaaggcctcctgaatgctcccggcgctgaccccttcttcccaccaccctatctccgggaaggcctcctgaatgctccccgcgctgaccccttcttcccaccaccctacctccaggaagccctcctgaatgctccccgcgctgaccccttcttcccaccaccctatctccgggaagccctcctgaatgctccccacgctggccccttcttcccaccaccctacctccgggaaggcctcctgaatgctccccacgctggccccttcttcccaccaccctacctccgggaagccctcctgaatgctccccacgctggccccttcttcccaccaccctacctccaggaagccctcctgaatgctccccgcgctgaccccttcttcccaccaccctatctccgggaaggcctcctgaatgctccccacactgaccccttcttcccaccaccctacctccgggaaggcctcctgaatgctccccgcgctgaccccttcttcccaccaccctacctccgggaaggcctcctgaatactcccccggcgagcatctaagctccagtgcccctcctccccagcccgtgatactgaccatggcctttggcaccacagggcttcgtgggctgaggtgaaggtagcctggctgtccagctgacctatctggcctaaaaacgagaggtgcaggggatgtggttggtccccagtgctctgctgttaactctggggctccgagcagtgacacaactgttggccgttaccaggaccatggtccaggctggggcaccgtggggcagctgggcctactgctcagaaagccggagggtgggagctgagtatgagggtcccttgtggccacctcagcagcccaggtttaggggacttcacgggctctgggattgcccaggtagctggtgtggggacatccttggggtcctgtgccttccgtgatgcctggcctcgtgctaaatgctgatggttttctcaagggcacttgggaaaggaggaatctggggaatggagggtcctgctgagaggacttgacctgcaaggtgaatccatgactgccggttcccagcccagcctggctgtggcctgaggtatcttcggcctgcggtctggttgtctagcagggctggaggagacaactggtgccctcaatagccacattcagcctcagcaggagcaagagaagaggcaggatggagacggggcaaggtccctggctagacctgggcggctgacacaccctgagctggggagatgaggtccaggctgggcactgttagggtgagtggacccccatcccttcccgccctgagcagaaactgactgcccacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggtgagcagtgctggggcacggggggttggagggccggcagagccctgtccgctagcagccaggggaccactaggaggactgaggtggggccagcatttgagcgaggaggtgccacttccaggccaggccagggtttcgggagctctggctacgctgacggggcagggctggttaggttaaaggggtagaaagggccgggtggggccgggcgcggtggctcacgcctgtcatcccagcacttcgggaggccgaggcgggcggatcacctgaggtcaggagttcgacaccagcctggccaacacggtgaaactctgtctctaccaaaaatacaaaaattagctgggtgtggtagtgggcacctgtaatcccagctactagggaggcggaggcaggagaatcgcttgaacccgggaggcggaggttgcagggagccaagatcgcgccattgcactccagcctgggtgacagagcgagactccatctcaaaaaaaaaaaaaaaggaaaggaaaagaaagggttggttggagtggaggcagaaagaaggccgaggacacagtgtcgcctgcccttgacggaggcagcacatgaggatgagaagctgattggagaagaggatgactgcagtgctaagagcagcgtggtcaggttgccaaggatggagcagtgggcacagcagggggacttagggtcagcggaggagtcggtgaggaaagggaggtttggcaggaagtgatcaaaggggtcatgtttttgtcaggatgtgggacttggatgtgttctgtgtgaaggagccagggcacggggctgtggtgatgagggcggccaggctttgactcatttgcaggcggctctgtgggggctcagtgagacaacgaggggcgtgtgccctgcacccacagggatgtagagggtcctgctcctccctactgaggtgggtcagggtgggcagcaggcaccccacctggtgagctggaagcagcgtgggaatcacagaatggacgggaacttaaaggctttgcttggcctggattttatcttgaaatacttttgacagctggctggttgagggtatctgctcacaggaacgccgcatttgctggctttgtccactagtgctcgcccctggctgctgatgcggagcctcacgtggccgcagcccaagagtagggactggcttggccacctacaggctaagcttcgggctcccaggtggctgggagggccaggggtgcacaggtgcatcagagcaggtgctgccttgctggagggccagggctcttctggccagggtccaggtcatcattgtccccagccaggaatccaaggggcctttccaaacctgcagggcagagggaattcgggtatctgtgcttgagtgagcccctgggcccaggagccttcgcttgctgtctctgtttctcaaggggcctggcctggtgagggagggggctaggctggaggagggatcccaagggaggtgagggggcttcgtcagcctcctcctgccctgcctgtgcagggtgttgcagtcagtccttccactgagtcattgcatgggctctcccaacatccggtgcacactggcagctgctctaagccaactcctagcccccaccacttgaccaacacaaacactgagtgggtgaggcagaaggggagcgctggggcctggctaggccaaggcttcctgcttcctggctgaatgatcgcacccgaggactggctctctggagcttcctttgctggctttatagctgctgccagtcacaagaccaggggaagccaggtggaaaggaactgatacccagcatttgtcatgtgtttttaacagtctggctttgtgggggcggccacagtgggggaggccctgcctggtggtggaagccagaggtgcccacaggaggcacacctcatggtgcaggcttggaggatggcaaggtaggcagaggggtctggacacagtgaggtgcagccccctcccaccaggtcagacccaggagatggtgcaggtgcacagagcaggtccctggcccaggcaggaaggcagctgcaccctccctgcagcacaggatgtctggatgtgtactagggcagagaggacaggagcctagggaggctccacttccaaactgtccgtcccacaggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaactgtgccttagccagagctcctctaggtgatcaacccatgtctggagctagctcttcctccaggacacgagagctgggggcctgagtacgtagcgccaggcccggtgtggatgctggggagaatcatcagtgtgggagccgaaagcccccgagggtggggtcctgcacagtgggccatgcctccaccagcaagatgtgcacaggtgacagggcttctccagcctagcagggccagcccaggccctcgtgccccagatggtcaggaccaggtcacagcttggctatgagcctgtttgtggcttctgtggactgtggtgaggactgggccaggaaaggctcagggtagcctgggaggaagaagcgcatggcagacagaggtgctggggagggggccacagggcacttcacaaatggaaggctgtcagagagacagggacaggccacacaagtgtttctgcacattcttcagggtggccacagactggggggtccaaggagcaggtgtagggacagaaggagggtctgagaaacgcacagcccacatgggccttgaaggatgcggcctcacccagagacaggagtcctggcaggcccccctccagcgtggagatgcctacgcgtgcggcaaggactggagggaagcgtaggaacacagagggcagcagccccacagcggaaccaccaggggcaaggacagcggggctctgcaggcttcactgggccacggccagcccgcatccacccaatgccaggcctcagggccaagagggctcagcctcagcacggggggagccctggggtggggagacgcgagcgcccacctgcgcaccccagcagccttccgccctccgcctgggctcaggggagcagagcctggaagacggcaatgacagggtcctcgtgggtggtcaccaccagcacgctgcggaacttgtcaaacagcatgagcagctgggagcgccgcgtgttctcgttgtacataatctcctccaggtggtggcggccgcggaagtagtgaaggagcctggaagggatgggtgggcgtgagcccaacctgacaccagcccccagaggcctctgctgaagagccactgctgggaatcagctctgagctgcccacaggcctgaacagagctggtggtgaaggccagggaggcagccaccacagccccccaacaagggtgggcaggcctcctggaccccatgcccaccacggtcccgctgaccaccaggtgggcggagtgggttcaggacggcagacggctgttcaaacccagaggtgcccaagcctgcgtcctgatgttgggaccagggttctgctggtggcttctttttcgtgctacagtgagtcccacgtagctctggagccaaatggtcactgcttttttttttcctttttttgagagacggagtctcactcagtcacccaggctagattgcagtggctcgatctcagctcactgcaacctcccgcctcccagattcaagcgattctcctgcgtcagcttcccaggtaagctgggactacaggagtgcgctaccacacctggctaatttctctcttttttagtagagacagggtttcattatatgttggccaggctggtctcgaactcctgaactcaggtgatccacccacctcagcctcccaaagtgctgagattataaccgtgagccactgtgcccagcctcctttttttttttttgagacggagtctcgctctgctgcccaggctggaggtgcagtggcgcgatctgggctcactgcacctcccgccttcccgccattctcctcctcccgccaagctccgcctcctgccttcaggccattctcctgcctcagcctccccagtagctgggattacaggcgcccgccaccacacccagctaattttttgtattttttagtagagacggggtttcaccatgttagccaggatgatctcgatctcctgacctcgtgatccacccacctcagcctcccaaagtgctggga

SEQ ID NO: 12098 - DNA, 63644 bp, Human
  misc_feature (1)...(63644): n = A,T,C or G
tggaaataaggcaaaaatattactgcctaccttttcaaagatactgcactaaagaaagcactgtcccacaggactgcccaagggttatccaagtctgggtagcaaggggtcgtctgattcaggcactaccctgagcggaaaacaatggcccaagacctcgaccaaacccagctctccacctgtttttgtacagctttgaactgagaatgcttttttacaatcttaagtggttgagaaaatatcaaaagtagaataatattttgtcacatgtaagtttacatgaaattcaaactttagaagaatttcctcttcacagacatcacatcttcaagagcaaatgcttgagccctaacctgcaagttatagtagaaaagtccagaagtccagcctggtcctcgccaagtttccaactcctatgcctaggggtattttatgcttacaggatctaacttggttacaacgtctaacttttagcagagaggcagtgctgagtagaaactggacttgttaaccatatcaagtcacttaagttggctaggatcccctacttaggtagcggccataaagcctagggcatccctgtgccctcaatggttcacttctgagtggtgggcttcctgctcctcaatagagcaatcggcagaaaggcccctagaaagctacattgtcttcatccgcgaaggattccctgtctcctattcctcaaaggagcacccggattctactttcattcttcttttgccattgcattttataacttaaaagaaatagatgattgtaacagaagaaagaaaactttacattgtgagaaaatttagacctaaagcttatagtaatgtgaggacgaaagtctatactgtttaagtaaataggttctatgagcagcatccaggctaacatcacacagtggtattttgaattaaattgtacttgtgttttgtttccgtgttttgctgctgtaaggaaagaggaaagcatcccctttctcggccctcctcccacgtccaggctaatttgcagcatttctacatctcagagtccacccttaagatccttgccacccattattttgtttcagaacgcttaatccatcaaggaaggttaaattggattaccccagtagggaagggacgggggctgtaagcatgagggattatccctgtaaagggctcgtggtgtgtgtgtgtgtgcgtcctgctagtgttgaatgacggagacctgagtttggattctgaatccaggtgtattcgatgccgctccggcgtagaacgggttaaagatgcccccagccaggtagagccagactgggagttgtgcaaggtctcaaccccctaaaagcggcccctcaaattgaagatgagtaaatcatagttcgtaaatcagaaagattatccagtactacgttactctgtttatttccctttcgtcatccctgagtcttgggtcaagtccatcccagctctgtcctccaggaatcaagggaaatacgcaaacccgcggtgggttcgcagccgcaggaaggacaaatcttgcccccgccgcggcggccgccccgcgttagctgcctaagagaatctccgtggccggccagtacccgccttggtgaggattctccctcccgcgagaacttctggaatgccgccgggccagattttgcagctgaggcctccgacgccactaatattgggccaagcagggagtgctgctcttccttataaggttttagcgaaagttaagtaagccaattaaagtgcaaaacacacagtctggaacaatacagcgctctataaatggtctccattattatcattatccgttagttataactggggataaaaaaaaaaaaaaaacgacaaaaacctggagaaccggaaaggtctgcaaaaggggcggaacgcgggaacttcgatttggggaaggggtggcgggggagatcccacacaagcagccaatccagctgtcccggggaggaagaggaggagtcaaggcccgcccctggtctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaaggtgagatgagccctcccagccgcagcggttcgccctgccggatgccttctcgcccccgcgccgggggaccgcgcctccgggggccatgcgcccggcccgtgcgtcccttgccgccgcggggagggactggggcgcggcactcgggactcacttgccgcgcgaggagagggtacgcttgcaaatgatccccctgccgcaccgccaacacacacacacacacacacacacacacacacacacacacacacacacacaccaccttttggcttatctgcacccgcaccctgtagggcgtaggcacccctttagagagagaggtcgtggatgggagaggctgcacccatgccaccaccattcctgagaaccactcttcttccaagaaagacacccggctggagtcaggaggtgtccgggcgcctgcagcttctgtgaccgtctcctggtgccttgcgggactccagcttccgctctctgactctgcttgttgcctgcggcccacgtgggagaactgcttacttgctcttttgtatgcttccggcttctttttcctccaaacgtaggccttctccgcgctgaagttttccccagcagcgtaatactgtaagaattctgagactttcttcgaaaaggagtacaggcgtccgtttttagggctgcactgtttggaggcctctggcttgaaactgctttgttttgcagccttgcaagttagagttcaatttccttgtgccctaggccctgagaggccttgatacaaggggtcattgtgcggtgggaagctttgtgctgaggagggcacgagttctgagagtagcagctggcttccctggggttttaaacacttctctcctggttagtattccgagagagaattacagcacgtaaagaaaaattgatgataaaacttaagacctcttctaggcagtttattactggctaagaatgcgttcttaacttgtttgatttttagaaatttttggcctatgggataggaaggtctgcgatcttctccaaagcatctcgattccctacactcgactgcagttttcccgggagaaggcgaatttctgcggtcagtgtgtaatcagccagattagtttattaagcccttgcaggtttaaatgagccacttagaatgagaggaatggtgaagggtgttgcatccagacttatatatgaaacttattttgtcattttgaaaagaatcttgcatccagcaaatatttatagaaggcctctcccctgccttcattgtttggcggaaacaaggcagaaatggttttcatgaaactcgtgtgaagtatgtgacttctcttaggtgctcatctataaactgagaattttactgcagaatttgctaggagggctagaattatattgtctatgttgcacatggtagaagcttattaagtggtagtgcttataagtgggggaactgagattaattttgaatgatcttttccccaaaaattattaagttattgtgttaggtatcattaggccacaacttttcaccttatccttgcaggaatacacttcaagcgccattaaaaatggagaaatggtgtttaaaacagtcttactttaatctggttagcattctccctgccacagggtttcccttcaaattaatgcagtgcatttaagtgcagaatgggcaatgggattctcagagacctgatgtaaatattgaatagtgtgtatttttggtcttggcaagcttctggatataaaattaagaggtacatatggtgctaggactgcctgctgatttctcttttaatttagaacagatgacagctttgccgtagagattccatgatgccagcaccgtattccccagacttctaaggcaacattctgtatagaagatgtgaggtgccagtgtccagagcaaaataggttaataaaaaccacatcctattcccaaattatagaatgatggggctggagtgttccttcaagaccatccatatagccacacaaacccgttttgcgggtgtaaagttgaggcccagaaaggtcagctaagtatccagaattacacagctggacctagataatgacagaattgggcctagagcctggcattccaccaactagatgtgaggcatttctgaaatctgaagtgtggtctctgccctgttttcttgtgacctaatgcacaattaaaatgagcacttgatagaatgtccatcttgaagagggaggcagagggtatgcagaaagcaggctgcctccagtgcccactgcacaccacccaggtataggtataggaggcacatgtgtgtctgaaccccattggtgtcactggcaggtcctttgagaggttgctggatttaaatacagtaacatgtaacacactcagcccagttccaggtactcctttaatgtcagcccaagtacctctcttcttaaaatagagatattaacggggtggatcttaaattcattctcaattttagaggtgcagttaactcatgcaagtgaaagattccactgagttttggattggcagtatatttggcatatctttcaaatctagccatctactggtggaatcctattcaaaaatatttattgaatacctgctagacaatggggatgcagctttgagtaagcgaggcctttatttattttcttcaagtttatattctagtcagggtgggaaaccaactgacatgaaagtgaaacagcagtaagattccattgggtgaggggtgtcagaaaagactcctagggaggtggattttaagctgtgcagtagtctgcctccaaaatctgtatgttgaaacctaatcgccaatgtgatggtattagaagatggggcctttgggcgtgattggggtcataaaggtggagccctcatgaatggaagcagtgcccttacaaaagaggccccagagagctgccttattccctctactaagtgagaggacaccatctatgagccaaaacgtgggccttcctcagacactgaatctgctgtgaccttgaacttgctaagcctccagactatgagaaatttctgctgtttataagccacccagtcctaagatattttgttatagcagcctgaatggacttaagctgatagtgaaaatagggataaagggtaaagatccaagtgaagacctgaggagagagatgggggtaggagagcgaaaaccaagatgtcgcagaagtgagctcagtgtggtaggaatggaaatcacggatgcacagtgagaattgggtggatgcagctcataaggccatccttgtagaccgcgatcaagaattttgattttaaatgttttggaaactgttgaagggttaagagtgggaggcagcatttgatttacattttaaaatgattactctggctgttgtatacagaatagcctgtgggcaggggaagagctaagagatcaggccagaagtcttggtgctggggctgaagtctagggtgggagccatggaggtggtgaggaataatcagattggggatagaatttgcaggtagaacacagagatggataagatgtggggagtgcaggaagaagaacaggatgatttctgcttttgacctggaaaaccaaaaagatgatgatactggtggatcatttcaaagtgggcgataaggggccacgagtgactccttggagccaaggagggtgagtgtaggattccttcctcccagatactgctggttagggggccagaggctgggatgctgaggggcctctttgctgtaggagcagagtgggtggcaggttgagggagggaggaagccacctggagtgagagtaattcaagcaatcttttttgtggttcactgcagtgagagatggtccaggcagggagtgaggatattacctggggggtagccatggagagaggcagcaggagccagaggctatgggattaacactgccattgtctgagaggacctcagggagacattgtcctccagcatcagccaagggcaggtggtattcctgacagagggccaaaccagtctttggcacccagatacagggcattctggagggctcctgcagtgtaccatggctcccctgggcagcctcccagctttcattctgggagattaaaaataagacttggccaggcgcggtggctcatgcctgtaatcccaacactttgggaggcccagctgggcagattacctgagctcagaagttcaagaccagcctgggcaacatggtgaaaccccatttctacaaaaaatacaaaaattagccaggcacggtgctgcacgcatgtaatcccagctactcaggaggccaaggtgggcgaatctcttgagcccaggaggcagaggttgcagtgagcagagactgcgccattgcactccagcctgggcgacagagtaagatcctgtctcaaaataataataataataacaacaacttgttaatcatggttgctgtgacaaggaggggatatggtcccattgtaggttggtagtgagctatcaacataatgatattaagggagatggacaagtcatggtttgtagactgtggaatatgggcctttacactccctgctttgctgtcttgagtgtggcctgcaagggccttcagcctgagagtccttgtgtggctatctgaaactgaggacaacctgcaggccccagttgaaaatcacatgaccaacaagccttcattttttttgcctagggacacaagggcattttgggcaggacaattatttcttttgtaggactgtcccaagcattgcaggacatggagtacaacccttaacctcctccacagaaatgccagtagcactccccctagtcatgacagccagaaatagccctgtttccagatacccccaggagagctgtttgacatttagttgaggaccccaaggctaaatcccaaaaaagactacctgctgaagagaggtaggagcagccaggttttgtactgctcagcagagtaaaaggaggaaataagggctttttttgttgctttgaggaagtttattttgattttttatttttgccaggagtggtagggtatacagaaacagagactgatggtaatacattatttcattttattctcttgataattttatggattagtaaaaatcttaccctataggtacagctgaggaagcagttaaggaaaatgtttgtatgcagtggattctggatcctcacctgtggttgtagtcatggcattccagcctgtgcctcaaaagcatctaaagcagtggttctcaaagcgtgtcatgcattcatatcacctggtcatttgctagaaatgcaagttcataggccccaccccagtcccagtgaatcagaaactctggggctggggcccagcaatctaggttttgacaagccttagaatattcagatgtccaccgaagtttgacagccactgacctagagagctttggaaagggtggccatctacatttttaacaagttcttcccttagtgttatagtttcctgttgctgctataacaattttcacaaatggagtggcttaagacaacacacatgaggccgggcatggtggctcatgcctgtaatcatagcactttgggaggctgaggtggatagactgcttgagctcaggcgttcaagaccagcctgggcagcatggtgaaagctcatctctgcaaaaaaaaaaacaaaaaaattagccaggcgtggcggtgcacgcttgtagttcagctccttgggggctgaggtaggagggtcacttgaacccaggaggttgaggctgcagtgagctgagatttcaccactgcactccagcagcctgggtgacaaagtgagactctgtttccaaaaaaaaaaaaaaacacacacacacacacaaacgtattctcttacagttctggagtccacaaatccaaaatgagtcttacagggctaaaattaacatgtgtatcgggctggttcctcttagaaaaaccatttccttgcctttttcagtcttctgaacctgtagaaccatgagctaaataagcctcttttctttataaattaccctatctcaggtattctgttatagcagcagaaaacagactaagaaaaatgttgtgcttgtaagagattgggacacggacacatacagagggaagaccatgtgaagacacatggagaacgctgccatctacaagccaaggagactgaccttagaagaaatcaatcccaatctcaccttaatgttggacttctagcctccagaactgtgagaagataagtttctcttgcttatggggaaaacctatttccttgcctttttcagcttctggaggcaccagcacttcttggcccatggccccacatcatgtccccttttctctccctctgcttctatcattatatcactttcttcctcatttgaccttcttgcctccttgtgatttcatttaggtcccacccaggtaatctaggataatctccccatctcaagatcctggatttaatcatatttgaggtaacattcccaggttctgggaattaggatgtagctaggatctcttgggacaggggcattgttcagcttgccacactcagcccatgttttaaaaatttatggtctaggggccgggcgcggtggctcatgcctgtaatcccagcactttgggaggctgaggcgggcggatcacaagatccgaagattgagaccatcctggctaacatggtgaaaccccgtctctactaaaaatacaaaaaattagccgggcacggtggcagcctcctgtcatcccagctacttgggagactaaggcaggagaatggtgtgaaactgggaggcggagcttgcagtgagccgagatcgcaccactgcactccagcctgggcgacagagtgagactccgtctcaaaaaaaaaaaaaaagaaagaaatttatggtctaggccctagagcaggttgcttagttctgagggcactttagaaccacctgcggagctttaaaaacaaactacgccttgcccaactaatcagaatccctgaggcctgggctttggtattgaaagctagagaaggggaatgtcctagtatccagcagctggttcaggagggtgggtggctcccactgttgctccacaggcaaaggagagctctaacaaagtatgcattagggagagtcctcctctaaaaatatctggccatttcagcaggtgaagtgtgtctttaagagggtgtctgccctttagactgatatctgtacttctcaaggggcatttgctcaaataaaaaccatggatgttttgagcgcttgcatcatccaagcttctctgactaaaatatagagtcactgtattagttcgctaggcctgctataacaaagcactacagaatgggtagcttatgcaacagaagcattatctcctcacagcgctggaggttagaagtccaagatcaaggtgagatcaaggtggatttcttgtaaggtcagtctgcttggcttgtacatggcaatgttctccatttgtcttcacagggtcttccctctgtatgtggttatatcccaatctcttgtaaggacaacagttttcttagtctgttttctgttgctataacagaatacctgagacagggtaatttataaagagaagaggtttatttaaaagaaatgaaagggagacgagggagataggaaaaggaaacaaaaaagagacaaactttgcttcataacaacccactctcactggaactaatccaacccaatgagagcaagaacaccctcccctgggactgcatgaatcccttaattggggtggattattaccatggctcatgactcaaactcctcttaaaggtactacctcccagcatcactatatttggggaccaagcctcaacatgagttttgaagatgaccacattcaaaccataacatgaggtatactgcattagggcccatcccagtgacctcatttgatctgaattacctctttaaaaacggcaaatacagtcacattctgaggtactgagagttggaacttcaacctatgaacttaggggagatacaattccatccataaccattacctacaagggtggcctacagagggggtgtcttgtcagagatggagaccccagctatccctgtggaccctattgcaggtttttaacagtcctcacagcctgagacagttggttgctccctctcatacagctaggcttccaggattttgcaaggccctgacaggcctcaaagccatgtcagcctaataatgagggcctccgtctgctgtgcttgccaaaattgttatggcaaccagagctaaaggactgcagtgctcagatcgggctgtgccagctccagctctggctcgcttaccttatcgtgagcttgaggcactcagaggcagcccatctccctggcatgagctagtctcaaccgcttggggtgatggtattttgaaaatgccattatagagtgctgggttccttacggcagtgtgcccaggcctcaaagtgatggtgaatggtttctgggacaaagaagggttggtaaaatctcctgtagccaggtactagaagaaatagacagagtaggggttactatgcaccctttccacattgctagaagtaactgttctgaccaggtgaactggtatttggataaatgctttcacagtctcagagaagtcagacccttggattgatttgctcttgaacaaaaaaattttttttttcactgtgaaaatgctttctttggggtgtctttagaacatgtgatgtcaagacacaacagcaagcgcacatacactaagacatggctgtcatagaacagattgtgcgtgaataaagggttcacaccacttccaccctttacacagtaacagaaggctctaggccacctacctcctccttggctcactcaaactcttcctcctcagccgtggcctcctgctactgctggtactcagacaccaggtcgttcatgttgctttcagcctcggtgaattccatctcatccatgccctcgcccgtgtaccagtacaggaaagctttgcaccgaagtatacctgtgaactgctctgagatgcccttgatcagatcctagatagcagtgttgttgccagtgaaggtggccggacatctttagccctgagggtgggaagtcacacacagctgtttttatatcttgggggatccaaccaacaaagtagctgctgttcatattttgggcattaagcatgtgcatgtccacctccttcatggacatgtggcccctgaacatggcagctaccattacgtagcaaccatggcagaggttgcaggcagccatcatattcttggcatcaaagaactgccaagtgggctcacgcaccatgagggcccagtactgctggttgtcccagctggtcagcagggggaagccatacatgaagtgcaggtgggggaacaggaccatgtttgcggccagcttctgcaagtcagcattgagttggccagggaaatgcagacagatggtgaccccactcatggctgcagacaccaggtggttcaagtcactgtaggtaggtgtgggcagctttagggttctgaggcagatgtcatagagagctttatttattatcattgcagaaggtctagttttgagaagtttggtttgatggtcagtccgtggaaaagtgtggcatgagccactagcttttaaaatctgtcaaggaccttgattgactccctatttcagaactctatcttgtgtaataaagaagtcctggctgggcagaaattccatctcaggtcttgaacacatttcctacacagtctagaattaactggactgaggactgacgcttcctgcccaggaggcctggcaaggtcttgtcattgtttcctgagggtggatgaggtcattaagaaagagttttcctcccctctgagatgattcactcagatacctggagtcactgtttctgtgcttgttctgtgaccttcgtcatgaacttgacctctctgagcatgttgtctcataacatggagacaaataacttttctaataaggtataatgttatggaggactccaggggatattgggagagggcacatcatagtggttaagcctgaaagacctagatttgtatcccagctttgctccttatgattggcccctggacgaggtttttaatttttgtgcttctctttcttcgtttgtaaaacgggtaacattctatagggcccatcttatggtcctgatgatgaaataaggtaaggccactgaagcacttagcacagtgcctttaacatgtaagtccacagacacagttactttataactaaggcagtactgagttgacacaaacttagagactcaaaggaatgtggatagaattgggccatcagtgcttgggtacttcatcccagttgtactttgctgtggagccagcaggtggcgacattggccacatcttggccctgctggcctccatcttagaggtccagtttcctgggatggcgggactcagttgctacacttgtccctgtatccctcgcacaatgtaggtttccgtaaacaactggacctagtaaagtgactggatgggcttgcctgcagatcattccagagcagtagccactcttgctttcatgtccagggctactacatgttccttgctgagggctgagttgccagctacctggtgcagagtcattatgcagccaggtggtgcagactgaagcttggggttgctgagagtgagctcaggggctctgaaattcagcgggacacctggttagcatttctcaacaactgctacaatgctgggcaagttcacctaaactcagagggtggctccaaacaaagcccaactcgatttgtgtatttgatcccgagcatccagtgttgaatccagaatctgagatgccctggctcagggaacacccagaaacagccaggccaaagtggtgataagttaaaaagctagtagctgaatccccagggagctggctgagagtaatttcagagtcagcagttcatatctgtgtcccaggtgaggatatgggctggatggtttcttagcctcctcatgacctgtggtgcttcagaggtccacggaatgaaggataagatggagaagccaggctaaggaaggattgggatttcctaaaacagtatgaatttttgttattttctattgaagtgccgtaatttaaatgtattgacttaagtgaacacttctgttgatttgaaagctataatactggttactctttgttcgttgacataaaagtatgttaacctgctgtggttttaataatatacctccacaagatggcgccaacatcaaagcctggctttgccacttaaggaaattgtggtggacagtcacaaattatgtaaccatgtcatgggaaacaggcagagttcttcagtaaaaacctcactaaattgtccttattttcttgtttgttttttgttgttgttgctttttttgtgtgtgtgttttgtttttttcaggaaactgagccagaaaggtaaccatttttttacgtgttgataggactcaacttgtgtaacctgacctgaaaattatttaatgcagatgttcactgaattcttaatcctggaatttttttcttgaggcctactttattttatttagttacccttgtgacaatagatttaaagcttttcattgaaaaacaacaatgctcaggtcacttcgcattaattaggtttctaataaagttagcctggcactgtttactctctaggaggtaccagcccaaggaaatttccctaatgatttgttacttatttttagttttaacagtttagttaatttttatttatttttgtaattgttcttgtttgtctttcttaatcatcaaattagatcaactctcagaggatagtgctaggtttctttaactcagacaaggactttcaagataatctctgaaaaatgcaatacaatgcatgaacttaaaaaaaacttataactaccttttgaattatttatatttgcataaatgtatttactgagtaatatacatgagtatgctatatgtatatttacaacatgtaaatatgaatttgcatacatatatgaatgattgttttcataaatgtatatgcgggtaacttttcatgcaatttcagtctcctctgtctgcattctctcctagctctgtgattctaatggcgtgggaaagataatctctcatttctttatcaaatagaacagtgaggagaaatcaataccaaatggaatacctaatattttatatcccagcagtcttctgaacattgtttattctatagtccatttgacagagaaacaaaattgatcagaaggtactttccactaccatacttgcctacttttaggtttgattttctaccttgagttggttaaaatacctctctatgctgacttgtaattcagacagtcagaagtaaatgtgatgtagtccaaaaaggtgccctacgttttggttacttatagaatatagaaggccttcaaatgtttgttgatttttatggaaggctttgaaatatttgttgattgatgttcagtaattttcagatttcaaaaaaataactagggcttggcaggaatggagaagagcatatgaataaatgaatttgcttagaatcttatttctaataaaaattaccaaatacaataatcttctctgtctttttctctcttagattggaataattggtggaacaggcctggatgatccagaaattttagaaggaagaactgaaaaatatgtggatactccatttggcaaggttaatatccaacttgtggagacatgttttttagttttttcatttctccttgctggcttgatttttgaattaaaaaaaaaaaaaaaagaattgcttttgttttggcagcccagggctgtctgctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccacagactcatttcagactgtacttttcaaatctacattcaaatcttctaatttgtggccaataggtcacaccacactaattaggggacaggctgatgactaataggatgaattattgttacgaagcggcatttgagtggaaagaattgttttggggaattagaacatacctgatgttagttgaatgtgtaactgagctagaaataaaatgctcctccttttataggagaggttgcttgttctccaagcccatgtcactcagcctaggccggggtgagggtgtctgcattctcctaattccatattgctacgtcctctggtccatctgtaagatctctctatctggctgtcccaaccaaaccctccttttcagctaaattcttaggttgaccttgtgtgctcccagtcctgcagtcatcctggttcattttcttaaacccctcggttctaagggtctttccagcctttgttacctcaagtcatttccatgatcatcttagacctggttaacacaagcagacatttccagtgctgaattcttagtgtcatgatggtggcttgttatcctttctgcctttcaccttcacacctgttctcaaacctgcccaataaccttgacacatctaaatttgaccagtctaccatcagagttccctggggtactcgttacaaatagatctgactaaatggtacctacacaggtgcccatggtaaccttgagtcctgtgaatctatgcctgcagagggatcaataagtaattgattaaatgattatattgataatcagatcttgcctcttctctaagttgtatcctcagactcttcagattccatgagtcctgttgtggttgaacaattataatttacatacctgtttttaaatcactgagttaaatgtcattttttcattgcatgcagccatctgatgccttaattttggggaagataaaaaatgttgattgcgtcctccttgcaaggtatggtattttaagctttttggatgttactactaaaggataatttaaatttaacttaaattctggaaagagtaaagatacaggtctgagcttttatatgttggcagaatcagaacatcttagtaacctttatttacaatgttttatttttggttaagttatattgacttaggagatcaaagatctcatgctcttgccccttacattgggaaagtagatcagatgactaaaatcaaagctctggttttagttctaactgcaagaagaaatgttttgttcatttttttcccccttcttataaagataaagaaaaacaatgcatcattaatgacctcttgctggtagtagttatatgtctgtgggaagtaggcttagggcttctgaagtgggttacttgtgtctgtgctgttgtttccttaaggaggctggtgctgctccatattacagaggaggccaagtcatttttatcccattgttagaagttagtcaagatatatgtatgagttctctactgttgtgtaacaaattaccacaaatttagcagcttaaaatagcacacatcatctcctagttcctgttggtcagaagtctggcacagcttagccagtcctctgcttggggttgcacaaggccccacaaggcatattcaaggactgagtccccatctggagcttgaggtccttgttcaagctcgtgtagttgtaggagaattcactccctagaagttacagggcggaggcctttggctcctagaggtggttcacattccctgccgtgtggcctgctccacaggctgttcacttgactgcagcttgcttcttgctattaggatatggcaaaggtgctagaagtcacctccatggttaagctgtaccttgcaagcatgcaggagtccggcaggagaatctcctatgcatgcttgcaaggtagagcctaatcgtgggagtgacttatagcacgtttaccatttttctattggctggatgcaagtcccaggttcactgaccctttatacagagcatgacagtggggtcctcactagggtctgtctgccactctacatatttgaaacaggagtggcttctcagaatccagtgaacctaaattttagttttagttgctcactggactgggttctaggagaccccctgtgttagtctgtggtcattgctagagaatcacttaattttttctagactctaggagaaaacagttggtggtgtactcatcacgggttaacaatttcttctctccttccataggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggtaagcagtcatacaaaatgctttaggctattgtagctggtcattttcagctcaaatggacgacgcgtgggaaccggcagggcaactgggagggcagtgccacagacttgcttgcttttttttttttttttttttttttttggagacggagcctcactctgtctcccaggctggagtgcagtggcatgaactcagctcactgaaacctccgcctcccaggttcaagcaatgcttctgtcttagcctcccgagtagctgggactacaggcacatgccacaatgcccagctaatttttgtatttttagtagagatggagtttcgtcatattggtcaggctggtcttgaatcaggagatcacccgcctccgcctcccaaagcgcaaagtgctgggattacaggcgtgagccactgcacccagcctgtgttaagcttttcattgtgagtttttgttttttaattttaattgacaaatgataaatgtatatatgaggtataacattatattttgatatatgtatgcattgtacaatgattagcaaagctaattaacatattaccccacatatcatctttagtggtgagaacatttgatttttactttaacaattttgaaatacataatacgttgtcattagctataatcaccatgcagtataatctcaaaaacttattcctcctgtctaactgaaattttgtgctttgatcaacgtctccccaaaccccagcccctggtaacctttctactctttacttctatgagtttgacttagttagattccacatataggtgagatcatgcagtatttgtctttccatggctggtttatttcacttaacataatgtccaggttcacccatgttgtggcaattgacagagttgcgttctcttttaaggctaaatggtattctgttgtgtatatataccacattttcttttttttttttttaattgtacttttaagttctagggtacatgtgcacaacgtgcaggtttgttacatatgtgtacatgtgccatgttggtgtgctgcacccattaactcgtcatttacattgggtatatctcctggtgcttttcccttccccacttcccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgttgaatattggcccccactctcttctggcttgtagagtttctgccgagagatctgcttttagtctgatgggcttcccttgtgggtaacccgacctttctctctggctgtccttaacattttttccttcatttcaactttggtgaatctgacaattatgtgtcttggagttgctcttctcgaggagtatctttgtggcgttctctgtatttcctgagtttgaatgttggcctgccttgctagattggggaagttctcctggataatatcctgcagactgttttccaacttggttccattctctctgtcactttccggtacaccaatcagatgtagatttggtcttttcacatagtcccatatttcttggaggcttcgttcatttctttttactcttttttctctaaacttctcgcttcatttcattcatctgatcttcaatcactgataccctttcttccagttgatggaatcggctactgaggcttgtgcattcgtcacgtagttctcgtactatggttttcagctccatcaggtcatttaaggacttctctacactggttattctagttagccattcgtctaatcttttttcaaggtttttagcttctttgcattgggttcgaatttccttctttagctcagagaagtttgattgtctgaagccttctctcaactcgtcagtcattctccatccagctttgttccattgctggcgaggagctgtgttcctttggagggggagaggtgctctgatttttagaattttcagcttttctgccctattttttccccatctttgtggttttatctacctttggtctttgatgatggtgacatacagatgtggttttggtgtggatgtcctttctgtttgttagttttccttctaacagtcaggaccctcagctgcaggtctgttggagtttgctggaggtccactccagaccctgtttgcctggatatcagcagtggaggctgcagaacggcgaatgttgctgaacagcaaatgttcctgcctgattgttcctctggaagcttcgtctcagaggggtacccagccgtgtgaggtgtcagtctgccctactggggggtgcctcacagttagcctactcggggttcagggacccacctgaggaggcagtctgtccattctcagatctcaaactctgtgctgggagaaccactactctcttcaaagctgtcagacagggacatttaagtctgcagaggtttctgctgccttttgtttggctatgccctgcccccagagttggagtctacagaggcaggcaggcctccttgagctgtggtgggctccacccagttagagcttcccagccactttgtttacctactcaagcctcagcagtggtgggcgcccatcccccagccttgccgccgccttgcagtttgatctcaggctgctgtgctagcaataagcgaggctctgtgggtgtgggaccctccgagctatgcacgggatataatctcctggtgtgccgtttgctaagacagttggaaaagcacagtattagggtggcagtgacccgattttccaggtgccgtctgtcaccccttccctttgctaggaaagggaattccttgaccccttacgcttcctaggtgaggcgatgcctcaccctgcttcggctcacactcgatgggctgcacccgctctccggcacccactgtccgacaagccccagtgagatgaacccggtacctaagttggaaatacagaaatcacctgtcttctgcattgctcatgctgggagctgtagactggagctgttcctattaggccatcttggaaccgcctctcccacattttctttatctgttcatctgttgatggacgtttatgttgcttccatatcttggctattgtgaataatgctgcagggaccatggaagtgctgatgtctttcttgacgtaaaatttcatttccttatacactctgagatgggattcttggatcatgtggtagttgatattttcagttttttggggaattttagtaatggctgtattaatttatattcctaccagcagtatacaagggttctgtttttgtcacatcctcatcaacacttactttgttttgtcattttgataatggccattgtggcctggcacagtggttcacgcctgtaatcctagcactttgagaggttgaagcaagaggattgcttgagcccagaagtttgagaccagcttgggcaacatagtgagaccttgtctctgtaaaaaataaaacaaaaattagccatgtgtgttgatatacagccattgtcccagatacttaagagactgaggtgggagaatcgcttgagcctgggaggtcaaggctagaatgattcatgaatgcaccactacactccagcctgggtgacagcaaaaaagccattcaggtgtgaggtgatatcttattgtggtttttatttgcattttcttgatgattagtgatgttgagcatttttcatacagctgttgtccatttatgtgtcttcttttgaggaatgtctattcaagtcctttgcctatttttttaatcaggttgtgtttttagaactttctttcatttagtttccttacgtattttgggtattaaccccttatccgaggtatggtttgtaaacatttttttcctatctataggctgtctctttatattatgggaatttttaaacatatacacaaaagaataataatcagggactctctaagttcctaattcctagcttcaagagaacattttctttttttttttttttaaagagagtataaattagtatttccttagtattagatatctaggaagttctctctattgtctcatgaactttttttttaatagttggtttgttcaaataagggtccactcattacacacataagcttaataagccttctagtctggaagattccaccttcttttttccttttccttttactgcctatccacattctggatgttactaattgtatcaagtgtcatttagtgtcttctcccggcccctgtgtttgctataaactggatttagttctggtggcctgatcagaaccaggtttgaattcttggcaaggatccttccttctgcatcctgtcggaaggcatgtgatgtccagttgtcccttcataatgcgatcgatcaggtgccagaggtgctggggttttgtttattattattattattattattattattattattattattatttaactgcacaagtaatatatattgttcctttacccccccaaaaaaacaacaataatagactgccaaatttttggaccttttctgcatttagaggtagttgaaatcacaagggaaagtggtggtctctaggtcagggatcccccacccctgtggcttgttaggaaccgggctgcacagaagaaggtgagccgtggggcgagagcgagcattaccacctgagctccccatcctgtcagatcagcagcagcattagagtctcataggagcaggaacccaattgtgaactgcacgtggaagggatctgtgttgtgcactccttatgaaaatctaactaatgcctgatgatctgaggtggaagagtttcatcctgaaaccatcccctctgaccctctctgtggaaaaattatcttccatgaaatcagtccccggtgccaaaaagattaggggcagctgtactagggccaccccctcccctatttcctggtagaaataattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcaatggctgtcaacgtccatgtgtttggaggtaatagtttaagaaaatgattataatatgattgctaaatagtagtggaatacaaaactccatattcaggatgatccagatgtataaagtattacagatgatactgtaaagtctgaattgggcactgagccttgggttaatctgttacttaaacagtataactatacgctgttgcatttcccagatcttttactcacatgtcttaaatgtagatgtttcacatactggctctttcaagaaagcagttgggtcagaagatggagactagaaagaaaacaggtattgccatcagatctggtttcattctatcttagccaggtaaccttaagatcttctactatttttctgtttatgagacatatggataacctgccctcttaatgtttccttggaagttcaaagtctctaacaagtgccttttgtgggatcttgcatgtgttaaccttctcagtaactgagtgccattattgagagtgtgtgcatactggctggagggtccactagttgacactactttacaacaacaggaggaaagaatctgttaaaagaaggatccctggcagggtgcagtggctcacgcctgtaatcccaacattttgggaggctgaggcaggcagatcacctgaggtcaggagttcgagaccagcctggtcaacatggtgaaaccccgtctttactaaaaatacaaaaaaaaagtagccaggtgtggtgagcacctgtaatcccagctactcggaaggctgaggcaggagaattgcttgaacccaggaggcagaggttacagtgaaccgagattgctccattgcactccagcctaggcaacaagagtgaaactccatctcaaaaaaaaagaaggatccctaagagaatataatttagcatgaaatctcaatttttacattgattacttatttggggtgataacgttttgaatatattaggttagacaagattttaaagttaattttacctgtttctcttttactttttcagtgaccactagaaattttaaaactatgtaggtggctaacatcatattgctgttggatgcatcttttaagtgctgctgcctttgattgagctgagtgggttccagttaaccaggcttgagcacatatatcattcattatgtgtttgaacatctcatagcagaagatgccttgcatatatatcattcattatgtgtttgaacatctcatagcagaagatgccttgtggttaatgccctctatgtgttttactgatagcacatttcttagtaaagtgaatcttggtgtattgagacgggcatctcctacctccacttgctgatggcatcagatacaaataggctgtgccatttttagcctggggtttcccagagtcatacccacagccccaacttgtttaacaggattgtaacatcctgtaaagccaccccgtggattatagaattccagggcagctggggcaggagcattgaatcaggaggtttcatcttgactctgtttggccctgtgcaaatcactttacccactacacgttggttctttcttcccaatggagggctgaattgcaccatctctctctctcattcttttgttgtttttttttttgtttgtttgtttttttgagacagtcccactctgttgcccaggctagactgcagtaatgcaatctcggctcactgcaagtgtgagccactgtgcctggccaggctccttttccctacactgcccgtgtattctctccagggacttacctagaaccacacacattggcctattgccgtaagtttgtcagcacgttgtctcagaaaaaaaaaaaaatcctcatcctaaagtgttcttcaaaggctagcgagattgtttaataatacggctattcttattttatagatggccaagctaaagcacatcattttcttttccttcagtgccagcatgagcagggcggggggaccaacctcagatttaagaaagacatgtggctgatttttagggttgtttttagaaacattagatttcttctctaataatgaaatatacttttgaaggactctgacaatgctggaagctcttttaagaaaaatgtcattcttatctgaaaatctttttttttcttctctctctcatgctacattacagctgatgaagttaaaaagcctgggcataagaaaaggggagccctgggtgtgactgccctggaaaaagaggtagagagtgcagtgggttcaagtatgtttgggtatgtgcagtcagtctttgtgtctttctcattcaagtaaattccatagcaattaaagtgaaaataatcatctttcatttgtgagtagagcatccatagaaagcaacatatatcttggtctagaacttaaattccaaaagaatgtgttatatttttcattttcccgtttttgttgcacagggacgagtttcctgatgcttccttgccataggccctgggctctgtgtgtagtgttcttcccaaaccaaaaattaaaaataggaaaatcagaatctataccaagaactttgtctaggaggcttgtctgcagtaggtttcttcagtgcctatgcctcctgctggattgtgtttgattaatccatttcttttaacttgtacaaggtccccattgttagagccacaagtcatttggccactgagggtaaaagatggttaggagtgggatttgttccacttctttgcagcgattaaacagtcagtttgaactggggaaagtatttgacctttagtctgtcctaaaagaatgtcatcaggctgtttatacattaaaaggctctcataagatatgtactcccagattcataattttggaacttctctcctatggtacacacccttgtatgtatgcacacctggctctcactgagtcacttatgggaaactgaagcaagtttttctattaataggggaaaaaagacctcataaaagagtcaaagtaaatgagacttagagaaatgtagaagcatgactatgcatcactgggcctttgcttagtttttattcatcagccatggagaagaaaggcatgactctttcctgcctcccacacccaccggacttgtaaagctcgacttcgatgatgcattataaagtggtgcacaggattggtttttaatgagatatgagatttttgccattggagcaaagcaagactgtttccctgccagctgctttattcaagtcatgaggcattttgttgtctcctcctgtacttgtggtacatgggccctccattttctagcccagttcttgttagatacctttgcacattcatttgtatgtatggcagaactgatgatatggcctttctttcacccccaactactaactgtccatgccattaaagatacatggacaggggattccagcaatttctacagttgctcttctttctctttaccattaatcctgatgattgtaggaaatcagtacaccatatttattatgcaaatctaagaaaaacaactagatctataaactatttgaaaagatgcccacattgtatttttttgttgtttttttagataggatctttctctgttgcccggggtagagtgcagtggcctgatcgcagctcactgtagcctctacctcctgggcttaagcaatcctcagcccgtctagtagctaggattacaggaatctgccactgtgcttggtaatttttttttttaaggagatggggtctcactatgttgcccaggctggtttcaaactcctggcctcaagcagtcttcctgctttggcctccccaaagtgctgggattataggcatgagccactgcacccagctacatattttttagaaaaggatcagatgagtaggacttgctcaactgctatcactgtcagaaatatctcaaggtgaaacttgcaaacatatcagtaaggagaaggatgagatttcttttttaatagtcttctttatcaggaatgttttgcagatattgattttttttttttttacaatgagaaaaatatgaccaaaaactgaatattaaaggaagcagagtgtgattcccggtgctaaacagtttctataaaatgtggctaataacatattggcctgttgtgcctaaggcctgtgtttgggttatgccttctcaaagaatgcagtggaagaatctcagcttagaagtgaggacatccagaattctttcctggctgtgccgtgaaattcctttgtcacttagtgtcctcatctgctaaatgagggtgttgaattgattcctaaaagttctggtatcctcccctcttcagattatttcttcaacttattttcttggtagaactgggagaggttcgactttgcttttgtcacgcattcttactcatcaggaaagtcccgctataaacacagtgctgagggatcagttatgtcagtctgtttccttctcccagagaccagccctgccttgggcttcccctagaactttatgtcatagcataaaggcccgtgtctgggccctgaggttgggagtatgctctgatgtcaagtatttgatcattctctttctgcctcttgatgactagaaagcgttttatggtaaagagttacgcaagaagcctttgtttagctctttctctcattgctaaaaatagtaagctgtttttaacccttactgttcttacttcttcttactcatttccctcactctttagctgagaatgtcacctccacctttatagagaagacagaaacttaagcataaactcttcaccttccttcaccttccctttccccagttacttgcgtccctgttctttgtcatcctcttgtctgtagctgtccttgaagtggtgtccactattcccctggatgaggttcattcttacgttctgttccataacctagttgtgttattaacttcccatcatacatccttttattaaaaatcctacactaccagtttttgagttcctattaggtgtcacaatcagttaatcccacttacggcatacagcagtcattattccagtttatacttgaagaaacttaggcccttactatgtttctggcactgcttattatcacagctctagaagacatcttctatctaccttatccttcccttttacaaaaggtgagaaaactgaggcccaaagaggttgttgtcaccacctatgtagagtgaggatttttatttttgtgctattgtttagcatgatctcatgaaatataatagaaaataaggggaaactatggtacctgcttattgagcagccttccttgactgggatataaacatccattggttttcctcctttttcatgccaccacaagcactcaggggcactcttgataccagaacagtgggaggatcttagtgatattggtccaaattcataagttttcacttctcttttttttgagacaagatctcactctcgcccaagctggagtacagtggcgccacagctcactgcagcctttacctcccaggctcaggtgatcttgccacctcagccccccaagtagctgggactacaagggtgtgacaccacacccagctaattttttgtatgtttttgtagagacagggtttcactatgttgcctgggctgatcttgaacatctaaactcaagggttccacccaccttggcctcctaaagtgctgggattacatgtgtgagcctcacttccttctggttatagagacagaattgttccacttcttagtctgatgtttctgtcagaattttttctcatgactgcctattcacgctgctgtttgattcttgggatatattttaaatgatgggtagattcacttcccctaaaccgtcctccttatgagcagccgttattctgctctgccagtaaattaattgactcacgattctgcatgttggggcttgttgtggatacagaccgtattctgaaatgtcctcagaggtcgatgattgtgtttgcttctgccaggggatgggtgtttgccctcagcttgtttgcaacaccacatttcctcaaaggaaacgtattaactaacagctatcttcaagccaatgtaagagtcttgattcaagaaacaacctaccagtcagtctatttctaggcttttctccctctctttgaaagtgccagtgttcttcctttcactctcttgaactcatttttcctgccagcacacatcattttgtctcctttacttttccataggctgtttttttttatttgtctactagcttttcttatcacatatccctgcttgacaaccttaagcaatttgttggatacccttgatttgaggcccatcaatatgtcatactttgggattggcagaagaaatgtttagaagcatattttccataaatgatagtgacaagtgccaagcacttgcttcatgttgtctcattcagttttcacggggactttataaggtaagtgggattactcccgtttaaggaaactgatataactgaggtgcagagagacgagagtgactttcccagaggcacacagctagtgagtggtaaagccagtagataagccagtccctgaaatccgtgttttccagtaggatcccaagctatggggagataaaaattagtccccttgcctagctagagggctttaaaggttaaagcaagaggaagaagcagaccttatcttttagttctgtaagtttggagtgtatcgtgggtctcactgaaactagaaaaattgtcagcacggctgcattcctttctggaggcttagggtagaatccctttccctgcctttgccactcaccttggcatatggccctcatccatcttcagagccagcaatggcaatggagtcctcacctctcatcatgctgacattgactcttctgcctccgtcttccacatgtgaggactcatgtgaagacatgccgcacacctagttaatccagaataacctttctattttaaagtcagcttgttagcaaccttaattccatttgctctcttagttcccctttgccatctaaagtaatatattcataggttctaagggttagcatgtggacatcttcggaggggccattatttgaaatctaaaatggagatgttattgcatcgcagtctattgggaggtagccactggaggtttttgcagccttgtttttatatttaagcaagggtgtatatgtgtgtcttagtctgttcaggttgatacaacggaataccatagactgggtagcttctaagcaacagaaatttctcacagtcctggaggctgggaagtccaaaaaaagttgccagcagatttggtgtctggtgagaacctactttctcacagatagcaccttcttattgtgtccttacatggtggtagaagggcgacctagctctctgggatctcttttataaggggtctgatcccaatcatgagagatctgcctaatcacctccaaaaggctccatctcctaataccatcacatcttgtgagtttggatttcagcataggaattttgggaggacacaaaacttcagaccatagcagtagggatgttgctaatacctcacgaagaaagaacttaaagaagctgagtaatttgcccaagaccacacaaaaattcattcgaatccagggacaaaactatatttcctgtgttttctccatgtcactcagaaaattcagcatgagggagaaatatgattcttaatatagaatcatatttctatattgaaatatgatttcaatatagctgttttggctagaacttggaagtgaacaggcaggcttaattgggcaacagtccccactttgtggggtgtgatcggcaggcttattccaggcttcttgctgagttataaaacttctgatttatctgatagagaccttcagaaggaggactggtgctattaaaattatacacatttcattctggaatttcttttgagggcatcatccactcccctcagctgtgattgtaaacctcattgctcttggtcagaatttcattcagcattaacaatgacacatcctgttatgctgtgcaggtgtattgctgtttataggaatttaagtttagatcattaaatgtttcaatactgaatgtattgacagttaagttgatgacgcagaaaaactacaaatagctgggcaaactataagaggtgtttctcgtctgcaccttcccttctggtatcttgatagtatagcccaaaaatggttttaagcccttgcttctcccccagggctaccctctttgcttgcaccttacaaggttgagtgttgtgaggccccatctggtgccgactccaattctgtctctagcccagacccacacttgtgagctgctatgagttatctgggcatcttggttgacttaatcttcctaacatccttgtaaataggtggatgaatactatgttttatgattggaaaatgaagaatcaaaaagatatggcaatttggtttaagtccacatagctagtagttagggagctttgttgagaaagaaaaatgcatgagaggaaattaagactgtagttaataattatcaggtgcatattaacgttgcatgaagcttaacttaaatacatgttattcttaaggttaaaaagttcaaaacaaaggcgggggttccaaggcaaatgggtggggatagacaggagatgggcagaggtagatgaaatgcgggtgttatggtgtggaagtcagttggagtatagccactggaggcttttgtggccctgttcatatcatagttataagtgggatgttgctaatgcttgactcatcaaaggctgaaacaaagccagagctgaagttgagtacgtgtcaccgttttattggttaatctttcaaaaagagaaaagcctctgtttatacaggctgaaacagtcatttgacctgttcttcaactccatctggaattgctttggggttaacttagcatttcccctaaagcgcatatgacagtgggttgggaggagctcggatggggtttttgttcctccagagcgctgaggccttatttctgagtgaggtggccttggtgccagctaatgccactgtttagtgtgtgatgaactagaagtaacaggttaattttggccagtagacttgccagctgtgtaaacggaaccagtgaaactatttctcagtgctgcctcccacccctggaagaggacatcatgttatctacctgcccctgttggcttcccttgacccatctctcccatgctgtcccctcctccctgtgttactcatcagttcaaatttagaataattgaatgcacagagaaagtggcttgttctgaaaacttctgacaagaaatttccaggtgacttggtgctagattaattttagcctctcttatggattcaaaactgttttgtcagaagacttgaactaagacactttagaattaattacggctgggaaaaagaacaatctaaatgaggcagcgaacaaagattcctaaatatggagcaagacaagtggctctttatttcagtgggtcactggcatgaaaaaatatagttggggttacaggcaggaattactcttagagacatgggaattaaatgcaaggtaagtaccttgtttggaccctgaaactaacaaagcaactgtttaaaaacaaatttttttaagacattggggaaatttgcatctgctctgagtcaaagcctgggatttgtgtttgtgaaaaagctaatagaggaagcaagttggacacaatttaagaaattgttgaatctgggtgatgtgtatatggtgttaagtatatgattttccacgtctgtgatgatgaaacatttttgtattgacttcttaagtgtcttacctggcctttctgagcccacagttgagttgcacctgcaatccaaagtggttaccccgtcacggctgccagaccacagacactttaattcttgttgtgcggtgtgttgctgccagcccagagccaaaaaagcggaataccaccctgaagcttttgtaaacaattgtctttagcttatccagaggaattgagtctggagtaaagacccaaatattgacctagataaagttgactcaccagccctcggaggatggaaagatggccttaaaataaaacaaacaaaaaccttttttgctttattttgtaggaccactatgagacctcagtccttctatgatggaagtcattcttgtgccagaggagtgtgccatattccaatggctgagccgttttgccccaaaacgagagaggtgtgtagtctttctggaaggtgtaccagaataaatcatgtgggcttggggtggcatctggcatttggttaattggcagagcgagtggccccataccctcactcaagtttgctttgtattatgcaaagttttatggagagttatttcctgttgctaataatttcctgttcctctgttactctcagtcattttaagctgaaccactcaaagttgcaacctacctttttaataagttttgattttgctatctagataaaatgatttaacatagaatatcacattactcaagagtatgcagtctggagccagattacttaggatcaaatctctgctcttcaacaaagtagctgtgtccaagaggacaaattatttgacatatgtgggtttcagttatcttacttctaaaatgaagataattatagcatgtaccttataagactgtgtgagggatgagagagttaatacttaatgaagtctctgaaccatgcctgtcagttatggaacatccaatggctggtaactgcttttgtgaattaaattactattattgatcttctaaaaatggtcagattggcagctgttgcctttgacctgagtttggccattactgcccagccttctgtctaccattatagccaaatcacagaactatggggacagccccacaagggccagtggtggtataaggggtggaatcacagttttagttcccaagcaacaaaaatggctaccatgactaagaagcctatggcttggtccacatgtgctacttctcttataatcccaggtttgaaagtcaggtgcaactcaaaagatcagaagtatcgttagagattaactgcttcataaaatctcccttatgagttaacttagagaatataaatacctaaacacgttagttattcagataatgttaacacctgcatatagagagtagatgatttcttttagcatttatgttttatcctacataatcacagaaaacccatttccttatagttaacagcaagggcacctaaactgaggacacagggttgggagaaatatttctagtctcaaacaagaatttggaatctaaaaccgagtactgagggaagccatttcggagataccactgcgcattgattttctctgacttctaggaaagtacgtcttttacttggttttttttttttttttaaaaagtggcaggcgaagtttgtatatgtatgtatagcatgtttctggatagttatccacagaatgtatcagaatgctgctagtcttcctctgaagcacagatctgtccacataatagatttgctatcctgggggaaatgaagtatggataaaattcttgtccacttcaaaatgggggcagcttgggaagaaatagtctaaggagagaatatgcatgctcgtatgaatctgaggtcagttctcaggcaaaatacagtgacttggggaactaggagtagaggtagatggggaaagcacaatggagctgtatagagcacatgtaaatgtgggtctgtggtgataatttccagtaatccaagttagcctcccttgaagccaaattaattcagcttcataaagactgagagaatactgggaaaggcaatttaagaaaatggcaaaataagcattcagaaagaaatttttaaatattatccaaaaacatgaagagtaaatagtgctgccacttggtaattttcacttttaacatccacatgatctttcatgtactgatggaataggactgtcatgatgaattgtcaagtggcaagcaagatactcagtggttgtaccatattctaccatttatgttaaagtatgtatatatacaaagaagtaagtatgtaaatatttatatacaaataaaatatttttggaaagttaacaaaaaaagctggtaacaggaaacagggaagatggcagataagagacagggctggccaccacggtggctcacgcctgtaatcccagcactttggaaggccaaggcaggcggatcatgaggtcaggagatcaagaacattctggctaacatggtgaaaccctgtctctactaaaaatacgaaaagttagccaggcatggtggcaggcacctatagtcccagctacttgggaggctgaggcaggagaatcgcttgaacctgggaggcagagcttgcagtgagccaagattgtgccactgcactccagcctgggtgacagagactccatgtcaaaaaaaaaaaaaagtaaagaaaagacagggctaacgtgcagcttccacaaggacggacagaatagcatatggagacgctatgatcttttgttccaagaaccactgtaggaacttaccgggaaaaccaaaagaattcaaagatcctttgaaagaagtggcacaccactgcaaattctgcaaaacaggcaagaaactgagttcccaaagtgtgagtcggggagaacctacctctgaatacacatccccactggggaaatctaaaaatccagatcatggaggaagaatttaaccttacctagaggtgaaacggatttagggggttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggcagggcgaaggaagctcccaaatgaaatcagtagtggtttcagctggtcacaaattttctcaggcagagtccaagggactaatgggagccgcagcagatacaagtgagtacaggagctgctgctgatggagtgggcaggtgggaaggggtgaggtccaaaggccatgcttgctttcccagtggggtagctcacagcctggggcaaggtctgagcagggcactgcaggagtgagactagcctcaccaactgcatagtagctggatgaggcctcttgctgctggctctcccccactaccctggtaaagtttatgatacagcagaggcagtcaagatctcctctggaacataaacccagtggcctgacaaaccacccccatcccccaatttcccacagtgtctgcagcaagccctgcccaagaagagtctgagcccagaaccacctaaccctgccccaacctgatggtatttccctacccaccctggtagccaaacacaaaatatttattgccctgcctattgcctgggaaaccaaaatagttaccttgggcatcttagggcaagcttagagccccctactccttctgcagctggtgctctcttgaaagtgccacctcctggctggaggccagtcaactgaggccattacagcaactcataaaacaataaccctgatcccaggacggaaaagacaacacctaatttcactgcctgcaacatcctggctaaccagagatcctgaatatgtccacatgacaacttcactgctagcataagcagcattcaagagagccagcacattaaacatatctacaaccaatgactcttgcagagtttacttcacttccctgccacatctaccagagcaggtgctagtagccacagcttggagacctgaagatggatcacatcgcagtactcattgcagacatcccccagcaacagcccagagcctggtggcctcaatgggtggctagacccagaagagcaataacagtcactgcagtccagctctcaggaagccccatccctaggggaaaggggagagcaccacatcaagggatcaccccatgagacaagaaaatctgaacagcaggccttgagtttcaacctctccactaaaatagtctaccaaaatgacaaggaaccagaaaagcaattctggtaatatgacaaaatggggttctgtaacacccccaaaagatcacaccagctccctagcaatggatccaaaccaagaggaaatctctgaattgccagataaggaattcagaagattggttattaagctactcaaggaaatagcagagaaaggtaaaaaccagcataaagaaattttaaaaaacaatacaggatatggatgaaaacttctgcagagaaatatcataaagaaaaaataaatcacagcttcaggaaatgaaagacacacttagagaaatacaaaatgtagtggaaagcttcaacaataggctagaacaagtagaagaaagaacttcagagcttgaagacaaggctcttgaattaactgaatcaagacaaagaaaaagaattttaaaatgaaattttaaaagaaatttgggtttatgttaaatggccaaacctaagaataattggtgttcctgcagaagaagagaaatctgaaagtttggaaaacttatttgaggaaaactttgctggccttgctacagatctagacatccaaatacaagaagctcaaagaacacctgggaaatttattgcaaaaagatgatcagctaggcacatatttatcaggctatctaaagtcaagatgaaagaatcttaagaactgtgagacaaaaacatcagataacctataaaggaaaacctatcagattaatagcagacttctcagcagaaatcttacaagccagaagccagaagggattggagtcccatttttaacctcttgaaacaaaattattctcagccaagaattttgtatccagtaaaactaagcttcataattgaaggagagatagtctttttcagacaaacaaatgctgagagaatttgccactattgagccagcactacaagaaatgcttaaaggagttctaaatcttgaaacaaaacctcaaaatacaccaaaatagaacctcattaaagcgtaaatctcacaagacctataaaacaataatacaatggtgaaagaacaacgtctttaggcaaaagctagcatgatgaatagaacagtacctcacatcccaatactgatgtcgaatgtaaatgacctaaatgccccacttaagaaaagatacgcaatggcagaatggataaaaatctaccaactaagtatctgcagtcttcaggagaatcacctagcacacatgaactcacaaaaacttaaggtaaaagggtggaaaaagatattccatgcaaatggaaaccaaaagcaattaggaggagctagttttatatcagaaaagaacagactttaaaacaacaacagttaaagcaaagagggacattatataatgataaaaggagtagtccaacaggaaagtatcacatttctaaatatatatgcacttaacacttgagctcccaaatatatcaaacaattactaataggcctaagaaatgacatagatggtaacacaataatagtggggcacttaagtactccactgacggcactagacaggtcctcaagacagaaagtcaacaaggaaacaatggacttaaactataacctagaacaaatggacttaacaaatatatatacccaacaactgcagaatatacattcttttcatcagcacatggaacattctccaaaatagaacatatgccacaaaacaagtctcaacaaatttgaaaatcaaaattatatcaagtactctctcagatcaaagtggaataaaattggaaattaactccaagaagaatcctcaaaactatacaaatacttggaaatgaaataatctgctcctgaatgatctttaggtcaacagtaaagtcaagatggaaattaaaatattctttgagctgaatgattatagtgacacaacttatcaaaacctctgggatacagaaaaagtggtgctaatgggaaagttcatagcattaaattcctacatcaaaaagtctgaaggaggacaaatcaacaatctaaggtcacacttcaaggaactagaaaaacaagaacaaagcaaacccaaacctagcagaagaaaagaaacagcagagatcagagcagaactaaatgaaattgaaacaaaaaaatacaaaagataaatgaaacaaaaatatttgaaaatttaaaattgatagaccattagtgaaattaaccaagaagagaaaagatccaaataagctcaatgagaaatgaaacaggagatattacaaccaataccacagaatacaaaagactattcaaggctactatgaacacctttatgcacacaaactagaaaatctagaggagatgagtaaattcttggaaatataccaccctccccaattaaatcaggaagaaatggaaaccctaaacagaccaataacaagtaggaagattgaaacagtaattttaaaaaattgccaacaaagaaaacatccaagaccagagggattcacagctgaattctatcagacattcaaagaactggtaccaatcttactgaaactattccaaaagacagagaaagcaggaatccttcctaattcattctgtgaagccagtatccccctaattacaaaatcagaaaagaacataataaaaaaagacaactacagaccaatatccctgatgtacgtagatgcaaaaatcctcaacaaattactagctaaccaaatccaacagcatatgaaaaagataatacaccatggtcaagtgggtttcataccagtgatgaagggatggtttaacataggcaagtcaataaatgtgatacatcacataaacataatttaaaacaaaaatcacatggtcatctcaatagatgcagaaaaagcatttgacacaatcctccatctagttataattaaaaccctcagcaaaattggcatagaagggacgtacctcaaggtaataaaagccatctatgggctgggcacggtggctcacacctgtaatcccagcactttgggaggccaaggcgggcggatcacaaggtcagatcgagaccatcctggctaacacggtgaaaccccatctctactaaaaatacaaaaaaattagccgggcatggtagcgggcgcctgtagtcccagctactcgggaggccgaggcagtgaatggcgtgaacccgggaggtggagcttgcagtgagctgagatcacgccactgcactccagcctgggcaacagagcgagactccgtctcaaaaaaaaaaaaaaaagccatctatgacaaacccacagccagtgttatattgaacagggaaaagttgaaagcattccctctgagaactgaaacaagacaagattcccactttcaccacttctgttcaacataatacaggatgtcctagccagagcaatcagacaagagaaagaaataaagggtaaaaaatcagtaaagaggaagtcaaactgttgctgttcaccaatgatatgatcgtatacctagaaaaccctaaagactcatccaaaaagctcctagataaatgaattcagcaaagtttcaagatgcaaaatcaatatactcaaatcaatagcacttttatagaccaacagcaaccaagctgagaatcaaatcaagaactcaacctgctttacaacagttgcaggaaaaaaaaagtaaaatgcctaaccaaggacatgaaagatctctacaaggagaactacagaacactgctgaaagaaattatagataatacaaaaaaatggaaacataccatgctcagggatgggcagaattaatattgttaagaattcttacaaaagcaatctgccaaaaagcaatccacaaattcaatgcagtttccttcagagtaccaccatcattcttcacagaaatataaaagtatcatatttctgccaaaagcaatccacaaattcaatgcagtttccttcagaataccaccatcattgttcacagaaatataaaaaaaaaaatcctaaaatttatgtgagaccaaaaaaagagcccatatagccaaagcaagactaagcaaaaagaacaatctggaggtatcacattacctgacatcaaactatactacaaggctatagttatcaaaacagcatggtactggtataaaagtaggcatgcagaccagtggaacagaatagagtatccagaaataaagccaaatatttacagccaactgatctttgaaaaagcaaaacaaaaacatacactgaggaaaggacaccctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccctctaggattttggagcaaggtcctgccatcttctgcagataactattctcctttcgagagactgtccttggcctgttactggactttggtggaaagtgaacttttgactatgggtcatcaagtcaccatgcgacctgaactgcctatcatgaactgggggctttctgactcatctagccataaagtgggttgtgcacagcagcattcagttatcaaatggaaatggtatatatatgactgggctcaagcaggtcctgaaggcactttgctgtgcccgtgcatggcctccatccttgccacctggacactttgggctcctcctgcctttaagtcaacaggctaagaagggagttacagtgctggctggggtgattgacccagactatcaagatgaaatcagtctactactccacaatggaagtaaagaagagtacacatggaatacaggagatccattagggtgtctcttagtattaccatgccctgtaattaaggtcattgggaaactacaacagcccaatccaggcaggactacaaatgacccagactcttcaggaatgaagatttcagtcactccacaaggaaaaaaccacaacctactgaggtccttgataaaggcaaagggaatacagaatgggtagtagaagaaggtagtcatcgataccagctacaaccatgtgaccagctacagaaatgaggactgtaattgtcatgagtatttcctcctccttttgttaaaaacatgtttgtgcatatatacagttgtactaagaaaatatcttcattgtattttctttctcctttatcatatgacatgagatttattgacttcacatcaacatttaagtattgctaactttatgtagtagtatttgggttggtgtttggtgcatttccagttgcacaaaggatagctgtattatgttacgtgtaattatgaccttattattgtctttatttgaagattatgtatgatctcaggagatgtgtatggattcatgtggacttgtgatggttaacactgagtgttaacttgattggattgaaggatacaaagtattgatcctgggtgtgtctgtgagggtgttgccaaaggagattgacatttgagtcagtgggctgggaaaggctgacctagccttaatctgggtgggtacaatctaatcagctgccagcatggctaggatataagcaggcagaaaattgttaaaagagagactagcctagtaccccagtctacatctttctcccatgctggatgcttcctgccctccaacatcaaactccaagttcttcagttttggaacttggactgtctctccttgctcctcagcctgcagatggcccattgtgggaccttgtgatcatgtgagttaatacttaataaactcccctttattagttatgtccctctagagaactctgactaatacaatggaatactacttagccataaaaaagaacaaaatgatggcatttgcagcaacctggatggagttggagaccattattctcagtgaagtaactcgggaatggaaaactaaatatcgttatgtcctcatttgtaagtgtgagctaagccatggggatgcaaaggcataagaatgatataatagggccgggcgcagtggctcatgcctataatcccagcactttgggaggccgaggtgggtggatcacaaggtcaggagttcaagaccagcctggccaagatggtgaaaggggtctctactaaaatacaaagaaaagaattagctggccgtggtggcgggtgcctgtaatcccagctaatcaggaggctgagccagagaactgcttgaacccgtgaggcagaggttgcagtgagccaagatcgcactaatgcattccagcgtgggcgacagagtgagactccatctcaaaaaaaaaaaaaaaaaatgatgtaatggactttggggcctctgggggaagtgggagaggagaatcagggataaaagactacacattgggtatagtgtacatttcttgggtgacaggtgcatcagaatcccagaaatcactactaaagaacttatatacatcacaataaaccacttgctccccaaaaactattgaaatgaaaaaaaaaaaaaagcctggtaataatggtttcccttgggaagggacagtggttttccttgtactatttaagttttgtaccatgtacaaatacgtgttccaaaagcagtgttacttctattcattttaggagttaatatgaaagtcctgacattaaatctgtttaggctggtgatctaatattgctagttccttggtgagggttgtggtactttcactaccacatccgtctgtttagtagttcagtgattacacgaggtaagaaaatgaaatcatcttaaactcagacctggaccttgaccctgtatttgatattttttgctgccttaagatagtgttagctgttcttgaaggaatgcaaaatgctggttcaggtggctgacatatattcatagcctccatttcttcctcctcctcataagcatggtacctatctcccaaagtgccagagtgacagtgaggacttgtcaagagccattcatctctagaagcactgtgaactttagccaagcatatggttcagttattcaggatctttaaagacattattgaaccagcgggagtgggcttgttatgtcttaactttaggggggaaaagggggtggggtagagatttaggcttttgcatttataacatatactttttagggaaaagtgttaattaagcataattttattttcagcatttataagataaacatgatgtagcatcaactgttcattgtccatagcttgctaaattttgagttgccaagactcttgtgaaaattctgtttcccattgcagtggcatagtgtaagttattttttaaggaaataggttaatttgtttatgtgatgaacacatgtgcaggtgagactttgcccagattggagactttgactttgagtcactccactttatttatatagtatcccaggaaggttagccaaatatgtgtagaagctgccagtattaatgattgttagaagaccagcttagtgcatacagtgtttacagcgcacctggcatgcttctatgcttgtatataccttagttcatttaatcttcctcatacaattgaattatgcgatatcattattctcaatttacacttgagaaaactaaggcatacagagatgatttttcaacagtgcttcagtaagttaacagttaagttgaaaagacttttttttaattaaaagggaatattgaataagctaagaaaaaatgaaggtaattaataacttgaagattagatgtgcagtattaaataaaacactggagaaaaggatcgaacttttcaatgatgtttctaaaaatccatgcctagccttgccactaaaggaattccaagatgtttatccctgtgaacagaaaaacaatcagcacaactctgtggaaaggcaataggcaaaagagaaatcactttctaaccagcaaaagcttttacagaagtcttcagattctgtatttttaaaagtaatgagaattaacttttcagaagcctggaaatagaactcaacacacctgtttgagaagataagcgacgagaggcaccttagcttagcctgcgaggttaaaagttaagactccagtctgtattctcaaaccagcttagtctcttaaagttgttaagaagcaaatgagattaaagcatataaacaaatgcctggcgagtagaaagagctcagtgcttgcttgtgtagctattagtttctacatgcaaagggctggggaaacaggattatgtgaatgagaaagggtccaggaaacacccttctgtggtcctctaggttttttctgagagcctggcagatagtaggcatttattatagtgacaaatcatctttaagaaatcaacttggtaaacattggggggaagtgcagccttaagttgtgcatgtgctagtatgttttgaagtttctggtttttcttttctaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtaggtggaattcttttctaagcacatatagcatgggtttctgggtgccaatagggtgtcttaactgtttgtttctattacgttagtttcagaaagtgcctttctacaaggttttgaagttgttaatattttctgtagttccattggaaggtaagaacaaagatcaaaggaaagaaagagacacttttacccaaggatcagtagtgaaaatagtacattgtaggcaggtagatgtgttgagaatcatactaagacttgggccttattttcaggataaaggtgtattttgattgccaatttctgctgctatgctactgttttttgttttcaagaaggaaaaaaatctattaaccctttcctcatgagagggctgtatgttcacatccatctatttaacgtaccgtggctggatactctgttcagcatagaaatgtgacaacaaacagagaagtccttaaggagccgacattctgtcggatggagatagaagttaagcaaaccaatataagaaagctaacggttataaagaaatagaatggtgaggtacaagggtacactaggtcaactgaatagagttgaccagaccaaatatttgaagtatgagaagccttcctgttttaagtgtgatgggcaagaagggcatgattgagtagagtggaaaggagggagactggggagaagggagagagaggagggatgcaatacagtagggccaggccatacagaccatggtaagggtttcagatggaaggacagtgaggggttcaggcagggaaggcagcaggatccagctggaatttgaggacactggaacaatgaggtcagcttccaaaacaaaacaaaacaaaactttaaacatctgtgtaagtacagggtggaatataatgaattccaggtacccatcacttaggttccacaattagccatggccaatcttgtgtgataggtatgtccctacctatttctcccctgccctcattgtgaagtaaatattttcctaaaaggtctttttaaaattaagttataaccatgccatcattgtacaaaaataatgatattaatttcttaatataatcaaatattcagactattcctttttccttcagtctcataatttttaacaatttgatcaaatcagaatcccttacaatccatatgttgtattttaatgattacctcttgtctcttttaatctaattttcacctctttctctttttattccttgtgttacttgaataaactagatcgttcgtcctgtcatttatctcattttaagataaagggacgacaaaactgcagtcacttttgaagtaaggaaaacatttaggggtgactttctgagcacatttagggtaagtgacatctccaaagaggcctaatattgtaccaccgttttagagagtttgttttactatctaatgtgtacagtgttttgggtcatagatgaacacaggttctttgtttttcatgaattccttatgatgactcttcagtgtaataaactgtttgcttagtactaggatgccttttatgtaagagattcgcaaattattacattaagtcacaacataatatcttatttggcagctttggtaacctaaggaacaactcagcctcgtaatgtcaagaagctgcttccaattaataggaaactccagcccctgccacaccctgagagcggtttgcttcctgcctgtggctttctgctcagtctaataacatatgtctcctcctttgtagaaccagcagtgatttcctttagtagccaaatgaggttggggaaatagtcagctggagctactttattgaaaagcagagaaattaagctctgtaagtggaaaggcttgaagacagtgttaaatgctacaaggaaggcccacagaaagatggcattatttcagccaatcgtgtgttgcagcctggcatggcaaaaaggatttggagttctctaaacccatcttcagatttgagttgctccatttgcttgtcacattgggcgagttatttcacttgtttactcttctgtagaatgaagccagggctctgggtgaggagtggaggttgtttagtcattgtttagtcagttagaccttgaaagattactggaagaattaaaccaaatgagatatgtaaaaaagctagtataatgctggcttgtaagagggtggtcatcagatggtggctctgatggagtggggggcctgagaggtgggtagtatcagggaaaagcatttaaactgcacctgaagagagggtttattttgggaaggtcagtaggaagtacattttgggtgaagcccaacagctggaacaaagataagggaggtcagtgtctatacagaaataaccagtcacaggaaaaatatataaggaaatgagtaaatacaaggcaaatttcttggatgcttcatgtctgcattcaaagactcagcttaaaacatatcatttacatgtgcctggcagatacccagcctgtcactgctttgtgttcccatagtagtgcaaactcccctctgctacagtgttcatcattttttcctatacacatcttggtgtttgtgggtgggatctggactatgcttaaggaaatagaaagatgtaatccttgtgtccctgaatgctggatttcttcgaagcataggaaggcatgtcaagtactctatctctgatggtaattttgtgttcactttcttcaactttttcttatgaagctattttagtcatatacagaagtagctaatagcacgagcttccatgaattcagcatctagcttcaaccattatattaacttacaaccaatatgattattactcccatcaataattttatccataaacacttcaggaggtatctaacatgagcacattatcattttcattctccaataataattctttaatatacccagccagaatttaaatttctggttaaatgccttaaattattcttttggttgcaagctttttatgaaggaaccagatcatttgtcctgttgagtttcccacagtctgaattgctgaaatcatctccttggagtagtttaataggcttctctgtcctctgtattgtctataaattggtagctagatttagaaatttaatcagattcaggtgtcttaaggtagcattttattttttcatcaggaagcacataatgagtggtttatttgggattttgtttggttcggtttgtgatgttagcagccaatccattaattcactgggagccataaaaatggtggtattttaattccataatatttttctttagtagctggaataattttctaaggagaaacgtacctgtttggttttccagtgtagcaacagttttaacattgtaatcccttcggctgtggacatgaagagaacagccacatctttctagaccatattaacccattatacatctgagatattttctccgataccatattgaaatctgtattagtctgttatcacattgctatggagaaatacctaaaactgggtaatttataaagaaaagaggtttaattggcttatggttctacaggctgtacgggacgtgatgctggcatctgctcagcttctggggaggcctcaggaaacttccaatcatgttggaaggcaaaaggagcgaggcatctcacatggtgggagcaggagcaagagagagtgagaggagaggtgctgtacacttttaaacaatcagatctcacaagaactcactatcagtaaaacagcacctgaggatgctgctaaaccattcgtgagaaatccaaccccatgatccaaccgcctcccaccaggccccacctcccacaattcgacatgagatttggtgaggacacaaatccaaaccataccagaattcatcagtgcttttcagagatgtcactgagtttctctaggacctccgtgctaggactaagaccatcttgataaatgccgagcttgaactcaggggtttaaacgtagaataaacagacttcacaagtcaggtttttcttagtctgtctggactgttgtaacaaaataccatagcatgggtggcttctgaataacaagtttatttttcacatttctgtaagttgagaagtccaagatcaagggactggcacatttggtgtctagtgagagcccactttctggtagacagccatcttctcactggaacctcacacggtggaaggggccctcgaagaatagcactggggcctcttttgtaagatcactaatcctatccacgaggactctgccttcatgacctaattgcctcccaaatgcccaacctccaaataccctacattgaggattcggtttcagcagataaatttgaggggacacaaacatttaggctgtagcaaggctggagctcagaaaaatgttttatgacaagcagtggaattttaagttctagtaacctccagtgctattgtttctctaggtttcggtggaccgggtcttaaagaccctgaaagaaaacgctaataaagccaaaagcttactgctcactaccatacctcagatagggtccacagaatggtcagaaaccctccataacctgaaggtaagtgtcagccatggacaatcaggcatgtctgtagactctctattgtcttcttttcttacttgcatttcacctttggtcctcatgtattttatgccagcctagatgttttcaacaagtttttgtgacatctactactaccataccaaccacttgtgaaactgagtagtcttattttctggctggtagtgcaagaccactgaaggctagggttgagagagttttattatctcgtgtaccagattcttcacattgccctgctctgtagtatccctaagtcttacttcagaagattgatagtgctttctctgcatatcgcttacattgttgacaaagctattttctctttggcagatccattcaaatttgtggcaatcctttaaagccaaaactctgacaatagtaccaaaatggtgccagaaaatatctgcttaaggttaatcatgcatcaaactaaacagtaattaatgataaaccaactgctagtattctcagaatataatttaaactaactgataaactcggagttgcatgatttttctttgggcactttgtgactcttcttaaccacatagggaaagacttgtctcaaactgatcagatattgcattctcctactatccaaagaggaccataccccaaagtctcctagaatacacctgtacttttgggtcttctggtggtggtggagagaggatttgaaaggttgatctaagccctccttacctgaattaccacctaggagctctgtaatgagagagccacagttttagtataatgaggacattgtatggtggtaagtgactgccaatcactgggcatggcagagccttgatttgtaatgtttgctaatttacgtggtacaagtgctccagtacggccagtttcacactactaatgtgaagccactgatgagttgagaagtgatacacacagctcttgcaagctggtacgaacagaatccagcacaccactgtaactaaggtgtctctcagcagttaggactgacggtcaagaatgttggaatttgtagcttatcttccctactaagaaacaaatctattggtttcaacactgtatacctaggacctaaatgttatttaatgaataaatgatactcctttcccccatgaagtgttttatcataatatatagagatgcaggaaacccttattattagaattaaaagggaaaaaatacatttgagtgcagtcaaatggcacaactggagcttgcataaaaaaacgcatgttggtttgccagaaatgtgactcctacttgtactattgttagcaaaatgtcatagaagtttgtttgtttatttgtttgtttgtttgagacggagtctcattctgtcacccaggctggagtgcagtggcacgatctcagctcactgcaacctctgcctccctggttcaagcgattctcctgcctcagtctcctgagtagctgggattacaggcatggaccaccatgcccagctagtttttatatttttagtagagactaaacctagtagatgaccaacatggtttcatcatgtcggtcaggctggtcttgaactcctgacctcgtgatccacccgctttggcctcccaaagtgctgggattacaggcatgagccactgcgcccagccaagtttattttttttaagtctcccaactaaccccactttgaccatagtctttcaaaagcttgaagttaatttctcaaataatatatttactgttttagctttatttttaagtaaaaatgcttgaagagtagaaatcagtgttctcctttcctggagcttctgaaattgtaaaattgtgtgattttatttgtatgcatttttaaagaggcttagtttacgtagctttcatcggattttcaaaggaggattttatatatatgtgtatatatatacacacatacatacatatacacacacacacatataaaacctaaagagagaaaatgaggaattcctgctctagacaaaactgagaatcttggtcttcatgctacagcattaaggaacaccatactaataatccctttttctggggtagtattgttagcactgaaatgtgtatcattcattccctcactaagtcatttcagaaacacttagcacctgctatacgtcaaggtctggtttgcaaagataaagagttgtgatgatgatcctatggtgtttggagatatagacacataaaaatttcaatgatttcttacagtggggtaaggataagggatagaggttgcataaacaataatccaggctgggggctggtatggcaataagtgattatcagaacaatgctctgagataagcattattaacctcactttacaggaaagggaggtgaggaaccaagagtttagagtacccgaagttccacatctggttagtgaacttgaaaattttctgtagaatttatttaaagtgtatgtttcctgcgtcctcactttgatctagaaaatcaaaatctgtttttttttttaacaaacatctcagtaattacgccaacatgtgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatc

SEQ ID NO: 12099 - DNA, 10585 bp, Human
acacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagagtgagtgcaaggttttatgagtggaattagccctcagcagatgggggagccagaaggcagttggagtgggaaggtgattttcccctggagtcgggctgctgagcagcctgggctctcctctgaccgcccctgccaaactcatggttccatcagttgatggcctgctggtgcctgttggtgtgctttccacgtcctcttgacgtccagcggcttgtgtctctgcccactataaaaaaccactggggtttttttataggcacaggacggggacgtggcgggctcgggaaatgcaacatttgggcaaaaaaacagaaatgcctgtcctcacccaggtccctgggcacaggcctgggggtggagccctggccagagaccacgccctcctctacccagcacttccctgcccccttccttatcatctggtcccttttctcagacaccacaacttccaagaaggatcactggtcctgaaccctgtgtcttgtccaggtgtggaccccagaaaagttggtcctggctgggcgcagtggctcacgcctgtaatctcagcactttgggaggctgaggtgggtggatcgcttgagctcaggagttcgtgaccagcctgggcaacgtgacaaaaccccatctctactaaaaatacagaaattagctgggtgtggcggctcatgcctgtggtcccagctatgtgggatgctgaggcaggaggatggcttcagccagggaggcggaggttacagtgaaccgcgatcacgccactctcctccagcctgggcaacagagcaggatcttgtctcaaaataaataaaggaaagttggtcctggccctccagcatttctccagggtccttttttcagcagggacctggcggaggcatcgccctcagagtcctctggacctggacctgcacacctatgggagcaggaaggacccttgtgacttccagtggcccccctgggtgccaggtcccacagtagccacagcaggagcagagtgggtggggtataaactcctatcacaggagggaggactagccgggcctggctgggtggacctgtgtctacagccacacatttcctgggaatctggaagcctgctacagagaggccaggtcccactagactgaaagaagttcctgttaatccaaaggcctgacctgaggaccacaggataaactgcgtggttattttggtgccaatcaggcacggggactgttgttcctcactgtgtgcctataagcagggggttcctgggggtagacgcaggagcaagagcacgctctggaaaggtgatgttgtcctctgcacctgagtactgacttgtggagaaggaaggtagcgccggcctctgctctgcttgatcagccctgctgaccactgggttctgtttctaccccagaaaatcactggttcaatggcagttttccacctgccacaagggaagccacacgtggcagggctggggagttacagcatacccccccgccccccactgcctcccagagcacgtccccttcctcctggcccctggcacgtgcttcctccacgcacgtcatggctgactctgccctctcaccttcctttcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggaggtaaggatggggcaggtctggccatagaaccggctttcccagggcacagggattcgggctgtagggccacacccttggtttcaccactaagagctaagtgacctggagcagggggttaagcgtgagcctcagtgtcttcatctcagaatgaagaacagtccgcagcccttcggactcttgtgaagataaaatgaggaaatgaactcgaaggacttagaacggtgcgcggtgtgcggtgcgtgctgagtgcgtgttagctgttgtggtgcggtggtgctgggggctgcagggcgtatctggaagcctctgtgcagcagcttgaattgaaccctcccagcaccctcactgttgccgaagggctcgtcagtcacttggttcctctgtctgttcagtggagctgatgatcgctttcatctcacactcgctgtgcacaaagcctcactgcatcctcaacacagccagcttcacctaggaaggaactgaagcccagagaggttgagccgtttacccaagatcacacagtcctccagacgcccctcaaccctcacagggtaaatgagatcatctgtgtaaacatcgctgcacagacgttagcccccgttcgtgtttttgttctgagaaaggtaggccagcttgcctggagaggagaactacagagtaaagagggtcctggcacggaggaaagccaggacgctgcagcctagtggctttccaattttttcatcacaacctgcagtaagaaatacgttttgtactctgatagagtgtacacactcaggtgtgcaggtacagctaaagtaagttgcagtagccgcccttattacataaaagggggctctacttttccgattcatttctctttttttctccagaggtgggatctcacccatggcacactcttggctcactgcagcctcaaactcttgggctcaaacgatcctcctgcctcagcctcacgaacagctgggaccacaggcacatgccaccacgctcagttcgttttttaattctttgtagagatggtgtctcattaactcccaggctcaagcgatcctccctcccgggcctcccagagtgctgagattgcaggtgtgggccactggcttgacccttttttttttttcaattgcaatccactaagccgatttcccggggtacatgggtcccaaccctcagtttggagagccctgtgtgtgcttcccctccaaggcttgggaccccagaccgcagccacacggacacgttcgatcagtcactgtggcaggtgccagtgcgacaggctctgtgctgggggccgcagctggggaggaggaccactgggtgtgagtcgggcatacagcgtgtccctgccaggagtgtgtgcagagcgaccacagcacaggaaacaggaaaggtggccccgggggttctctgcccagccctttgtctttgatctgctaagactgcccatcagctcatggatttctgtagcgctgctctgtgtggggcctggggacatgaggaggaacaggtcagtccctgcctctgtggagctctcgtgtcatctggctgccgggttcaggagacctgcagaaggaggtctggtccatacctcgtggccaggggcctccaggagaaaggaagggagaataactgggcaccaggaaaatgctctgagggcctgacgttggctgggagagtgtggaaggagggaggaaggagacatttgcagaagcacagagggctggaggagcgccagctgtgcagagaagtggtgggtgtgagtggagcaggcagcggtgctgaggaggctggatggaggaactccaggtggctggatttccgcttctcgtcctgctggtgacaagcaaagcacaggccccctcggcagccctgctttattttcttctgaactttgtcacggtcgaaggaactttcctcctaccctctgtaaatattacacaaacagagggaccatcactccagaccctcaaagctgaatacagcggtggcttgctgtcagaccagggtttgagggggggaactgaggcacagagccggaagcctgtgacttccatcctcgggtgtaacctggagacgggggtttcaccatgttggccaggctggtcttgaacacctgacctcacgggatccacccgcctcggcttcccaaagtgctgtgattacaggcgtgagccaccgtgcccagccgagaccctgtcttaaagaaagaaagaaaaaaatccttcgttggggagcatctgcaagcatgaggaatgggggacactggagccagacaggctggtgcttaggggtcccagggccccgggaacccagcagcaaacagcctcgccctcaggggatgacgtaccatcagccacaggccaccagcacggccctgggcttcagtacctgcgagtctgaatggatttgctcctggggcaaccccaggcccgtgctgctcaggagggggaggcagggaggagcgtcggcagcccggtctctggggaggctggttcctgctttatccacgcaatacccagtcctattctatcaggaggaccccaagatgggccctaactcccaggccaagagccggtttaggcaccctccccgcttgcctgcagggggcaggcctgagcgcctaaccccagtccagagggctggactcagaccctcctctgtggggcaggggacaggcacgtagggagtactgaattgtgggggtgtgcagatttgggcttcaggcgcacggtgtgagccgacctttctagacagcatccctgatccccaaagactagcgaggccggggacacaggagcagcgatgggaagcaggcccgccggaacctccgactcccacctccccacgccacggacgctgcaccaccctgtgtttttgtttcatgtatttctcaccctgttccccgtgttccgcctggggaaccgagtgccatggacagagcagacacttgggcagaactgaacagcgtcatcttcgcctgcctggcgctccctgcctgggaaatggagcttcagctctgtctcccggcggattcttgatgcttcctacgctgccatgtgctagggaagattaactaaaatcagtcacaatatcccactgggaggtgacgctttttaagacgagcaacagccggccgccaagaggcgggtgaggccccactgagcacttctattgcatctaactggggagccatttgtacccaagtagaagcacacgttcactttgtagctcaagcccaactttaattagccatctgtatgaataaatgctgattccaggtccgtttcctctccagtccctgcagtttaagctgaggaggcatcgcttaaatcagaccatttagaccaggcatggtggctcacacctgaaatcccagcactttgggaggccaaagcagaaggatcgcttgagcccaggagttcaggaccagcctgggcaacatagcaagaccctgtctctacagaaaaacacacacacagaaaaattagccgtgcatggtaagaggaggagactgaggtgcccagcggctgcagcccgtgcatccccagggtcccagcacagagtgggtgttcagaagtgtctgctgagggactgagcaagaacccgactgagcacagcaagcaaacgctcagaacgggaggtcagcagcaccgctgtgcccaacacgggtttccaccataacccgaagttggaacgttttattcttccataccaaacaggagttgagaaggcggctgggttccttgaggtgtggaatgtcatgcactcctcctttcttgcgtggaaagcccgaggtataaagtgtgtatgatgtttgcttttttttttttttttttttttaagacagggtctagctcggttgcccaggctggagtgcagtggagtaatcccagctcactgcagcctccaactcctgggctcaagcattcctcccatctcagtctcctgaggagctgggactacaggcgagtgccaccatgcccagctaatttctgtcctttttgtagaaacagggttttgccatattgcccaagctggtctcaaactccggagctcaagcaatcaatcctcccaccttggcctccaaaaatgctgggattacaggcatgagccaccctgcacccaacctgtttgcatttttattttttaactttaagctattaagggttaatgtttgcatttcttaagggaaaaacagaggagaaagagccaaaggaaaaacactgaaatggtagcattcctgggtgatgagtttatggcgttttgtttcctggttgtctataacaaatatgtaatttttaaattagcaacagcgttagactacttcggggaaacctggctctgtgtgccacgaagcagggaagggcttgttcccaggcgcagcagcacttgggcatcccgtggtgaagtcagccccttacacctcctccaggcacagctgtggggagcatgtcccgagaaggcgcaggaagaggcccaggccacgtgtcccgtgtggtcagcctggggaccagagttaaaaccagagctcctccttcaggaaacagatcatagaagcctgtggtttcatcctgtgttctcagagaagaggcaccaggctggaaagacatttctttgggcagacaggcccagagtatagggcccaggttcccagagcaagcgtcccagggccccggcggtcgtaactaccgctgcatgggctctgatgctcagccgcggaaaagcaagtaaccgggaatgaaggaagtggggtcagtcccaaccctgccacgtgcgggtctcgagacggtggacaagtggctggactccactgggcctgggctgtcactggtacacagagggcactgggctagaactgcgttcctcccaccagaggctccacaccatctccgggcccctccccagagcctctcaaccaaaatcagtgtcttcaaagttcaagttgattctgaagctcagccaggtcgggaccagataatgcattctaggggacatcctcctgggtctcccatccaccctggtggctccctgggctgtgtgtagatgcccagctcctcctccctgccatcgtgtgggcatggcaccatgccctgacggcctccctcccctgcccacctctgcccgcagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacggtgagtctcacagggcctgctccccctccccactatgcgggtcccatctcctggctgggagaaaggccatccgcccaaaccatctctgagtgccagggaccgggcagcctgcgtccccctccaccccacagtgccagcgtggggcccatgagccgtggtctctgcaccgaggctccagtagcgtacctgcccctgctctgcgcccaccctaaaatgagaaacacggtcatgaggatgaaatataaacgatcgtcaggttcctcacaatcactcagtgaactcctcagagagtcagtgtacgtttgggctggccagacgcagtggctcacccctgtaatcccagcactgtggactgtgggaggccgaggcaggaggatcgttgagcccaggagttcaagaccagtctgggcaacacagtgagaccccatctctacaaaaaaacatggttttgttgttgttgctgttgttgttttgagacgaagtctcgctctgtcgcccaggctggagtgcagtggcgcaatctcggctcactgcaagctccacctcccaggttcacaccattctcctgcctcagcctcccaagtagctgggactacaggcgcccgccaccacgcccggctaatttttttgtatttttagtagagacggggtttcaccgtgttagccaggatggtcttgagctctgaccttgtgatccgcccgcctcggcctcccaaagtgctgggattacaggtgtgagccaccgcgcccggccaaaaaaaacatgttttttaagcatgaagtttgggttgcacctcagtgcctcctcttcccccattggtacagaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtggttttttttttttttttttggagatggagtctctctctgttgcccaggctggagtgcaatggcacgatctcggctcacgtcaacctccgcctcccaggttcaagcgatcctcccatctcagcctcccgaagaggtgggattacaggcgcacattgccacacccaactaatatttgtctgtttagtagagatggggtttcaccatgttgaccaggctggtcttgaactcctgacctcaggtgatccacctgcctcagcctcccaaagtgctgggattccaggcgtgagccactgcacccggccggtctctaacctttcaaacgttcttctccagacaccagcacagcctgccaggtcccgtccacaggaagctaccagatgtgctgggcttcagcccgcactgctgcacagaggtgggagaggatggagactctgtccccgaggtgggcagctggcccagggcagagacacacatgctcagtgccacaagctggggatgtgtcctcttaaaacccccctgcacagtgtgggaagctgaggctcggccaagggctctgggctaaaacccaggttgaacgcctcataggctagtcccctcccctgcccaactttcatacacatttaataacagttgttcacacatgtttattgataaaccgtccaaaatgtaggtcatgtgtaaacaattccagttgttgggtatattgggtattgatccctgcagcctcctaaagtgctttggacatgaactgacccgcaaagcaagggcaaaggcctcagatgcacagagctgccctgacatcccttggctcggagtccctgtgccccatgtcagagccctaaacctgtctcccctgcctgcactgtgtccggcagacaaagggcagctgtctgcacggtgaccccgagtacccaggacacggaccacgaggacccaatgaaaatgtcccctttcaccatgatcggcagcccccttcccacagccccgccagcccacaacccccctcccacggccccgccagccgtcctcacagggcaggcggcatctggcatctccaccagcatcacacgcagctgtccctgccagctaggcaaggccgtaatgaccggcacaagcttgggcttgggccgtgggcagcaggagggctggagaggcatgggggaaaccccgctctccctccggcatggggcctccacctgcagcagtaagcagcctctcagcccctgagcctggggacctgcccgggcagcacagggccagggccaagaagtatttgtgagaaggaaggtggcctccgccacccctgcctagcaggcctctttctgctgccctttagaaggcactgggtggcagaggaggaaggggagggaggtgttccaaagccagtgcccacccctccacagagccaaccccagggcacacaggaagcagccaccacacgtgggagacaggctgccctcgtcaccgctgccctccagcccccccttcaccctgccctcctgaccctcccacccctgccttcctgcccccccaccgccctcctgccttcccacccctgccctcttgctctcctcacccctgccctcttgctctctcctcacccctgccctcctgctccccctcacccctgccctcccttacccgttctcctgctccctcctcacccctgccctcctattccccatcacccctactctcctgctctcctcacccctgctctcctgctctctcacccctgcccccttgctctcacccctgccctcctgtcccaacgcctgccctcctgctccccctcatccctcttctgctccccctcacccctgccctcccttacccctgttctcctgttctcctgacccctgccctcctgctcccccaactcctgccctcctgctccctcctcacccctgccctccagccttccacctccatcctcagcctctggacatgaggaccctgagaccctgctcttgaagtttccaacacagggagatgccgcc

SEQ ID NO: 12100 - DNA, 23292 bp, Human
  misc_feature (1)...(23292): n = A,T,C or G
aacaaggtagtggtgtgaaggctcagagtttcacacaacgactgttgttctgaactaaaagcagaggatgtggatgagtgaggggagggtatgttgaaaatgactaaacccggtgcagaggacacgtatacgaaagtgcaaaaagctctcatttgccattttttgtcctcagcaaactcctctctggtatgtttgtgaacgtttgagggaaaggtaacactgattaaaatataatgcaacaagaaggcaacgatctttgctttgttcactgatgtgttccaagtgcctaggacggttcctgacaagtagcaggtgctcaaaatacatttgtcaagtgaataaatctgtgaaaggaaaggaagaaaaacaggttgtgaccagaactttttgtgaacaaaaccctgttgtttattacatagactttggtaatggaaaacttacttgggtgaaataaaaaatggcatcctgttaatttctgagaacgtctgttggttttaggaaaagcatacctatccatacctcactacctgttttgctctagcctaaacatagattcttctttggttaggagacattgacccaatatataagattaaaacaaaaactgagaaataagtgaaatcaaaagcttttcaaaagttgcaggttgacctacggtggtggtggtctaaaatcatatagaaaccagagatctgatggtttacctgaaaatgcgaagtaaatgcacatactcagcatctcagacgatcgaaagctcaacgggtgaaagctcagggggttaattttgcgattaaggacatcttggaaaagtatgtaaaatccctggtccacttaagtattattcctattttgggcttttatttatttattttgagatggagtcttgctctgtcgcccatctcggctcactgcaacttcagcctcccgggttcaagcgattctcgtggctcgtcctctcaagtagctggggccacgcccggctaatttttgtatttttagtagagatggggtttcaccgtgttggccaggctggtctcgaactcctgacctcaggcgatccaccgcctcggcctcccaaagtgctgggattacaggcttgagccacagcgcctggcctattttgggcttttataccccactggtaaactgctttcctccaggttgaggttaaaacgacatcattttaaggtgaactgaagtctggaagtgattaagcacttggatccttagggagcctctccccgcccccatctctttcatgctaagataattaaaacttcggggccggggcattgtctgagtcacttcaattcaccagcctaatagatgcaaaaggatgtaagcatgtcagacacgcagagacagtatttgaatcaagcttaatagctcaagggagctgggccatttcctattttctttttagtgagtgcgatgttctctaaacaccgcggagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctcgcactctcagtttcaccgctcgatcttgggacccaccgctgccctcagctccgagtccagggcgaggtaagggctggagtcgggcaggaggaggggtgtgaggctgataccagagaggacccggagcgcgaaccagaggttcgacctccagggcagcgcagggtaccccggcttcggagcgggaagggagcgcgccccgtcctggagctccgactcccaccccatctgcgctgagccggaggcgcgggtttgggctccaaggcccgcctccttggctctgcccgagcctccccgcctgccctccgcgctcctgcgacggggtcgccacaagctggacgggatgagctaaccggactgtcggggccccaggagtggctgaggcggggccgtccaaggcacccacacaagacggcacaactgcctgcgagaaacaggcccggccctgtggaccccaatcctaggctccttcccctgctcttcgttcctaaggggcccaagctcacggcggcctccggcgcggtgctcacccgctggcgcaggaggaggaggagctccacatttgggtcgctccgagccttgcgtgcggtggcnnnnnnnnnnnnnnnnnnnnctccggggtccggcggacgctctgcgcgcggaatcccccgtactggggctgcagcccccgcgtctgcgccacttgtcgtttgcagagcccacttagtgcgcgctagctgggcagggataggggtcctattcggggcgaagggtctggatgcgagcagagaaagcggagggtggaggaacccggggctgcgcccctggaacgcccggccgcaggcgaggtcctccgcgcgtggaggccgccaggggagtggaaactgacagagtcgcgggaaggggcgagaagcgggttgggagtgagcgaaggcaagcgagagctgcgagtgagtgcggaaggagggccaggaggggtggcggctgggtggggagagagggtgcaagacgagcggcgcgtgtcgggagcctttgggctgcgggtgcgttacaggagagcaggcgggtaggagccttcgcgggggccgagctcggaaggcggacggctgtgcccgcccaggggatgcgcccgggccggccgcgaaggtgccttcttccgggggcccggacgaccctgacacggcacgcgcgcgcttcgcagcctcaaagactccggggcctcgtggtcactggcgcaggggatcggggcggggtgcccggagtgcggtgcctcgtggctgaagggcagctcttctccccgcagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggtctccggcctcgggagccggcgggggcgcgccggggagggcccagagacagagcccggggtccccggcgccgcctccgaggcgagcccaggggaccgcgcggggcggacgggcgggcggcggaggcatcaggtggcgtcgccggagccgcaggaggaggaaaggaggcctcggctctcagcgggaccgcgggggccgggagccgggtcctgggcgcgtggaggctgcagggaaaccgctgaaggcccggccgggcccggggaagggcggccaaaggcttgaggggttttgcgcgttcgtccgtgcgttctcgtttccacgcaagcctcccgcccttcctccgggctcccgtctgccgcctccgtccgtgggtccccctcgccctctccgtgcgtccgcgcctgtgccggcggctgttttcgtctctcaccgcgtctctgtttctcttttcgctgcttttctctctgagtctctctctctccatgtttttcctgaggtcagcctctcttctcgctcctgctagctctctgcgggtactcccacctctgtctttctctttgtgtgtctctgtctctctctttcccccatcgcagtggaactcagggcctctgtctagagctgtctcccttgccctttgcgcgagtgcacacacgtgtgtcgttgttacgattgttctcccctaaggcagtttacccagagaactacgtgtctgggcccagcccccacctgtgggcagagcaggggaaggggacttcctccgggaatttggtctcaatttgctctcagagtgcctcagctgtgctgccatccagatgtctcctgtgggtgacagctcacaccacagctgtccttagtcctaggcaagctcactcagacactgggtgggtagagccccctgaaggaacctccgcatctcactctaccggttataaatacccagaaaatgtgtcttcaacttggcagtgatagggtccaagatggaaaatcattttcctagagcatagctggggtctttcagtttacgttctgagcaacggtgtaaatctgaaggacctatgcgccattctttcttttagaaatacaatttcaagattccttataaaatatctgtattttgggtttagcatggtggctcacacctgtaatcccagcactttgggaagatgaggtggaaggatgcctatgcaacatagtgagaccctgcctctgcaaaaaataataattaaaaaaattagccaggcatggtggtgaacacctgtaggccgagggcccagctactctagaggctgagataggaggaccctagaactcaggagttcgatgctgcggtgagctatcatcgtgccactgtactctagcctgggcagcagagcaggactctgattccaaaaagaaagctaataaaccagacatgtattttgacttttcgttctcttcattctttcccaccaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggtaggggctctcctgaatttgggtcacctaacagaggcagccagatccttgaggcaccttaacttcattctgagcatcactttctagctttccttttgtattgcctgcctgcctgccttctgcctcacagtgaagcccagcctccttgcctgagttatgtgggtcacaagttgaaattcctgtggggttcagcataggagaattaatcacactgtatgcctcaatgtatatgggggggggtgcattgaatatgtgttttccagttagtctttcaaaaaaaaaaagaaaaaagaaaactggataacttgttaaaatttacttatctaatagtctttagtgagtgactattttgcagaaaaggagtaatgagaggaatatctcatcactatgcatggtaataaaactgtcaacttttaaagtgtaacatggtcagctgaggtgtttattaaaagtcagattcctggacccctcttttcaagattctgaccagtgtgtctggaagagagctcaggaatctgcatctggaacaaatccttcaggtgacctcacttgggaaacatctggctggcggggtcctttatgtcacaaggcacattcgcatgccatctgtcatgtatttctttacctgtcctgtacaactcagaccttgtagaaaaaaatcagtttaatagcatgaaaaaataacttcccaagggagttgctgaaaaataccttatttgtcaacaccgtgttatgcattctaagaattaaatgctcaggtatttttacaagatttgacatttagttaggtcagttcctgtttttacgttgtgccatttcccttttccccaaacatgtaggagccaagcagctcaccctggaggacccgcagatgtccatgagccacccctacaccatgacaacgccttacccttcgctcccagcccaggtatggtggagggcactgggctccctgagggcgaggctgtgtgggccagctgcccacatggccagagaaccacagcagcccagacagcagaacttgccatttgctatggctgctccaacagcccagaaaaaccccaggtcactgaacgaatgtctcactttccacacggtgctgccattggtgtggattttaagttggggagggtcgggcgtgtccgcctgttggaatatgcttctcaggtcttctgggaaacagatgttttgtggaagtggaagattttggaagtagtgccttatcatgtgaaaccacagggcagctgatctcttcaggctttcttgatgtgaatgacagctttgtttcatccactttggtgggtaaaagaaggcaaattcccctgtggtacttttggtgccaggtttagccatatgacgaagctttacataaaacagtacaagtatctccattgtcctttatgatcctccatgagtgttttcacttagtctgatgaagggttcactccagtcttttcggatgataaaatgcttcggctgtcagtctaataagggattccctgaggagtttggaggctgtaagagcaccccccgtctcaatgccagtgcttcttatctcagcctctcctgcactcctttacccccgtctcgatgccagtgcttcttatctcagcctctcctgcactcctttacccccgtctcaatgccagtgcttcctatctcagcctctcctgcactcctttacccccgtctcgatgccagtgcttcttatctcagcctctcctgcactcctttacccccgtctcaatgccagtgcttcctatctcagcctctcctgcactcctttacccccgtctcaatgccagtgcttcctatctcagcctctcctgcactcctttacccccgtctcgatgccagtgcttcttatctcagcctctcctgcactcctttacccccgtctcgatgccagtgcttcttatctcagcctctcctgcactcctttacccccgtctcaatgccagtgcttcctatctcagcctccccgtctcaatgccagtgcttcttatctcagcctctcctgcactcctttagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggtaaggaggataccagtgcaggaaatagaagagctaactgctaatgtggccatgggccatggcgaatcctggtctgtcctgggcagcaccaaagctctttccccttcttagaggctgcgtgtgcagctcggggagaggggggttttctcactcctgtgggatggtggcatcccacagccaagtttactctcaggatccatgctaggcactgcccttcgtgggatcttatttaaacaccacagagatcactccaggcagtggaaaacagccccccactttttatatagagaggagattgtggaagctcataaataataagtagggatgctgggagattattgagctggtatatttctctcgaatagtggtgtgttcattgttgctattgttggaattagaggtgatactaaaaaaggaacggaaaaataccatggcaaacacataaaacgtctctacaggtgcctacctaccactgggtcccagaaagacttgctgattgtggattagatgtggtcccctgccctcgggagttccccagacatcaaaatgagctccctcagcagaagctctcattagctgggtgcagggagaatctagcaatgcggtaactcaggccttcaggacttttgagttagttacttaaatggaagtcctgagacaggtcaacacactgaaccctttggatgttttaggaatatttgttcctttgcaatttggcctttttttccccagtcatgttcaggttatccttggctgcaggtagtgaagaggtgtaccactctttaatgtttgtactgagtggcatgttcacaaaaaagctcagaattcagttgcattggcttttcaagagggatttgcagcaagggctggtttccaatatggtagtggaggaattggctaacataaaactagctcctgaaattcagacttgcgtttactgctctggctctatggaattagtaaccatgggaaagaggcaatgcttagaattgtgtaaagtgatggagtaggtagagacctgtcttgaagcatcggtaacagtaaatgaagcagcagcaagatcaggtgttctgtgccacattctttttccattcatgtttcatacaacattgtcttcaggaacatggttcagtgttctcccaacccacaagagacaagcaaaataaaaatggactaaataatttgctagtttttaattgggctctttggcacagactcaagtagacctgaactctcagctctgttgtgaacccgctttgtgaacaaggacaaagcatgtcatctgtctctgagcctcagtctccctgttagtcagttacagagagagcgctccaagtttccttccaaagctgtgcactggctcgtttctccatcagctttggttttccagttggtctccagctcatctttgcctcacaagagcgtgccctgctagttgctggtgctgggagtgggtgggaaggtgattgggcgccagccccttccttcccaggcttcacacacacaccccaggaagccccgcggtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcctgtgtgtgaggtgaccagggtgatttaggagcaccattagaaaacctgacatcactgcttgtggttctgctgaccgtttcagccactggcttgaatggagtcattttggcttcttcactggcacctctctgaatttctaggaatgtgcctttacctttaccgagggcccctcttcagccaacattctcacgatgtggaataattgcttggaagtgtagaagggcttctcattttgagaagctgatcatccttccaggttgagccacaaataagtcctcctcctctactccctggggacattagttctggtccctcatctctaaaacattgatgtgcctaagagtaatacacattttggtcttcctctgaactttaatatagcttgcaaacaaatatggattcaatctgatttttaaagttttatttctaaaaaaaaaaaaaaaaatccctgcaccatggagatcttacctactataaagaaggcacctctaggcttggcaagcacacgtgctatatgtatatttatttttcagataatattttggattgtttttaaatgggatttgtttttatattaaaaccaaatagcttaaggtttggaattctcatcttgccctctggcatctttaaaaatcagtgatgaaaaatactaactaaattctgaaggtttcagggaggcgagagttgtggcacttttgctgctcagaggggagctggagtttgacctaccagctctttctagttgtgaatgaggcttgcacctttttttctgaggtgctcgtgagtaactgaggatgccctttgggaggaggtgcttctgagcaggaaggcttgtgtttgtttttagaaactttcaaacccttgtcttgaacacctaagacttgtgtgggtgcctgaagagtaggaaataaacagctatttatatctcggcaacctcgtgatttctgatgacattaaatgaaatgaaacctgccccgagaatcacctcgaatggccaacacccactctctttggggcgcactgtctgactcgctttcagacagtgtgttgaagcagagaattgagacagtgatgtgggttaagtctcaaaacctgctgttgaggaataagatagttttgtgggtttctttttttggtatgcatgatacagattaattatcagccatgagcacatttattagataactgtgattcccattgattttggggttccatacagttaccagtggcagctgcctcctgtctgtgccactcccctgcggtctggctgaggagcttgtgcaaacccagcttggttctttcaactcatgggcgatattttaaagaggcttctgaaatcagcaaaacgtttgtaaatggattcatcttgtttaaagtttcagagagcgcagttttagagttcttttcaaacttaaacacaaagcccagtgggaatttcagcagactttacatgaacttttagagtatttttctcattaatttctttcttttcacaagaattaattttgtgataaaaacaccacatatccagtgtggaaaactaatttaaaaatcagaaaaacaaaaatggaaaataaaaacatcacattctaccacccagaaatcaccattaaggcctcagtgcttaccctttaatgtgtgtatgtgagtgtgtttatatataaattatatagacataaataattaagcacctaattctatatataatttatatatgtacacacacacacacacacacacatttgctttttacctaaatgatgtcatgttattattttggggacgtttcaggtatgtggaccgacttgcttctttctgaaacaccgttatattttttgctagtataaattaaacttagggttcatttcctccaaagtaaaaattgatttgcttaaagatgaattttcattcagtgacacatgacttaaatgacatcaccactatcatcatcataattcacaaataagacttagcaagttcttaatagtgatgctctataataggaattcaacttacatttccagaaaattaatgaaagatacacttgttccttaaaaaaagagtcggtggccacatacgtttgtaatatgctggtttagacagattaaatgggtttctttccacgggacttctccaagtgttgaccgagctcatgctgtctgtggatctctgggggagacaagggcacgctgtgtttcccaggcctccttgacgcgggaaccttttgttcccccacgggacatgtgggacactagagttccaccacaggtgcttggctctgtggagtcgttggcctcgaggtggtgtccttggcccccagcactgactccggagctctgtgtttgcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcaggtaaggcacctcgttatctgttagaatggaggtggtgatggcctgcctgccacaggggtcagaaaccacagggtccctcccaccccaggctgaggtcttcctcctgttgacttcggcgcccactgggcttggggcttgactccagtagagatcttctgtctggctctgttgtgggcagagagtccggatcagatggtccaggtggaccatggctcaggctgttctcttgcaattctggttttcagcagtcgcctcttaaaacagttccatttcattgcactatgatctcgacaaatacgtctgctgatgtggcggctcttttcaggttcccagaaaaatcataaaggttggaagcatattgttaacattcttggttgtcaggtgtgtcaccctcatgcagatgctggcccacgagtgagacggagggtggagtggactgtactggttttgcacaggagaagttataggagagtgctataagttggctctgtgatatgaacatttctaagcatatttttcagaaccagtgagttttgtttttctaccttggatttcatgacaattcagcgaacctctggctggcttctgtgaagcccctcgccctgtcatgctgggcttcctcactggctttgtggggctgtccaggtggagggagcctcccgcgtgggagggagctgctctacccgccactcgccaccccaccgccaactcttcctctgccttttcccagtcctgtcccttcctgagccccttcagaaactcctgtgtctttgatttctcatgtgcctccccttttcttgaatgtgcttcttcattcaacttatttaaaataaaaatatgacacgtctgtgtgctctggcactgttgacatgtgctcgtacttctgggtgtaagtgacccaagtttttgtaagctcatccagattttcttttggtgcccaaagcaaatatgtccccagataactaagcttcaggccaggtgtggtggcccatgcctgtaatcccagcactttaggaggctgaggtgggcagatcacttgaggccaggagttcaagaccagcctggccaacatggcaaaaccccgtctctactaaagatacaaaaattagctgggcgtgatggtgggcgcctgtaatcccagctactcaggaggatgaggcacaagaatcgcttgaacctgtgggaggcggaggttgcagtgagctgagatcgcaccacggtgctgcagtttgcaggacagagcgagactccattgccccccgcaccacaaaaaaataactaagctcacacagaggctgaccataggaagagggagaactgtgctggttccccgaggcggcggcaagtgaggaagtcacctggggctggacacctctcattctaagggcagaaccatccccaagccctggccagggcggtcccatccttcttggggttgggcatggtgttcatgggggaccaaggaaattgaagggcaactggggggaccccccctcccctgtcagcatctcctgtgtctgccttgggatctggaagagctcacatgggccaggaaggctaaggcccactgggcctggatttctgaagactctggaccttggtgccagtggattcagaagataccacaaggtgagggctttctaatgaaagtgtcacaaggaactggcactggcttttctgagtgcctcttgctgggcgtttttagggaggtagagcccccgtggtgactaagctggaaggtgcacattgagtcacaggtgcactgcgtgagagacagcacaggcagggggtggacgcctgtgagtgtcctggggctgtagacttgcacgactagaacttactattaatctgtgagcaagagctggtcttggctttcattccttcctctgtaaccaagggctgtgctctttgcccactgcagcctctcacctcaaagtgttcactgaggttcaaggaggatgctgtgaacgtaaaaactgcagctgtgccaaccagcttctgcataattaaggattcccaccaaacactctcatgttatctagggttggagccatgctttctcagagaattgtgccaactcgccattctgattagcctgtgtaggtgtagtctcagatcacggcagtgtgaatgtattttacagattctgactaagtcatttgggtttgatttgaattctggaaaaaaaaaaaagcaggaagtcaaatagtcctgtaagttagctagaaacttctgttcagttgaagagaacagtggagatctttgatatcttcctattcaggtctgcacagcactagggacagcccccagggcccggcccgagggtgtgtatctgataaggacgcgtctgttctgcagaagctgtagcggctcctgtgtcaactcgtttcttttgcgggcgtgacattttattgtagctacaggcagaagatttgtcttgtgtacaggggagggagcatgggctaaagtcaggggatgggcacttgtctttccaacaatgttccagtccgttttgtatcttttgggtaggtgtggtggcttcaggatgtacatgtgtatatccacaagcgggaggccaggggggctgccccactcctgttctcaagtcaagttactgttccatccctggagacaggcaagaagtctactcagagttacacagttcaggcatagtgacagtgggactcagctgccgatggctggtgctcagtcaccacgttgacgttacatattttctgtggtgcctgagttacgtggatgtccgcagtagcacagatactggattatgtgggctctgtagtgaggggatgaggttttaaaatgatcctgggatgtcgaaacattctgattttttaaatgaaaacttgtccatggcataaattggtcttttgccattgcgtgactacgtttcttgttctttatctcccgacttcactgtggtctactaccttttgaatcttcgtgggtccaatgctgcaaagcagtgttctttagctgtcgactagttcctcttgaagaatcgagggagaccgagggccctggggggaaagcacccaaaggaatgcatacatgctattttgtatctgagatgttcacatcaagagccccactcagcggagtaagagtgctcattcctcttgcagtgttcagaatcacagtaagctcttgcttcctgtttaacctggtgtgttcggtgatgagggtttctgaacatggtctctttcttgtgggcttctacagagctgcaagcgtttgctcaccacggccgctccctgccaagattccaggtgactctatgctttggagaggagtttccagaccctcagaggcaaagaaagctcatcacagctcacgtgagtcctcagttacactcctaccatagtggcttcctgttctttgtaaaggccagagtttcatttagaaaagtcccaaatgaaaagtaaatgtcaaatgacctggaaaaataagcgtaacccttaaactagtgagggaggaagcatggtccaacgagcagcacagtctgaggactcacgtgctcctcccagacttgagatctgctcatcaaagaaccagggaggacagcctcaaaggagggtgcctctttccccatcttttttatttttcaggaaagttgtcgtatttccattttatagggattgaaaaagattgatggttaaagttgccctttaaaattctccaggttaagattgctgtaagaatgctatctagctagtggatcttcattcaatggaaaagcttttcccaaatgagaaactatccattccctggaggcattttgtaggtctctgcagctgtgtcctagcacctcttttatttctggaattttagaaattatttaattattgggcatatgatatttgaaagaggctgaatctttcaaggaattcaagcaaatcagaccctctcgtaatgttctctagcatagctcaagatgggttcaactgtggcaagtaacactaaaagggtagggttaggattagggttagagttttcttttttatgagaaaaggtttccatagataacatgaagcattaatttgccatgggaaacagaatcttgaacccttaagacttttgaatttgaaaacttcacattgctacatacttgcaagcattattaacgggcttgcatgctgagcaataccaggtaaaagttacaccccctaacatcaaagttctcatcatgttctagctctgatgctatttctcattgagaactgaaatgaaacatggtttaatcttgaacatacaaccccccttcttgattttaaaaacaaagaccagccaaccaaccagtatataatcccatagactcaggagttttctcatgagttctctccagtgattgacttaataattgatatgattgttgaaataataactgatacattgttaacaacaggaattgctaaatgactaaataaacttggcattgataagcagcatttaagaagttgatgatcggccgggcacagtggctcacgcctgtaatcccggcactttgggaggctgaggcgggcagatcatgtggtcaggagttcgagaccagcctgaccaacatggtgaaaccccctctctactaaaaatacaaaaattagccgggcgtggtggtgcgcacctgtaatcccagctactcgggaggctgaagcaagggagtcacttgaacccaggagtcagagcttgcagtgagccgagattgcaccactgcactccagcctgggtgacagagtgagactctgtctcaaaaaaaaaacaaaaaaagaagttgatgatcagctcagctatcacatcaatccagttttaaagttgacatggatgcaagtcactgtcctctaagtcagggaaagatggatccccagatgaccccctcatgctgaagacgaggctgcgtggtccataaaatgaataaacacacgtgtacacctatgagttccacttttaaaaattattaatttaattcatttcaggtacttaggagtttagcttaagtcgtcatatataaaatacagtctctaatatcatgattgatggagagcattcagcttgccttagatgctgtaaattcaggaaaagctgaacattaaggcgtttttgttttttggtgagtgtgatccacgctaataaccagacagtataaatttgaggccagttagcttctctttttccacaatagtagttttgttgttgtttaactttactttttatttcttttacctctggttgagaactatacagattacctagaaatcaaatcattcaggatgagctccttgtttctttcaaactgcagttgtggaaaaacaaaatcattggcctaaattaccctgcagattccctcagacttccttttaatttgatcactttacttgatttgatgcagttttagttaaatgtacattttaagtggcagtcgatttgaaagtaacatctttaacccagaattaagtcactttggctgtttttttacatgttgatctatggaaggactaaccaaaaaattgcttctttagatggctccaaatatgaaatgttttgatgtgttctaggatgtaactttgggctttacgttactgtctccttagaatctgagtgctgtttaatagtgagccagttgcaggatatctcagtaatgtctttttaaaatctcttattaaaggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaactcagaagtggagatttcagttcagcggttgaggagaattgcggcgagacaagcatggaaaatcagtgacatctgattggcagatgagcttatttcaaaaggaagggtggctttgcatttcttgtgttctatagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaacgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttatggaatgtgtgtgtgtgttattaaacatgcatcctgatagcttttaaagcactttctcctgcggttacgttccttcagagaggctgctgtacgtgtctctgaaatcagatctccaagtgttcaccttgttaaagagacaaacgctggccaagtgccgggctgctcctcccacacagaggagtgtctgtgaagagtaatcatcctgctctcccgttagcatctgcctcctcttcctttatctgtactttaaaaggtttagggctttcaaggaagttgtttttaatgttttcttttgtttatattcgaagctcctctgattttggtcattgctaaaaagaagggatataggttaactaacactccaaatgtgaaaatcaaatggaaaactggataaagagaacaggatttagatggaacccctggggatccgtacgtctgctgttgacctcagctccaaactcttcctctctctgagcagccaggcaagggagtctcctttctcagcttcatcgcttctactgattacatggctcagctcctatgcacctactaacttccagtccagcagaaaaactcaaagaaccaggctgcagctgctggtgctaaaatccttgcagctgaaggttacatagagctgtcagaaaagtttgtagtttggatctagaaccccccctagaatagtagattagcataattttgattttgctaaatggtaaaatttcttttctaaaccctcacaagttcagttgagaaactttcctgaaaacaaagatcaataaatcttagcatagtgataagacaaaggagacagcagctccagtgttttaaaaggggacaaaaatgagagaaggtagtaaaatctgttcccagattccactgctgccttcgctgttcccaggaaggaaggatttatgtcctgatctcaggagacaggcttcagcagagtgcttccctgtgagttctgtgttcctaacttaacaattctcaatattttggggagaaatattttggtttccttcagtccccccttgaagctttactttcagaaagtttcacatgttaaaagctaagttggtagttttggagagatttgggttagaagttttaagataagagatttggcaaaggaggaggagaacatagtttggaacaagcagaaaggaaccaatttgggtacattgttccatctcttattgtatcagtctttcagtcctgaaaataggtcagttccgttaaatcattgcatcccatttcagaggtggtgtaagtgggcttccataagagttacgtcttccatatggtgtaggcacacaggtactttatcagagacatttgtatggaaataaaaagaaaacaaaggtctatgtttcaagcagtctataagctagtttctggagagcaaccagctgagatttctagatttgggttcaaataattttaagttggagtggacaggcagtggcaatctgacagatttttctggattatagtttgcatcagacgttccagtgaagtttttgtccataaataaattgtgatgacttctccaaagtttatatcaagttgttcagctttcatttgcagggcttcaggaaaggcacggttttaattcctagtgatttcaagtcagaaaggtgggagaaagttgggaatgttagtctgaagagccatagcagatattagaggaaactaaaacttcaggattcagtccagataatttttaaaaactctaaaacaatggacagggcta

SEQ ID NO: 12101 - DNA, 94879 bp, Human
  misc_feature (1)...(94879): n = A,T,C or G
aaaatgtgttcagtagtataatgtggttaaggaggggctgtctttataaaagatgttcattaccatcttgactggcttcctccccctccccgccacataactaaagcatgatgctattgagttctaagtctagtttccacccttatatgaaaagtcagcttggcacagagtttggtagagctaagtctgaccagctgcactctcagccacaagggaaattagacgagacagtgtggctgcttcagtaccaatcaatcaaagtttttgaaaattatcttgaaaacacacaccaataaaggcatgtgtgtagttgtcttttcatataaactcaggttagtcctagtgcatgtgaacaaagaaagtaaggtgtcttcttcaggttgactacttggtagttcctatttctctatcagttccatgagcgttttgggagaaagtgaccacatctactacagtctttcaacatcttaagttagatttgtgtaccctccaattgaatcacttgaatcaaaacaatagctactagtctatttgactttctttgcccaggccccatatatatctttttattttatttttattttttgtagagacagggtcttggtttgttacccaggctggtctccaactcctggcttcaagtgatcttcccaccttggcctcccaaaatgctgggattataggccccagcactgcacccagcctccatatatatttttaagtgtataatccagtggtttttaatatattcacaaagttgtacaaccatcaccactatctaatgccagaacattttcatcatgaccaaaagaaaccccatatgcactggcagtcactcccaattccacctcccttaggccactggcaaacactgatatactttctcaccatatggatttgcctgtcctagatatttcatataagtggaattgtacaatgtgtgttctattattttttattattattattattaatttgagatggagtttcgctcttgttgcataggctggagtgcaatggtacaatctcggctcaccacaacctccgcctcctgggttcaagtgattctcctgtctcagcctcccgagtagctgggattacaggcatgcaccaccatgcccagctaattttgtatttttagtagagacggggtttctttatgttgttcaggctggtctcgaactcctgacctcaggagatccacccccctcagcctcccaaagtgctgggattgcaggcatgagcccagcagtgatctattattttatagtctacgtttgtatgtctgactgacttctttcacttagtgtaatgttctcaagcttcatccacgttgtagcatgtgtcattgcctcattcttttatatgtcctataattttgaaaaatgatgtttttggaaaaaaatgcaaacgcagagtatcccctaatagaaatctttgctattcttagagaagaacatgagacaagttatttaacctagagatttggcttgaaaaattaatattgacatatcaatgaggaataagaaaaaatataaatgcaataattaaggactgatgaaaatgaaaagctaattggagcataaaagtgatcatctgaatacaaagacttttctgcctaatcttagtgaaaattaaggtataggttggattggcatattatgatttttaatttgtttttttaatcatccagcaaactttttgcactcctgagtcagcacatgcatctgtcagagagagaagagcaagacggagcacgaggctgcagctgaatttagaaagttagaggtgttctcatcagccacatgagatgggcaggagattccttccagtaggcgagagagcagagtgcagacaacagatgtgagaaaggtccccatagctgtcaagttcctgcatccttgtgctgaagaaagggaggtgccatcatgattgatgttcagaggcagtataaaagcactgggtttctccccaactgcttgtcacaccgacctgcaccatctctcgcctgcctgtggggtttctgtcaactagtcgtggagggaaggagactctttaaagaataacatcttattgtggccatgccagaacccactaagaaagagggtaagacttatctagaaatctttttgttgtactcctgaataaagtgtttattttggtatttatcttcaaacaaataacaaatatcttaactagatgagaaaataaaatcactatgatttaaggaaacgatcttttagattaaacagaccagaggaaaaatacagcgagagtatattgaattgaaaaatttctgataacgatagtttctaaagggatattgactaaaattatcaaatgataattctatcattcaattgtaaagaatccttaaagtgtaatttaaggatgttaattgctgatggtaaacagattacgttttcaagcatattttcttagatttaatcacaaattttttaccatgtatttgcaatttgcagagagtaggagacttaaaatattttctcaaatggttaatacattggatcaagatttcaaaaaagaatttgtgacattatttccatatttgctactttttttaatggaaacatatttaaaatatacagacgaagggttttttttgttcttatcagtgcctttggaggttcgttattaaattcttgcatggaaagaaaaccaaacacctgataaaaaaggatgtccctgaatatcatgaatagattgttctttcatgagttttattgtagagaatttcataatatgtagtaggctttaagaatagttaagctgaaagtataaaaatattcttccttagaagaaatgttttccctaacaaagtttctcctttctataaaaaaattagtgtattaaagctaccaattggtaacagaagtaaattggaattagtagttatgaaaataaataataataagcacaaattaatactatgcatgcattgaatttaatttttaattaaaatatcttttaaaaatattatttcatttatattcatcttcattaatgcttactgaatctttatttttcccttctgcaaataaaagaaaaagaaagattagcaggaaacataaaaatagtcatagttttcagtttttaattcttaaaaatgctttagctattattttaaggaaccttgaaaaagatgttgaaatactaaccaaattatcaaaagtcttttaaacatattttctttatataattaagtaaccagtgttgacaggctgtggtgatcagtttacaggttggccttacttagtggcagagggcattgatggatgaagtctttcacccaaaataaccacaccaaatgcatgtattaatatgggaacttaatcctgactgtcaggcagggagtccaacccctgctaaagtatcttatttgtaatgcaaatgatttacgtgtgtactaagtgtcctttttatctgctctgtcactttaacctctccgaagtgtacccagaagcaatacattctaccatgtttccaaactggaaacacaatattgttttaattattctgaatttagtgaatgattttgcatttgtttttttaaagcctaattgaaaatgagaagaaagctgaaaaaccaataaataaggtgacagcctgtaagagccaataaagctaattaaattattctgatcgcaaaggcgatgaagtttacttttcatttgacaactcagtctgattcactcttttatggggaatgaaattatagagctgcaaagaggaaaatatatctttaacttcagcccccacccccccaatatatatttttttctttctgaataaaacagcatggatgctaaagactccatcatcttcttttgctataaaagcatgttgctattctgtgtaggagttcctccacccaggacagtaattttatacccataaattctttggttagtgtaaatttggatgatggggattggggcaagaagagttactgatatatttaaaatccattgaggaagtacagagatttttttggttcccttaccagcagaactgattcttaaaggaactgtaccttgaaaagctttccttagtgaaataattgcattttaatattgtttacattagaagagtaaggagtacggcaattcatgaactattctggtcctttcttcttctcctaactgtgatttcattttcactggggttagtttgattgcatataagcatccctctgaaaaataaaacatggcctagagccagttcttcagaatcatttcaaaatacctgcagaaaccctcccaaagaacaggctcctccagcccatatgggtcttctgaactcttccccacagctcgtaaagccatgcccaggaaggccatgaccacttgctgtgaatcttaataggacacatgagctggtttggccctcctaggatccaggaggatctggcaactcctcaaaagaggctgagttttcagcacctgaaggtacaaaaaatgtctcactcaactacttcccagcctaccgtggcctaattctgggagttttcttcttagatcttgggagagctggttcttctaaggagaaggaggaaggacagatgtaactttggatctcgaagaggaagtctaatggaagtaattagtcaacggtccttgtttagactcttggaatatgctgggtggctcagtgagcccttttggagaaagcaagtattattcttaaggagtaaccacttcccattgttctactttctaccatcatcaattgtatattatgtattctttggagaactatgttatttgtactgtctattccagataaaacttaccttacaccactttggattcttacagaacctaaggcctagtacaattaagttattccgatcaaattgggaggatgttgtaggcagtttcagatttgtggggatctcccaggatgcctttgatacattcatttatatatcaattattaattgagtacaagtaagtgcccgaaagttaattgcccccggttcctactgtgtaaagaaatcacctttctttttttttttttttttttttaagacagtatctcactctgtggcccaggctggagtgcagtgccacagtctccgctcactgcagcctttgcctcccaggttcaagtgattcttgtgcctcagtatctcaagtagctgggattacaggtgcccaccaacacgcccagctaatttttgtatttttagtagagacgaggtttcgccatgttggccaggctggtctcgaaccgctgacctcaggtggtccacctgcctctgcctcccagagtgctgggattacaggcatgagccactgtgcccggccaagaaatcacctttcactggaaatttctcttttccagtcaaaaagaaattttatcaacctcaaactagacaattgcaatagcctttcttccgtggcagaatctctgttcattaaagaatagtatgaatggctgttaaacccataaaaatgatttcctcagaattttacctctggaatatgtaatgattaaaaccataaagcctgattctttaacatcctgcgacaactgttaactggattcctttaattttttatttattttttatctttttgagaaaaggtctcattctgtcacccaggctggaatgcagtggtgcaatcatggctcactgcaaactctgcctcccaggctcaagcaatcctcccacctcagcctccccggtagctaggaccacagatgcatgccatcatgcccagctaatagctgattttgttatttttagtagagatgggggcctcacaatattgcccaggctgttctcgaactcctgggctcaagagatccacttgtctctgtcttctaaagtgctgagactacaggtgtgagccactgtgcctggcctattaactgtcagatactataaaacccagaaaaattctcttctaaaacactgagttgaggccttaacatgaatttcactttttgtttctgatttatcagaccttattatatttaatgtacttaacttgtccgaaaaggcaaaagttcctctttggtgcttgtgtgtcattcgaaaaatctcaagagagtcactgtagttttctcatgttccgtgtaagatctcttcttgaaaactcaaacgtatggccaatcacaggttcctttatgaccataattttaaggtgccattctgataactttaggaagcaaaggcatggctttgttactgcagattattttgctgtgtcaacatacaatattcatcttatccatcttggtctacatttcaataggaatagatgggaccatggtaatagagaacagttttgttgttgttgttgttgttggggtccataagggtttttccatttctgtatcttttttttcttgctctctagagatttcatcacattttaaagttttgccaagccaaaaagctacctgaatgtagagcagcattcatcccctcttgcctatttctaagcatttctcagggcttagtcatccatcagaaaaggacctcccttgatgggaaaactccttctcatatctcttctttgaccttcagtttctacctgcaagagagtgaatggcctatttcaaacaccgaaatcaatttgtctttggaaagtcatcttatatacaaatattatccttacctcaaattggggaaaggttaataatttatgcagaaaactaagagaaaggaataggggaggaggaaagatagtttatcaagggcaattgtttcccttttgacttcaaatggttcatcgaggccaagctgatgatttcaattgaaaataaagaagttgtatgaacgaatgccatcatattttttcctcctgagaaaaaccaccatgctgtgctggagattcatggcatatatttgagctctgtgttgtaagaaggaataccctagggcaaatgcgtgctagaggggcttaatacttggcagaatccttctttttcagtagcctgcttttatgactgctccgactgcacctgttaggaagataaataaaggactggccaattctttcctctgaagcgccctaaatatatcactttaaaaagactttggaaaaacaagttgtatccttacttctcacccagtaaatctaaagaaattccctcttgttcccaggcctttcaaacagtgaagtcaggagtaagggagactgtggactggtcaaaggtggaagttagactcactagctggtctaaggaatccaggagggtggaaaacatgaagaacttacaatcctttatgctctcaatgactcactttattttggccatgagacacagccttgaaacttttttttttttttaggctctgtatacacacacaattcatagagtttcctttttaacagcaatttcaaagtatccccgaatcaaacatgaatgttgaagtcaactacccagactgaagttgcttttaaaaaatgcttggacacaaaaacaaataaataagtggtctctttaaaaacttgaataaatacaaaatgacatttttgcaatacttttgtaaacaaatacattcttcttttcaattttgtatggttgtgagaggagattgctgtgtaattattgctattgtttttacagtccaaggaagcatttttgttacttttatttaaaattattgcaattgttttatttaaaaattatttttaggctgtttgtggacacagagaagaattttgattataattaataatgactatttttatcttcactgctccttaattagtctatgaaaactatattaagagacacaaaatactcttggctgccagtatgttctgtggtaattctaaacttcatctctagacatacttaagtgtgttagatgataaagaacaggattaaagttctagcaatcaaacataagtatggaaattttaatttcatgtgtgtacctgagagcatgtggccacatcttctttgttattattccatgttagttcttgatggaaacagatgtcttttctggaatccatggtttgttcaaagtactgcatcctggggaaactgaataaatacacagaaaggtagtagctgaattagtgttctgagttaggttaatcatgaagtagctactgtttattcatgaggggtttcctaaaatttgagagcataccagttaaggaaagccaaactgtgaaaaagaagaaaagactttgtcacttaattttctacatgtatgcaaattatctcataactggataagaagagggcttctgtccttgcagctttttacaaagacagcccccccaaagtcaaagtgatcatactgtcttgtcgtaattctgctctgtgtggataggctcagttttaatttacaaagagtatgtttgttttagacagcccaaagatggaccacaggccaaatttcaagatgttcccattcatgggacagagtatttatgggctttaacgtacattttcagagtaaacttttaggtcccatcagattggggcatgaattgattgatttggcagaggcggagaccagaatcattcaatctcacacttatttctctttctataatgagttcacaaaaagctaactgtaatctgactttcattatgcctttcaagtctaaatccactttgataagacttgcccttttatactcccttaggaatcctttttaggccaatttggcacatcagggcagcgtctaaaattacatttaataatatgtcaaatgttagatcttatgattttgttctattctttttttttgatgtgtatttagctattttggtaagtattcttcttctctaaaattgtccaaatctttcctaaatactctttataaattgctttgcttgcatctggtgatatcgtttgccttctaaaaattttaatgaatcttggaacagaatgctctacttaaaactcaaaatgtgtcctttttaattctacattttgtcatgtttagagttagatgtctttagggttgttatgcacacagtatgtgtcttggctttttctttatgcatcttaaatattatgcattattaaacatggtgacataaaaaaaattatactatttgtagaacattctagacagctcaaattccagctgcaccatagactgaattacttacactttgtatgcctctgtttcctcatctgtatgtgaataaaacagtatcaactctttgggtctcagtaagaattaactgaaatacaccaggtaaagtgcttattttatcttattttattttttatttgagatggagtcttgctctgtcgcccaggtcagagtgcagtggcatgatctcggctcactgcaaccttcacctccctggttcaagcaattctcctacctcagcctcctgagtagctggggttacaggcatgcgccaccacgcccagctaatttttgtatttttttggtagagatagggtttcaacatattggccaggctggtctcaaactcctgacctcaagtgatccacctgcctcggcctcccaaagtgctgggattacaggcatgagccaccatgcccggacaggtaaagtgcttagaacagggcctaacatatggaaagatttcaagcattttcctcctaaagcagtaaactcagaaatcttgtctggcacaaggtattaaatgcctcatatttcacataaactgatggcatttccctcaacataagggatgtaacaaccactgctcacctcctcactagtgtaatatttataatacacgccaagaaagctgctatgatagtcataaccatcattcccaccactatatttccttcttttacttgtggtgatacatcttcgctttcacccatagaagctcagatcaaataaaaggtctatactccatgacctctgttgtgttcttactgaaatgagccatgtccaattcgggggtctgtagttgtcagcataaggtgataacggttgggttgtttcttcactgttcttgtggggacatggcctttcccacttagatgaaagagttaccctacagagttgaacaatatctatgtctgtctccaagggttataagtcttgggtttgtgggactttacaatttctctccctggccaggcgtggtggctcatgcctataatcccagcactttgggaggctgaggtgggaggatcacctgaggtcgggagtttgagaccagcctgaccaacatggaaaaaccccatctctactaaaaatacaaaattagcagggcatggtggcgcatgcctgtaatcccagctactcaggaggctgaggcaggagaatcacttgaacctgggagaacggaggttgtggtgagccaagatcgcgccattgcactccaacctgggcaacaagagtgaaactccgtctcaaaaaaaaaaaaaagaagatttctctctcttatcaggggtgctttttggtggatagggtcttcctcagtctgcgctttcctgagatgaccacataaagaactctccatgaccacatatggatgtggtgggtgattgattgagtgtcactgtgtttattgcggtggaattttatttttatgaccccacctggcgtcaggactcttcttcctctatttttaaaaagtcacccaatgtgaggtccagcaacagtttggagcaaggcctttaagaaatttatcctataaccctatagccacataaataagtgatacaagatcaggtacaatggctcatgcctgtaatcccagcattttgggaggccaaggccagagaattgcttaagcccaggggtttgagaccagcccaagcaacatggtgaaacagcatgaaaaaatacaaaaattatctggatgtggtggtgtacacctgtagtcccagctacttgggaggctgaagcaggagattcacttgagcccaggaggctgcaatgagccatgatcatgccactgcactcctgcctgggtggcagagtgagactctgtctcaaaataataataacaataataactgattcaagatccccaaaaaagacacagtaaaggaggaaactgttaacaattcaaattgcttttgcaataatttctttttgacctatgctaaaattttaagctccttcaatctgagtaaatcttcccctgcaaaacacaccccatttgattctttaaaacatggtaagagtagtgaggaaggcaagtcctcagatcttagcaattttcccccagccccatgttaacaatgagaagctatttgttgctatgtaataaggaccatattttaatcctcttcctgtgtgaaatgacatcctgagatgaaacttgcataattagaaggacaaaagaatgaattgactaggggaggaaaaaaaaccctgtagattcagggaaattccaaaggttgaataatgagtcattgaatatttacatgatcaaggtacaattagacttcatctattcagaacattagagtacagtacagtctttggcaacattcgaccatagtaaataaatatggattaaattgattgaatcattctgaatagctggattctctgcacagctaaaggttaattttgttatataacctcagagccttattttttccaccagtttgaatagaaacattcttaaaatgtaatatattactccttgctttaaaaaataaagtacagtggatataatttgtcttaaattatagatatcagttattagtagcatgtgacaccctgagggcccaaattatttgctcttttgaaaaatggactcatattgatttgtattttgaatttctttccaatttttcttagctttcctactttatccctcctagaagtgtgctgtcttctttagtactcttgtcagtcagcatatgaaactgttcccctcactcccctttgtcctttattatagacgccattccaggtaattaatctggctgagtagagtttagcaccacctaaggcacaacatttaagaaggcactgactttctgggtcaccaaaatgcaggttcagccccttaagtgacctccttaaattttgctcctcaggcaccctgcttacctttcccaagtcccaggccctgggtttactgaggagctagggccttcttccatgaggaaaacacagaaactcttagtgcctggaacgtaggagcttgagataaatgcagaggcccttcagaggcccttttatttgggtggtcagaagctgttaggtaagttgctagatagctgaattctgcatagggtaggtgttactagacactattgcccttttgtctctattatggtgcacttaggaaaatgagttattgcttcaaaatcaatgtaaggtttttattttgactgattcattcattttatcaaagctgcagatgtatatgatatatatgacctgagtttgttttaaaaataacatgcacaaaatctttttccaaagagatttgcaataaattcaaaaccagtggttcaaaccttttggtctcagatccctttgcacccttaacaattattgaataaactaaagatcatttgtttatgtgcataactagtgtattatacacactaactttaatttggaatacagtaaatattgtattagtgtgtcatatatttactgaattaaaaattaaaattggttgggcatggtggctcatgcctataaactcagcactcagggaagcagaggcaggtggatcacctgaggtcaggagtttgagaccagcctggccaacatggtgaaaccttgtctctactaaaaatacaaaaaattagctgagcgtggtggtggacccgtgtaattccagctactcaggaggctgaggcaggagaatctcttgaacctgggaggcagaggttgtactgagccgagatcatgccattgccctccagcctgggcaacaagagcaaaactgtgtctcaaaataaataaataaaagtaaaattgataacgtttaaaatacaagaatacagccaagtgtggtgacttatgcctgtaatccaagcactttggaaggctgaggcgggcagatcacttgagcccaggagttcgagaccagcctgagaaacatggcgaaacttcgtctctactaaaaatacaaaaattagtcaggcatggtacatgcctgtagacccagctactcaggaggctgagctgggaagatcatctgagcctggggagatcgaggctgcagtaagccgagatcacgccactgcactccagcctgggtgacagaatgagacctttcttctcaaaaaagaaacacacacacacacacacacacacacacacacaagaatgcacaaacaattctattagctgtcagaacattgatatcattacacattatgtatcctctggaaaacttcactgtctatttgttagagaatatgagtgaaaaaggcaaataatgtcttagcattactattaggaaaatcattttgacctggtaaactccctacctaggcagctcctgaagatcccagactgtactttgagaaccactaatataaatcaatttagtatttttttttttttttggtatagagacagggtctcactacattgcccggcctggtcttgaactcctgagctcaagcaagccacccaccccagtctcctaaagtgatgggattacaggcttgagccaccatgcccagcctacttcttttaaaagtatgtaattctgttaaatcccaaagtataaaatatccagacccataatgcctataatgaatagagtggggaacaaaataagcaagtaactgtgaaaatgttgaattaaacattgatttttgtccaaattcttcatctctgctacataagcaatttggccaataaaatacactgtcatttatatttgctgattttgggggggtacactgttttttgtttctttgttttgttttgtttgagtctgtcactcaggctggagtgcagtggtgcaatcttgactcactgcaaccttcgcctacccagctcaagcaatcttcccacctcagcctccaaagtagctgggaccacaggcacacatcaccatgcccgactaatttcttgtatttttggtagagatgtggttttgccatgttgcacaggctactcgtgaactcctgagctcaagcgattcgatctgccccccaaagtgctgagatcataggcgagagccactgcgcccggccatggggtacacttatgattaacagaatcaaacatctctaagcattatgaatgtccccatgaaagcaatattttatgctatgggagcttccattgtgctcgtgtctgggcatatgaggtccaggttggagtatgcatattgtgtcagaccccaccatcaagaggggagacacctgatagtgtttattacatatttaatctaaaaagaaagataatttgctataccaccaaaaatgacagtacaagagttggccaggtagacccttccttattcatcatgatgtttactaaacacaaagccttcacatgttctatttcaaagctagaattttactttgagaataagaaacgataatcaggaatagcatacaattttctcttatgcctcaaatttctaaagaatatttttatttttaaaaaattttcccctagaaagtgacagaaagccacaaaaacagaactagaatcataacatttaatgataactgttattgtgtcttcttctgtcttttttatgcctatataatatattcatatgatataattttgctctccatgctataaaaaagctaaattaaatggtatataagggcccataagatagttaagtaggtcaaataatgtaatatttgagacagcccacgggaagaagagaactgggtgttttgttgtgttttgttttgttttatgtgtatagacgcagacatataaaaagagacaggttaattaattttaagacgtaagatttctttttttcccctttaagttactggccatgaaacccttgatcattgaaaatagaaatggactccattggagagggccaagccatttatggagttactgggtccctagtgtttctgcagcagcacaaaggccacatatggggctgtctatttcatagctgccaccagtgcccgtcaattagaatgccttggcacaggctgtgcaggcatgccattggtggcatacctgtgctttttacagtaggtgaccataggaaaaatccaccataaatagatctacccctttgaaagcatttcagtgctgcagagggagagaaagtctgtatatgttcattagaaaggatcaaagaacagccgcccttgcccaggaaagagggggctagctttagttgttggttcacaaactagttcatttttaggttgtcccttaaaatatccccttgggcttatttttttcaaaaagtatccttgtttttcctttttattcaaaaagttttaaaatatgcttctttagtcctgttagcatgttttctaaaaaagatattgtgtgagaggacaaagaaaggagaacaaaaaaccaactgtatttacctagcaagaatgttccacagaactttgccctttggcttttgaataagcagaagtacagcaggacctcacctcaataaatatcggtttgcttgtttatgatttagagagcttgccaaaggtgggtgcctcccgaccattgcaacacagctaaccttgttgacaacagttggtgtgattgactgagtgttatttgctaagaaactggtgggacaggttcctcgacacaagttgctttgccgttttggggagccccgattttaaaagcgggggattccttagaaaggtgaggggtgtaatattcctgagagtcaaaactctagccctaattgctctcctgcccttgttaagaaatggaagacatgtgttgacagtaagaagaaatgtaaatgatggagctgggtgaatgcccctggagccttggccagcgggaggggaaccaatgaaagacatagtgttccttgtgggtaacacagatgaagaaagctgcccacggaatgccaggggacggttatggatttcttggcagcaaggagaagcggcttttgtgcagggaggaacagcctgccagtcaactatatttatggagcacctgctgtgtggaatctgaaaaggagaaggagaagggccttgtcctcaagaagcttgtgatcaaagggagaagaaaagtccccatctactgtaaaccctttagggttcccactcacatttgaaaagggagtggaacgggtgatatttagggggtgtgctgagccttgttactcaaagtgtgggttgtggaccagcagcatcacctgggagccttgtaaaaatgcagaatctttttagttttaaaattaaaaaaaaatttttttctggagatggggtcttgctctgtcaccccagctggagtatagtggtgcaatcttgactcactgcagcctccacctcctgggcttaagtgatcctcccacctcagcctcccaagtcgctgggacttgggaagcaccagctaatgtaaaatgtttttttatgaagacaggatttcattacgttgcccaggtaggtctcaaacacctgggctcaagcgatcctcccaccttgacctcccgagccaccatgcagccttgaaattcagaatcatgaaccctactgctgcagactccaagagtcagaatctgcagtttgatcagatccctaagtgattaatacgcatactgcagtttgagaagttctagaggatttctggaagtagtgagtcttgaatgttttaagagtgcagagtgagttggttcaatgactcaattgatactaaaaggcaattcatttacctgtgaatttcttaaacacaagtatcttatcatattgtaaccacttttataacctctttgaccttgttaaattcataatgggagttcaatgaatttaggttgcaaggatgctcctgcctatggtccctattcagtgaggtacagtggaaattgctgttaatgaatgaatgttacagaggcagccaatgaattttaggaacatgtaaattatttttagagaagcgggcaaagctagccatgacaggacctgtcagagacaaacatatgaattagagcgagagagatgcatgagcagttccttcaaggtaaatggggacaccttgggggctctgagacttacctgcaacacttcattttccatttaagtcatgtgctgcttggcctttaccactccttggtttcccagtttccaggtttaagacaactggaattctctgtttcaaatgctctgaaaaggactaaggtcctattttctctgatcatttctgtctcaccatgattgattaattgaatcgttgattgatctacttatctgcagtgtaaaaactataatgcataaaaattgcatcgagctcaactactattcccactttacagtaggggtatgagggactcacctcttctgtccagtccccagatgcttcctcagtccccatcccaaatgcaaacacgttttaacacatgcagctcacagacctagaaataaggcatatccttagcaggcagcatgtggaggaagacataagtgtcttttcgtaggtgtgtccgagtaaaaatgatgatcataatgataaaagccatgaaaagttaaagtctatgtgacacttgccatgttctctacccctgttaatgcattcattcctgccaataacccctgagttaggctgtgctattatttctctcatacttgaggaaatcgatgtgcaccccactcctacaaatagggagggcaacatccatatgaggttatgtggtcttgagaataagaccaagcaattcagtggggaaaatggtgtaattgcgctgagaagtccaccagtcctcctctgccttgtccaacataggtagcagggaaaggaagtgcaggcccgggctgcagagcccaggctctgagtcaagcaagcctggatcacagcctggttccacactccctaggctgtgggatctcaaagagtctcagttcccacttgcaaaatggagataatcatagtactgatttcacagagttgtaaggattataaggattaatatgcactaggtcctacatgcagtgggttctaataaggggttgcaatgtatttactccttcactggctataaagtaaagaggtttctgtaattttgagaagaaaaagttctggatctgcctatttacaggccggtatacattttcctatttctactccctgcaaccatcccacaacggtcctagcagtcctaatatcctataatgtttctgccattctctctgatagagttggctattcatgaccaatattttgtggattcagtggaagttgaattaagccctttaaattatcattttgatttttggtctgttacatagcccatgggggctacagacaaaatggaaatggagaatgtacatttagggaacatttacagatttagtgcccaagatgattctcttttacgtatttgattagaattcaccattggccttagttggattttaagcaactacagttacccttaaaaaatgggaattggtcacatagatgctaaacaagtatgatcaatttaatagatgtccaaccaccaaaagaagccctccttaattcttttgtatcaattctctatgcatttaatgtgttttcagcaataaaatgagataccagggagataagaaaggaaggaaagatccctggctttgtttagatggggagaaacagaaacataaatatacagagactattagaaaataattaagtcatagtgaaaagagaatgtgttatgatgtagtccagaatgcaaaagaataaggaagaagaacagaatagaataatcagctctggccgggcacagtggctcacgcctgtaatcccagcattttgggaggctgaggcaggtggatcacaaggtcaagagatcgagaccatcctggccaacatggtgaaaccctgtctctactaaaaatacaaaaattagctggacatggtggcatgcacctatagtcccagctactcgggaggctgaggcaggagaattgcttgaacccaggaggtggacgttgcagtgagccaaggtcacgccactgcactccagcctggcgacagagcgagactccatctcaaaaaaaaaagaaaaaaaaaaaagaataatcagctctgagagccttgagaaaaatattggcaataaggataaagattgccaaatgatagtaatggtaacagttcaattatagagctctttctacatagcaggaactaccctatgcatcttacatagaattggcaccctaagaggttatttatcttgttattcttatttcacagatgaagagcccaaggctgttagagattaaggaattgcccatgattgcacaatgaataaggcagagtcaggattcagacctaagtctgactccatcacatgttcagaaaaagcaggaggtctgctgggaagaacagtggcagaaaggtcagaaggggaacagaaatggctctagaacagagaggccactgagacgtagtaagagaagggagagaaagaagtgcccatgaacaacggctttgaatgcgaacctggggagtgtagacctaaccaaataataatagaaatactttcaagtagaataatgggatgaaacacagttgtaggataaataacttctgcagctgtggagaaaggagactggagggatgagaaacttgtctgtagacagagccaggaagaagtccttgggcatggcatggcaatggcccagtctgaaagatagcgtgtcaaagaaattggcatctcgctctcagtattctgatatccgtgtgctgcaacaacttattcaaagccaagaggacaatattagatttccatttctgcactcagatctctgaaaataaaatgctttgactgacagtttcatgttttggttgacgataaccctagtgattctttccatgatgtagtgaagaaacaaaaacatttctgacaatgccatccaagggacatttgtgttttcactgtatctgcaaattacatcacatcctgccacgttttcttctgtccatctataagtttatgttttttgtcttttggttatatatatccttctccctcactagtaaatagtaataaacttatttatggccatctgaataaaagtttttaaaaaacaataaattggagtttatactagccccaaaatcagtgatggaaaaagacatgattgcatcctggcaggcctgcattactgttttcttgatttctgttacggtgcaatccattcatttttctatgctcattccagccttcctagactagaacggggcatttggcctacacatagtggtgactgttcagccaaactgcttgttatggggcatcgtccgccctgcttaacaagagtcacttgtggaaaaaaatgtggaaaatcccatatgctgacaaaggctcccaggattccacaatgtgcctataatacaaaaactttgttatctttatattttatttagtaatcaagtagaagataattttagaagcgatcaccttcattaactgcctcttcttgtcctggagatgaagcaggtggttcatgagtgagtgatactcacatgtcactaattcccaattctgggcatccacagggatttggcacgggaaatgctatgctctttgttcatgtggatgcctttacctacttggaaatagtatgttctttaacagaagtttctttgtcagacttcatagccagactgctctgtaataaccagacatcgaaagccaggtaaaccaaaaccaaacctcaaaaccagagcctggaaaattttggataggtgtaggtgggaatctactccaagcacgtatgcttccagaaacaactctgagagggcttaattctgtttcccagtgaattgcaccgtccttgtaaaacaacaacaacaaagcactgcaaagccagaggactttcatgtcatctgctttcagaaagtgtctctcatgcaggcagaacaatgttggcgatgcagtggtgctcttgctttctgggaaaaaggggtctcatttctgcaccgaccttaccttagactctacgggatatgctcaccatatgcttgctacccattgtgtttcacttcatcctaacagcagtcctgcccatataagatgcggccatttctctagaggcaggaaaacaggctcagcacaagtaaatgcccggcctgcctctggaggggataactaagtggcaaggacactcggatccccattctacctttatctttccatcactacaccatgccacctcctggaaatctatataccacacataaatggcagcatgtatgtcttgggcctcttgatgcagtagggtgtgtgtgtgtgtgtgagagagagagagagagagagaagagagaatgtgtttccctcctccatccctcttgtgagtacacacaggtgagatggctgcctgcagcagaagctgcctggggctgtagaaagcagttcttctctgtgataaatgagcctgacatttccatgactctttccatttctagaaaatgaagtgccagccccagccccacccccggaaggtgagtaaaaacactcactcacacacgtttgggctgcaaatacagagggtccatcccagcatgatttggcctccacgggtgctgtgagctgtgagctttaacctaactcctactgagaagttggatggtgaccattgtgataagttgagaataataaaaataatacactgtgtttatataatcctcttgtgttaatctaatttggatggcacttcatatatattagggggacaattcttatgaaacctttcaaattatgtaaaagttattatgtccgcattttacagtgtggaggctgagcctccatccaaggggctgaagaatttgtgaggctttttcctatatagtgaaggtcaaacaaacccacatcttctttatgagagtggggagtggatccatctctaccctggaagatcagctgtcccttctcaacttgacatatgtcactattgagcacctccagaaactccctagcagctatccagaaaggtttggtgacctctgaggttcaacgtgaggaccaacttcttgagttcttagcaccatattgtccaccagctggcaacaggaaatgagtacagagatccagtgagacccttggcaggtagggcagtcccctatgacacacaatatatgaagcttgtttttatgtccacatacacctaaagaagaaaagaaaattaaaagattaaaagattgaaagctcaatgtggcttaaactcccaacatggctcttcagagtcatttatcagccaaatagccccaagatggaagcaaccaaaatcatgtgcattttcccataaagactccaaagtggccttcctcatccctcttcctccttgaaaaggatgagaaactggcatcccactcaataattattcactaggtatttaccctgtgcacaactctgacctaacccttcagagggattcagacatacctatcatgtacgtattgatagctaggtgcaagcatattgtaccagatgtagtggggaactctacatagaaaacatctccctgtattcagtttgtttgcagccaagtagaaaatagaatacagcctgggaaacaattaaataaaatgcagccaaaacattaaaacattaggcaatattataagaaccccccgccccccccccgcccccccacaccaagcagtatgtgattacttgtgagttgcttaaactggcaatgtgttatgaagccagcaggtgactgtagacctggtccagcttaggtgaaagcaggagtttggagaaggtctcagtttctaatcatcttttcacacaaaaacttatgaggcaattataaagctcttcctcttcctccctggagatcgtttttcttttttctttgttttcttttttcttttctttctctttcttgagacagggtcttgctctgttatccaagctggagcgcagtggcaccatcacagctcaccgcagcctcaaactcttgggcgcaagcagagattgtttttcaggagggcagtttgagaaatctagctgctcacaagaggccctttgtccagctaagaatactagattcacacactcaaaccctaaacagtatagagaagtattactatgtgtcgaaatgaacgaaaactggctcagtgccatatgagttcaaacgggaaagctcagatttattttctttagatcttgatcttgaaactagtgtagatgtgtgacattcttcttaggatcttcctgttccttggtatgttttctccttgcccataacaaatgtactttgaccaacattgagtacactgagaacctactggccattataaacaaacctttcccttctgtttttcagatcagttactgccactgagccactatcgtttcctttgtatgtcatatttcatattcattgcacaatattgacttcctgttgctcaaatgtctcctcccaaattctgctaaaattgtccttcttagttaactgagatttgaatctccattcatcagtccgaaaaaagagaatgcattcttgaaacaattcttttcttactgattccataagtcagataccatttgcaggtctaaactaatatgatcccaaacacagagaaatgcaaactagatggtctcaactggtagaatctgatgttactgctcttgttttgcatttattgccactaaacccaatccagaagattcacatggacactgaaacattttctttgaagcaacatacactgcacacaattacatattttgtactttactagaaaatctagaagtccaaactcttggaatcattacatggggcaaactgacttttctttaaaaagtcagtcccttgctgaggtctaaaataaagtggctcacatttgttttgcctaattctactccagcatgttatataacatgatccaagtatagttgagtgcattttaacaaaatctgtattgagtgttcttatgtgtacttttccaaaaatgatcagattaattgcttttcactaaaagtttagtgtggctctaagttataatttctaaattcataattcatgtacagcacgagtattcagtatcatttatgacctgttctgctgtcatttatttcttccctccccctctccaccccgttgctcatcacacaataaaatgctttaaggcactttaaaaaatatgcttgtactttctacacagaaccaagtaaagagaaggaggccggaactacaccagcaaaaggtgagttggagggagggagagtgaggctgaagtcaacaaaattagaagcagaaagaagtcagtaatgattgtcatggtggctccatagaatttctctgcattatctttcgttctgcctttgcatcttatctgcaagtcccaatcagtataatgacaaatggtgcattgctaagtttccattacatgtatttctaaaagaaaaacaacaatgataaaaatatcacaagcacttgttgagatgccagcaaattaattggtagtttccaagtttcgacatgcatgctaagaaagagaggtgtttggtcttcttaggattatatcaattgggaaaattatctgaattacccggtttttttttaaattaaatgttttcatgttattgtgtgaactgttccagggttcactaataattttgaaggctagcatctcactttgtaacactgactatgtattcatgtagatttatataatgatttctacagatacacaatataacattaagaagacatgttgccccttcttgaactggaaactattcctgtaatattatcctatttttactttatatggagatagtctcattttagaaaataatcttaatcatatacttctgttactccatgaaatgctaattcctttgtctcaccatggaagaaatgattatcattactgaccatctgtcttaagctaaggagcattagtctttcatagagggaagtttcatgaaggtggattagacagctttgctgtatatgtttgtattgtcattttaaaagtgaaccttttatttgcataatgaataaaaaagtttaaattttggaataactatttcctgactgcaacaagaagtttctctttttcctggacactgctcaaaaccatgttaagtatctctttgttcttgatgtgtcatatttcattatctaatttctatgatattcttgtgtcctatacattagtaaaatacttttttctttctttcagtagattggattactttccttcagctaacttgaacttatgctctcataatgaacgcataacgttagtatactcactttgtccttgaccttcagtggctcccatggagagtaacatgaatactaatcctggccacgtgggcgcagtttgaaggttatttgcttatggaatgcagacagtgcaaactcctagaactccttccatgggatggtttcaaggaggtttgggcatcctggctgaaattattgtaatattattctctacaaggccaatgggcatacacctctgtttccaaatttggaaaggtgtttgggccaggctgcaaggctcaaccaacagagcagatgatgtaatcccagagggcaagctgtcaaagtttaaacaaagcctgtgcctgacccttaatttgaaaagtcaccatattatacttgtatgcttaaatgagaaaatgtctttccttaaagtcaaccaaccaacaaaaactcttttatttatggagaacacagcgtgatgaaagagcaaggctagatgactagggcattttgaaattagtagcatttttctgacgtttgcagaagataagcaaaaccatgaccacatgcagttgcatgcccaggtacaaaaactgccgtgtgtgtgtgtgtgtgtgtgtgtgtgtgtgtgtgtgtgtctgtatatatattatataatggcaaatacatgtatatatatatgtatttgccttacatacctaggaagcaaatcaatttgggatagaaagtgacatccctaaataaagaaggtaagtgaatggaagtttataataaatatacagtcctcttcatcaaggacagagaaaatacctatgcaaaaagtagacacaataattactgctacttggatatccccagttgagaaaggagccctgcacgagcataaacaggattgatgggtgcaacctaccttttctccagcatgagctagaactctcctgctctccctccctcctccaactgtcagtctattttttttttttaaccatccaactcaggtttcacttctttgaacagctttctcctgaccatcctggcttacttttatctccccttctttctcctgatttctcttggacctgttgcctccatcattcaatcactcttgtctccacataatcgcacattaatggttgactccttttcctaacaggttgtaagctttttgacattggccccctcatcttattccctccagcatctggcagagagctgcacatagcaatcatctaatgaatacttgcaaaatgaatgagcagttgaatttccatgctggcttagctgctgaccattcaatggtaatctggatagatttttatttccattcaacatgtgtgctgggtaggaggatgaacatcctatgtatgttcttagtcactgagggttagaatgagacactgctgcagaacagaaggatgatttccactgtaagaccaacttgcctaaagctactgaaaatggtcttgcctggattttggtacattttcagcactttaactggtcttctatttaattggttgacatatattcaattaattgctccaaatctgtcactattaagaatattattcatcgcaatccagccttaacatcattcccagattgattgaatcattctgcaacagctcagaaatgttctgaaaatgctttttgaagccacagagagtagattctagaagatttaatcttagaagtagtatttgtgattagatttgccaactttttcatatttgctaaaagtctctgtctggaaagcagccaatttcccagcacggggttttatgattgtttgcttgcttgcttgcttgcatctggctatccatccagctatcctgttccttaatactgaccactttgtcctgggacctgggcaaagtcttctggaattgaaacaagagagatgacaataaagaaatgtgtttagcccaacagcaatagcagaaattagatgtgcaaatctcctttagaggaatcataccaggaggcaatgcctttatacaaataacgctgtcctggcttagaattctttcataataattataggtagcaaattgatggaacactaaatatagattcttttctgtatgctcagtggggccaaagattcgccttttattctagcacgtatttattcagcaagatttgctgagtgttggctacatgccaggcacagatctgggcactgggtcctgccctcctggagccaagttacactttatggggaagaacaaccatcaacagaggaaggtggatttcagttttgaaagcagacaagagtcacagagggccatgtgtagggaataacgtgggtgatcaagtgggatcatactttttttttgtcaactaagatccaacatcctatgtctgaacatagggtaattggagtaggtttctgctgtgcctcaacagctggccctgtggaaagttccgaaaatggttctgtggctggtccaaaaagtgacagcagcattagaatcagaggccactttgaagacctgtactcatttccatgcctaagtgctgatattttatttttacatcttattagcttagagtctgtatcttttcaattggtaaagttacttcctttttttattactgcttttggtaatcgtgaaaagggaaataaaaccttattttcttttcccaggcattcaccacataaactatcgtgaatgaaccctgtgtgtattaaatatctcacataacctgagatgaagtctttctttttcatgaatgtgactggcagatgaggaagtgagtcagcagaagttccaacctgaattatgtgattttgttttaaatttaaaaaaatgatttttaaaaaaatttaggttcttttacatctgcaataacattaccctggtgctttttactagcatgctaaaatatttttgtacgatttacctttaggtgtcaatcagccatctactaaaatttctccatgcttaatctatgtattctaattacattacttctttgtaatgaactttgttaaaaattaatgtcaccacacttttcaattcaaagacacagccactattaggcaagattgatttaatagatttgaggaagaaaaattcattaaatgtacatacttattgtaggataaatcatggttttataagcatcaaagtgtgaaggcatgtatcgtctcattaagaaaatgcaataaattaaccgaatgcctcaaaacatgatgaattaatgttagctattgttattgtctcccatattttattgctgttgttattttggtcacaaacaccagtatgtactacaactgattactctgcttgaggaattcatgaatttgtctcagtcaaacaaggtattgtatcagtatttcactgtttgtttacaagtcacatatattttaattttataagcttttggtctttattattaaatctcaacaattgtctcaagtttatattgcttaattaattttaaaaggcaatttaaaatcaaccataggtaggagttgctttatgcccaagagagtttggataattataagaatgtacacattctactatctctggagctttttattcagttacaagtctctcactcatattacgaagtatttatgtgtactcccctaaaaccccaggcttgtaatataagactgggttctttccctactttctagaatttcttctctgggaacttcagttgtttaaagaatcatttttacagtcttacaaatgctattttcccatgacttacagatgaataaaattctgctttagtaaactgcccttctatgtagctagggggaagatagccctgctacgctgagtgtgtggtttccctgtatgtcatattccaacaagctaaaatctgatgtttatgtattcatcatcaccacgtttagatagaaaaaaatgaaatatgacttacatatattttttgttttgtttgaaaatgttgtaagatgctacgtcattcatatatatgttgttgaactggacacaaccagaaagatttggatattcaaattacctcctagcaatagaacctggtttctatgaaaaataagaaccattaaacatttcagtctcatcgaactcaaccaaatcaagccaggcaattttttgagaatttaaggtcagaatcccaatatcttaactacatttcccaatctaaaaaaaagtgccaggactgaagcaacttttaaaagaaaggaaactggctgggtgagatggcttgtgcctgtaatcctagcactttgggaggctgaggcaggaggatcacttgagctcaagagtttgagaccagcctagccaacatggtgaaaccccatctccaataaaaatacaaaaattagccaggcatggtgacaaacacctgtatttccagctactcaggagaccgaggcagaagaattgcttgaacctggaaggcggaggttgcagtgagctgagatggtgccactgcactccagcctgggcgacagagtgagactctgtctaaaaaaaaattaattaataaataaaaataaaagaaaggaaacagtaagctttgctcatgttgattatgttttctagcactttcataaatttgaaaatttatgtgcaatgaatccaagattgccaattgagaagtaattgctatttgacactactgttgggtgatctagacgaagactatttcatgatactctgaagcgctgcattcatatgtattccttcatggtctaaaacaactgtgcatgtcctccaaatagtcttaacatttagtagactttgaaactactcacctatcaaatttttgcttaaaaaacagattgccggccaggtgctgtgcctcctcatgcctgtaatcccagcactttgggaggccaaggcaggaggattgcctgagcccaggagttcaagaccagcctggccaatatggtgaaaccctgtctctactaaaaatacaaaaattagctgggtgtggtggcagacgtctgtagtctcagctactcaggaggttgaggcacaagaattgcttgaaactgggaggtagaggttgcagtgagccgagattgtgccactgcactccagcctgggcgatagagggagactctgtctcaaaaaacaaacaaaaaaacccagactgccatcattacatattctatgcatgtaacaaaccatcacatgtaccccataaatatgtgcaaatattatgatgtatcaatcaattttttaaagacaagattatttttcttcattttagtttcatgaaagtaagtgaatactcttctcattttgtgttctaggtaattaactcaatgtttcattatgctctgtgcacaaacaaaaagtaaaccaccacaaaacctttataaagtattcatttgaatcaaaatggttcaagcgtccagtttatatttaataaagaaagctcctttctaggacttgattgaattttaacttcatttctgttaatttttacaggactttaaatcaacaatcttatatatttcagtaaataaaaacctctgaataggtaacaagaataaagtactaaatactgaattaaatctatggcaagtaatattatgggaaaattgtgagttattttcgttttgaacatgtaaaattttaattatttcacagtcttctgaataacggaattcttctaatagctcagaaatacctataccgggcaaatgcacaatgttgtggaatgtgaatgcatgcatattagttcaggagaaaaaattcaaaatgaactaagtttgggaggtgctaacgaccatatcatttcttgtcacccccacttccagtacacattatttgcacactgagagctttgagatatcctgcagtaaacacataaacacaaaacaataaaatacaagcatttaattccagcctagcatttttcaagcttctttgaccacagagagcttcctgttaagaatctcaaatcccacatgacccagtgaatcacctcttggattctgaagtaatgatattaatatattatattagtaattttattaaaaagtaataacacatatccctgtttgacagtttgggaaaagaaatttcaggccagtgggtaatacttgtagtaaatattctaatagattatataaaaacatactattttatgtctttttgtcaggaatttttaaagcactttttaattaacattcctgggcatgtatttcctgtatcctgcttgtacagtcatatacatttacattttgaaatccacagttattctagtttgcttttgtttttgtttttagagtcagggtcttgctgtgtcatccacgctagagtacagtggcgtgatgatggctcactacagcctccaattcctggactcaagtaactctctagcctcagcctcccaagtggttaagactacagcacacactaccaagtgctcagtgtgcaaataatatacaagcccggctaattaattttttttttttttttttttttttttacggagagagtcttgttatgttgcccaggcaaattcacaaatattctagtattttaagtacgaagattttattattcataaaaacactagtttatgctttgggaagagcagagcagaggttcagataacaacaaatgctctttaaggatgtaaaatgtgaactttgttcacagacctcagtgatgtgagcactgttgcttaggagtaacaagttgctaaaatgcagaagggatgggtagtgtttcttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtcttaaccacactgtaacttatagttcccttaaaaaaaaaaaaaagaataaacctggcagctatagaatataccaggtgcattcataatagctgttttatatattggagtgttaacatttttaaattaaatgttttacattcacaagtgatggggagtcttatcattaaggtgtgtgtaatttagagttcagttggttttattctaactggactgcacttgttttcatagtggtgaaatgctatgcgcatttataccttgcgtaagtcctcattctaccacacgataaataacccgctggctgataatataaacactaactggagagattttatttataagggctctagaataaaatacaagtttttcacaccagcatcatctgttactaatactcttaattagttagtgcagcttttcattttgttgtggttggtctcctgactaggttgagttttcctcctctgctaacaggaaacaataccgacgttctttttcttatagcatttgtattataaaaagcacaaagctccagcccactgaacctctgccaattaagatggtgttgggttaggctgcatctggttactgtcctgggaaaatcactttaatagagatggtcttccaagcagttttaaaatttatccttctgccaggcgcggtggctcacgcctgtaatcccagcactttgggaggccgaggcgggtggatcacaaggtcgagagatcgagaccaccctggccaacatggtgaaaccccgtctctaccaaaaatgcaaaaaaaaattagccaggcatggtggcaggtgcctgtaatcccagctacttgggaggctgaggcaggagaatcgcttgaacccgggaggcggaggttgcggtgagccaagatcacgccattgcactccagcctgggcaaaaagagtgaaactctgtctcaaaaaaaaaaaaaaaaaaaaaaaaaaatttatccttctactgaagtttttaggtcaattaggtaggctgactaaatttacaaatgaacttgtttatccaaaacaaataaataaaatgtgaactttgaagttcagatgttttttaaaagggaaatattctgcacataaacactaaaagacatattttgaatttcacaaatacatatgggtaaatattcagaaatgatacagcattttccaacaccaatataatgttggaaaaaatgcttataaagtttatattaacttatcttgacttttgtttcttaaatactgagagcaattaatcatgaggttttctgggtagaaatgagttctcagatagtacatatataggcttttatgtctgtgtccaaacgaatgtgatatatgaataaggtctgccattcactttagttacaaaatcaggacttgaaaaccacttccattattgatttcatcaaggtttgatttttagcattcattttttcctaacctacagtcacataaaaaatttgcagtgttccatttttaaatctgtgcttccatttggattaccctactctgtcaactttttatttattattttttctttctttgcctgaaaaactcaggtttcacttttcaggtaccaagttttctaaggcttgctcagcagttgaaagtgtattgtgtggtttctcatcttctttttcagatttctcttttctcaggttacttgggatgaagtcttttctccttgactttttactcctatttcttgtttcagatgaagaggaagtctccccgcctagcgccttgcctccaggttgggataatttctacccttttccctgcttttaaatatattattcattgacggtagaggaaaagaaaaggcagtgagcctccttgctgagtcagtgcacagagcaggggcaacagttttcgcctgtgctggcaccaagaaggaaatgttggctttaatgacaattttttgttttacgtgagaaacttcttagaaagaggcattctttgagaaataaataagattggtaaatcttgggtataaatgttaggggtcaacatatctgtcttccatttctcactatatatccacccttttccctgttctttaaatttagatatttggattttaaaatttttcttttcttttttgagactgagtctctctctattgcccaggctggagtgcagtggtgctatctcggctcactgcaacctgtgcctcccaggttcaagtgattctcgtgcctcagcctcctgagtagctgggattacaggtgtgtgccaccaagctgggctaatttttgtatttttagtagagacggagtttcaccatgttggccagactggtctcgaacacctgacctcaagtgatccacccactttggcctcccaaagtgctgggattacaggcatgaaccaccgcccccagctgggattttttaatttttctatcattttaaaataagacacacacttttatagatgctttcatacttggagctctactgattttccatccaagccaacttgtagggttttttccttcctatcaccagaggagacagggtttaggggaatccaagaaggttgaagtcagcactccattttcatcccctttccacccctctgcatcacccaaatcacactttcctttcaggtttgggtagtcgggccctggagagaaaagattcaggtgagcgcaagcccagagaaggcatcctgacctcatcctaatacaatcactaatgagctcatttcttgaagctgtattgattctaatccttgtcttattcagattgtagtttttacggcaatctttcattacgtttcctcttacaagaaaactaatgtattgagaaacaattaattttgcatgatacacacgcattcaaggatctagccaaaaataccacaggtttgttctatcatttttaatatttagcaaatacacagagatcaatcttcattttggggatgtactaaagttagataataattcacatttttatagaactttacatacagataataaaacattttcaaatgcatcctatcagctgtagctcctgttctgtgaagtcattcattcattcattcattcgacaaatttgtactgaggacctaatatgatcctattatgggcctcttatgggccagccactcctataggcactgcaggtatagaagtgaacaaaacaagagaaacacttatcctcatgttctaaatgtgctcctattaatatcataaacacaaacaacaaaattttaacattagcttgggtgtttaaaaatatgtaatcacatgactatgattgtcacataattgtgaaaatgtttaacctcattgtgaaaatgatggcctactactacagatagaaatatcaagcatgattgatacatgaaaactaaaataattaaatgtgcattttccttcttttcaagaaacatcaacaagcagagagttggcaacctatgcatttttttccagttactaaatggctgaacctgaactctgcattcggctcagagacaggggaaatatctacagttctctctactatcctagaattggaattgactgcagattaacacttatcaccagagtgcaaatgagaagatgcaaaagaaactctatttccagcttgtctctctttatgggaaagcctcagtttttttctttccagttctctgtttcgttttgcttttcccccttgcagcacaatctcagtatccttgtaatttgtaccacaggtcatgatctgttacttccttgtcaaactatggccacatctgtacaaccctaataaaactctcttacaaaagcaaggaatctagaaataccaggccaggcttggctttctgacccttgtcagacagtttaccctccaaatgacctatccgtttagtctttttcaatgtagttgtatcgatgtggccttatagtccatcacctagaaaaacaccaagagtactgcttgaatacactggccaccattgtttacctgttaggggacaggcaagatggggaagcaaaggaattattgccatcaaagagagaataacagcttacctggaaagttccactatttctaagaattacataatgttcatttgccccatcatggaagagatacccctgtaagaatgggaatctgttcccctctactgatggctgctgggggcagaaagaatgatgttgtatttatctaggtttattagacaaagaaaagctacagcgttggtgagaacaacaaatccaggtaagactgcctaagaagagcctggccctgaaataatccttttcctcctttctgctcatcagactggacccttgtcgaaactcctcctggggaggaacaagccaagcagaatgccaactcccagctgtccatcttgttcattgaaaaacctcaaggaggaacagtgaaagttggtgagtgcctagcattcaatccttccttttttaaaaaattaaggtgagccgagcacggtgcctcacgcctgtaatcccagcactctgggaggtccagacaggcagatcatttgagctcaggagttcgagaccagcctggccaacatggtgaaacccagtccctactaaaaatacaaaaattagcagggcatggtggcagacacctgtaatctcagctactcaggaggcagaggcaggagaatcgcttgaacccacgaggcggaggttgcagtgaaccgagatcgcgccactgcattccaggttgggcaacagagcaagcctctgtctccaaaaaaaaaaaaattttgaggtgaaattcacttataacattaaccattttaaagtgaacaattcagtggctattagtacgttcgcaatgttgtacagccactacttctatctatttctaaaacattttcatcaccccaaaaagaccctatattccactaagcagttactactcattgacctctcctcctaggccctggcaaccattaatctgctttgtctctctggatttacctattttggatatttcatattaatgggatcagacaatgcaggaccttttgtgtctggcttctttcacttagcataatgtttccaaagttcatccacattgttgcatgtatcagaacttcattcctttttacggctggataatattccactgtgtgtatacactaaatcctgctttttacaacctgaaaagatgagtgacagctatgatttcagtaaccttcagcacataggagtccagtgcctggaccctggaaccttgggttctgatcttgattctgcttcctgctagctattacccttggaaagacagtttaacttctttatgcctcagtttccccatctgtaaaatggtgacaagaataggacctagctgtgaagtattttgaacagtgcctgacacaccataatgctgagccagtgtctgctgacattaccataactcactccataagatgattccaaatctacacatgcgctaggtcataattcataatatctgagacagctgattgggcaaatggttcaactcttcaaatattcaaattcaaaaatattgattatatacctcctgttttaggcactgagtataacatgtgagcactcagaatttatagtctgagaggagcagagaaaaaaataaacaaataatcacaaatgccaagtgctatgaagggatggtgagctggaggaggacctgagggttgaagaattttaaccaaataaatctttataagggatatattatgatctgaactagtctttgacacttatcaatattatgcaaatgagtacatagccaactgtattccagaattacttctttccaggctagaatgtcaaaatacactgcatgtgaacagaaatgttggttccccttatgttcctgtacgacattgaaatgctgggctggaagctggactacaatgtcacgtcctcagggtctaaatcactcaatacaaacagattgcaggtttacttcaagcagatcagtttgatttagtcacattcctataattccaggcttctcatcaccttgcctaataaaaagagtgaaaaaaattcaattttttcatttttatttcatacatatccatatatatgaaataaaattttatacatatccatatatgcaataaaagttcacatatatcatacatatccatatatgtccatatatatgaaataaaaaattacccaaatgtaaaattatccatatataaaaattacttccactggtttccctattactttttctgcttcataaacccccacagcagaacaagctgggacagcctaaggacctctagagcattcataaaaaaatcaggacgaattcatttcacaattccgagggcaccaatcacaccatattctgtagtgcagtcccatgtcaactccttccagttgaaagcaaaacaaatgacgcttgttaaagagcaagctgaatcccttatgcttcttctaggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtaaggccctgaactcccaggacaggcgctcagctagcgcattccttctatgtgaataaatgattattttcaggttcagctttgagagacttcagttccagaaaatcctctgaagttaccattgcagtgtctacactctattgcgattgcccggctgtgtccgggggctacaggacacatttgccctcctatagtgagaacattgtactggaattcccacagacagacacagctttaagccaatgctgagaaatttggaaaataaactgaaatgtgtgtgtctggatgcatttcattgcaggtgtacacatttgagatgcagatcatcaaggccaaagataactttgcaggaaattacagatgcgaggtcacctataaggataagtttgacagctgttcatttgatcttgaagtgcacggtaagagagccttcttgcctagataaatgtaattttttaatggggtgtgaggggatggagaagaagtagttcatttaatactatgagatttcagagaaagttttcctttaaaactgtttctgattgtggtagtctcagcaagcttgctgaattgaattgtaatgaaataatttataataaaagtagaattggggggattttatcgctaaatatctcttgtccatgctatctatattctttcaatctcccagataaaagatgatgtcagtttttgctgctacagaatgtatgtttcaaggggtccactttcccacttaggtttggggatagggtaatatgctatgagagttcaggatacccagatggaagggagaatttctcttataacgactaatgtcaggcatggcagttcttcatccatatgttctgtgcactacccagagtaaacatagaaggcctaaatgcatacgatgaggttggaaaaaaactcgcttttacaagtatacaaaggaaaagttgacttggcagcaaatattataaacttaaggtgaatgtaaagtgtgatgtagttgcaaaagacaaaaaagtgaatgtaattttattttatttgagacagagtctcactctgttgcccaggctagaatctagtggcactgtcttggttcaccacaacttccaactcctgggttcaagcagttctcatgcctcagcctcccaaatagctgggattacaggcgtgtgccaccacacctggctaattttgctggggtatttttagaagagacgggatttcgccatattagccagcctagtctcaaactccaggcctcaagtgatccacctgccttggcctcccaaagggctgggattacaggtgtgagccactgtgcccggccatgaatgtaattttaaactgggctattccaagtgctataggatctaagtttaggaagtgatacttctctctacaacatgctacttattctacatttggagtgatgtctttagccgtggtcactatacctctgcctggacctcttctcgagtagagtaaccaggaagatgaagaatccaaaaaccacaccctatccagcttgagtgtgtgggtgaaggaagtcaggcatacatggcttgttgcaaagaggggaaggggctgtcacacagaaaatggaaaacaaatttccatgcatgagaagcatttaggcagtttagaatcaaaaggtggaaatgatgaggaggtgaattttgtcttaacgttaggatgagctggccaggcacggtggttcacgcctgtaaccctagcactttgggaggccggggcgggcagatcacgaggacagcagtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggctaattttgttcttgtatttttagtagagacggggtttcaccgtgttagccaggctggtcgcgatctcctgatctcgtgatccgcccgcctcggcctcccaaagtgctgggattacaggcgtgagccaccgcgcccggcccctggagggctatttaagaatattgatttctgggtgcccctccctgatctggtggatcaacatctttggcagagaggatcaagaaactgatatatttctaagtccctcagtgattctagtgggcagacaagttgaatgacacctgaacaaggtgaccccaaggtcccttcattggttcttcatgagggaggaggaggtatgatgaggccttggcagcacagccattcaggagaaaagcctccccccttcacctgacattcttccatctaaagaatccccacagcctataaaggaactgaacacaaactacctccttaatgggtatttatgttattgttttctttcctttcaaagaatctactgggactactccaaacattgacatcagatctgctttcaagagaaggtaactccaaaagaaaaatctagatagcttttgtataacacagaagtggaggattttcaaacacatttcctttcccctgtattccgtattccaaatacgaacaacacttttcaccgcaaaaacaccatatatttaaacattggtgttctagaaaaaccatgggtttaaggcccagtcaagcatatactgaccattttttagaatgttcttgttataaagaagttcctgttttggaggtttcacagttgccttagaaagacactttcaatttattcatatgtagcttcctccttaaagcattactttccaccaaatggccaaaagaaatacgcaaagagactcatttcattggttaagtcacggcagaaaacttttatttatattgcctttcatctagaaatcactcagggagctactgaaccatgtgcccaagaaaaccacaaccaagtagctacttactgaagttagtgccatataatattggattatcctaaatgaaactggcattaagaatactacagaaaggcaaaatttagatacctatttcatatatttttgcaattaccaaggctgaaaaatggagggggggcggtcaaggaagaaatgtaaaagatttttggtctctgagaaatataaccagccccttcctgtcattatgttattctctgtacttaattattccataatataaattctttaatgagaccaaatgttttgttcttccgaagactgaatccacatacagaatccacatacagttttgctgaataaggaaagtcactccaaactattataaaacaataatttagcctgttaatgaggcatattttcctctgatattataaataaatcaaaactttaattactttgaaaagttatttaatattactggtattaggtattttttaattttaaaaaatgtcataactttcaaattttattactttccttccactttcccttcatcccatgctcagcaaatgcacaggtctaaaactatgctcatactgtatacaagtatatcttaggagagggaaacatgatctactaagttttgagctttaaaagaacagaaatgtatttacttcaaaaggcctgcaaacacctgaagaaattttgaaaacacattactgagtttaattcttatgacttacatgttatacacactgtttttaaacccacagactcttttcttagaaaccataactaacatttgtaaagagcaggaaacaaaacttccttaaaaaattaaacatgtaagtaactatgtagtgccatttaaatgttagctctgtagcttctggttagagtttatatgaaatcacagtggtggctgcatgcctaatttaagatgcatttctctacaagaaagcacttttttaaactgctagtaaaagtttcattaacaattcaagacaaatttttttaaaacatatttaagaaggtataaatattaataagaaaattagaataattatcaccctttaagacagaaaggaatgcatcttttaaaaatttctgtgttagctccttttttatttttgccatgttagtatcacattatctgattcatctgttcatggacacaaagaggttaccattgaatataaggctttgtacttatatatctgacattggtacacttcgtcctccaagccaatctctgtcttacatgaataacagagatcagcaaaagttctttgctttttacataggtatgtttctacagcccccaacttgcaaaaacaaagtactttgtgttgcttggcttaagtgcatttgtgttacctggttttaacacaaatccaagcagttttatatatgcaatctacaaaaatgtgtcttctgaaatcatagcgtaacacaagctcctcatatgtttacttttccacaagtacatactccaaaaacttaacatgtcacttgtgtgaaaagaaatagtttgtgttgatttagtccttgtgtggcacaaaattgcatatacgttacatgtagagtgtttgggggaaattgttgtgtatgtctctgcattaaacccagatttgcttttcttttgttaacgacagtggagaaggtcaagaggatgcaggagaacttgactttagtggtctcctgaaacgtaggtgagaacaaagtgatggagtgagacattgtggcctggaagtctttcagacacccactcagagaagtcaagtttaaagtggatgttcttcagagaatttttcatttctgaaaatgtgttttgcttatagaatataacagagttgactagaaagagagaaacaactgcatactaatcttttaaagcctttaacagttgcttttaaactttctttttaaatgtttcatgactcttcacctatttttttttaaatggggacgaagagatatgaaaactgagacataagacaaatacctagaaacctctaagactgcacatatgatttggtagaagtctgaaggtatacacattgtaagaggcagacctactttaatgtattatttatgatgtactgtatttctgcaagtctaagacaccactgctattaagatacaccagcactttataaatcactaagcaatgaaaaaattgttccaaatggtttgacacaccattgattataagatgcattgtcatttcagaggtctttaaaatgcctcaaaaatgtgttttagaagtgacaaaatggaaataaaagtttagtatcatcacacactgacacttttcattgttctctcctgcaataaaatttataggatttcattatggatacttagaacataaccattttataagatttctctccatatatatttctataactgctatactcttcactaggattccctatatatatactatattatatgcctgttatagatatctagatatttactatagtgcagaagcaacaaaaagaaacactttttttctgagattatgttttatctagcaaatttgtaaataaacagagtaaaactataattttaaattaattgtatataatatcagttttcatttaactttccaggcttttaaaattacttttagtgctttctatggttattaaaagactacaagtacaaatatgcttcataacaaattacaaacacttgaaatatactgggattgtgtttattctctgtttagttagatagctgtattgaagtctctgtaaatgaaaaatttacccctatccctcaacatgtaggttgagaacagaaatattaatgggtgtgatttattaattcctgagggctattagcccatcaatagactacttcaaataaccattagtctcaatagtattgattaattccccaaatgcatttaaagcaatagtatatgaagtgcccttaagtgagcctcacgtttcctcattctacagataagaaaccaaggtacagagacaacaagtgacttatcccaagtcacacaggagttagaggcagggccaggacccaaacccaagtttcccttttatgagtcagctcatttcctgtgactccatattaaagataccactctgaatttgccttggaagctggcgcttcagtttataacacaaattgacactttaggaagacaagagagctttgtattctccctgcaatcatttactcagtcaggaaaatactaaacactgtctttgcgtagaatataatgctactgatgtgaggaaaagaaatccagtgcctggcacatagaaaaggatagatacacttttgtgggaggaaaaatagtggtaaaaacatggactggagtctcagctctaccatttactaattatgtgactttggtcaaatatttgacccctctgagacttggatttcacatctggaaatgtgaagaataaacactacttaatagaattattgtgcaaattaaattaagtgtaaaaagcttggttcacagtaggtggcaaataaatatgtacttcctctaaggaaatgtgtcattttctctaacatagtttatattcataaggagacaacacacaaacacatacacaatcaatcaacaaaaatgtgatacagtagattattaagcaccttgctctgattaaaaaggaaaaaaagaaagaaaaaagaacagactttttcaaccagtaattccagaataaaataaatctaattacatagtcaaaatgacaaaatttaaaaatcacttaatgggcagccaacatgtctccagttctcattttcttttatcccctgcttaagatttgcattcataattagattgttgttaatataaggctatgttatgttcatttagtatactatactaatccactaatataactttagaaatcattgtgttttcctactagtgagttgcatgcgttttcattgcggtaatgacatatggttaccatttctactcctccaagtgtgtgtgccaaaatccccacaagaaaaaaaaatatgattaaaaccaacatctctgtacaacgaaagatcttcctgctctgaacaaagccagcttacttcaaatagacattagctaaatcagattaaatcttttgggcagcatcctgttataggaattgacctgtataaatacttgtaagttgtactctacataaaatttctataactgttatactcttcactaggatcaccaagttattgaaattttgatgtagatgaaaatacagtgagtattatacaggtctatcccgaggcttggaaaagaatcagaagtgcctacagaaatttggctttttctcctcactgtaacttaacatagccatgcagacagggtcatgtgcagccaccatggtaagtaactaaagatatgttccaggtgcattaaggaaatgctggaggtgagagccttgacctcacatttcagtacaagatagatgcttctctttacgatttgagatacaattaagtaatggagagaaaaggaaggaataggcaagaggtcattggtgttcttatatgaaatttgatatgactaagtatgtgataagagtggagagtatcttggcattttaatgaaaactggtgaggatgattggttttataaatctaccaacaaaactgactcaggaaatcacactcaaaattatcatctttattactggtttccttcatataaatattcacctcatggatctatgtaggactcagtgacttgtgcctcttgttagctattttaattatatctagcttgatagctttaaatcctccgccaatgtcaggaggatagctgaaatatgtaatgtatgtgtgcaattcttcatggttcaaatacaaatttaacataatccagtatggcataattttatagtctggggactatatttaggctggaatgtgacaaaaatagagcactaataatctagattgagggaacaccccgcagaaaatatatacatatgaacatacatatacatcttttttgggtttttctttgagacagggcctcactttgtcacccaggctggagtacaatggcgcaatcttggctcattgcagcctcgacctcctgggctcaagcaatccttccacttcagcccaagtagctgggatgacaggcatgcgccaccatgcccagctaatttttgtattttttgtagagacggggtttcaccatgttgcccaggctggtctcgaactcctgagcccaagtaatcttcccacctcagcctcctaaagtgctgggattacaagactgagccacttcacccggcctatacatatacatcataattgtgactctcctagacttcctactaaaatatttaaaggatgtatttgaagtgtttactgtttccaggaagtagatttagtggatctggcaaattattaccaatattccaatttcaggacaattttcttaagcttttcgattttctcatgttaataaaggatgtagctgttatttcagtgagatgaagataatgcttgtgtcttgagtttttaagaggcacattttgctaatggtgttgtctagtccttcccatcaagattattggagagaccagtgacctttcacttccttctattttccaggagttctgcctcaatgtcccccaaacccactgggcaaaaagacttacatggcaatgtaaaatggaagttagatattcagatgtcatccttgcctaatgccaccctaaactctatattaatatctataatctcctcccctcccctgcatattttatccatgattacaacccagtatttccttctcaaagtacacatgagtgtaaagatgacactccaggctggtgtggtggccagcactttgggatgccgaggtggacggatcacttgaggtcaggagttcaagaccagcctggccaacatggtgaaatcccatctctactaaaaatacaaaaattagctgggtgtggcacacacctgtaatcccagctacttgggagactgaggcaggagaatcgttagaacccaagaggcagagattgcagtgagctgagatcacaccacttcactccaacctgggcaacagagtgagactctgtctcaaagaaaaaaaaaaaaaaaaaaagaaggcactctgaaacaggtgtaatgaatatgacaatgcaaacagatgtaacccatcattccctaacatgatagcatgaattcattttcacactgatatataagatgtttgaccagttttccagaaaatcatatccaaatcagcattacggtaagcagtcgttgtaacatttctaaattaacctgataaaaatagtcatgtaaatgtaaacaaaatcaggattatttattcaatgaaggaaaccaatttgtttatactaagcctgttttccaaaagagtgtttatttctgaattttatttttattttatgcttttaaaagaaaggaagacaagtgtaaatcttaaatcttacttaaatcttaaatcttatttttaacacatatatgttctttatgtgttctgtagtcaatgatcaaaagttggggtcataattttggtatgcaccctaagaagttactttcccttgttcatggtgccctaaaccatttgcttcacagtttaacatttgtatttttataactcatacccaatttgcttccaaaaaacattcaagacagtactttaagatgaaatgtaagaaaatttttaaaacctagtctcctttccccctgccgatttagaaaaaaaattttaaaaccatcagtatccataaaaaccatgtgaaaaacaaacaaaaaactcatggcagtttcaattttttttttttattttaagaaaggtaaaaaatggttcatgtacttagttactaatatggtagggaaaatgctatttgcaaaatccaaatgtttgaaataatgtatttgtactgtctccatatttagctagggtgtgtacatcaaagaaaatagagatcatttttatttcataggccaaatctaaaccttttagttctagtccaattttcaataattcaatatccatatcctagatgaaaactgttaagtttctcaaaatcccatcttctaattagactttaaatttgaaaataagtaaaatatatttttaggctatttcctgatgtcctctactccccctaaaattgtttttattaactaggaaaacgaaaggtgttactataagggcacacatttgatcttctactacctgcaagtttccctaagacttccattccagcaagcaagacttgacttctgggcttcaagtactcaggctttaaacagagcttttttacactgaactgaaaaagcagaattatacctcgaccttcgtggtctctaagggtcagtgcagctactaaactagaccatggttctccccggttagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcaggtgagcgctcccgggggcgaggcagcggccgaggggcgtggcagcgttcgaaagccttgaccgtgaaccccatcccgagctccttccagtctcccgcggggttgggagtggggctgggtaggagtgcaggggttacgcttgtctagacggacagctcctgaaggttcaaggtaacaggagattcatggtccacatacaacgtagaatggaatagtacattacccccgcggttactgggaatttctcagccgccccctttctccagcctccacatccccactcactgtcaaattattgatttttacttaagcagagtggactctttcaccatccttttctttcacccacttgatggcgtgtggagagttcactttctcacacccaatatggttagcaaaatgttttgtaaaaccaataagcagctccgtgggggtctgaaatgggtccagtttattgtggtctgaaatacctttttaaagtggaaagaaaaaaaggagagaaaggaatacattttacgctgaccattagctcttcgaagcttcctatactcggtcattattggttatgggttttatgacacatcaggttagtaatatatcaatcctattattgtttattattttgttaatgttccaatagaatttaaagatttttaccaccctttaaaaaaaatctgacctttatttctgaacttcctggaaactggttgagaaatggccccagagaaatgtagtagggttttttttagtttatgtagttcagccattcccactatcccagaactcctgaagttatatttttgagaggtgtattaatactacaggggagagccagctgacatctcttttccccaagctgaactttgttattgttatcacttagctctgaattcatctcctaaggtgtgtggtagatggcttttttaaaagctagggtttattttatcttgttaaaatatgagacagtgagcttacctaaacaatagtataataaggttggaatgatggaaatacaagcatgacaacatgaagcatttcacatttgtattttccaaactgctaaatgagaattattatcttttaaaaagcaggaaaaaaacttattaaattaaaaaaagaagttaactatctttatttaggacccttcaaagacaactttttttttaattgctgtgttctatgttatttaaaatatttggaaatcctgaattcctaaacgtatgtgcaaggggtgtttttaaaatgccactgtttgggcaagttaccacagtataaaaactttagtaagcctactgtttcaattagtcaaaggcattcgatttaatatgaatcactgaatttatcttataaattctgtggttaaaaaaccatctgtgacttagaaggagtgcagaaataaggccaatgacactaacagtaattctgctggaagaataagcatgttcttttatttttatttttattttttgaaacagggtcccattctgtcacccaggctggagtgtgcagtggcatgatctcagctcactgcaacctctgcctcccaggttcaagtgactctcatgcctcagcctcccgagtagctgggattacaggcatgcaccaccacaccccactaatttttgtatttttagaagagacagggtttccccatgttggccaggccggtttcgatctcctggcctcaagtgatctgcctgcctcagcctcccaaagtgctgggattacaggagtgagccaccgtgcccagccccagcgtgtttttaaagttcactttcatctgaacgctttatagtgtacattccctgaagaattaggtcatttttaaagcttcttcaatgattcttttcttacctttcttctagaaacatgtggattctcttttcaatttaaaccatcttattgtatataagtcaacacagtgttcgaaatataaaggataatttggaaggtttctgatttttttcttgagattcattttttcatttgcttttaggttctcctacatgtattgactatttaaattcatagcatatgtatacatatattaacatacttttgcttcttctattctatcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaagtaagtgggctttgcaaaaatcagtgatagctctacagtaaattaatcaaatagtagttcgactgacttttctgagaataaaaggatatttatattttcataatacaaaatcatatggagagagagtaaacatttaagtcacattttatttattagggaaacatgatagttctatataaactaaacctttttttatgtttaattctaaaaaactatttaaagtgttttccaattatggttttgtgtcgctataggttatatgtgattatttcagagtattgccaaatttctcccaattttaaaaaataaaattgaaaaataacttgcaatccatatttgatatgccacctgggaatcccatcttataattagatgacttttgcttttccaaaataacgactatatttcataatgggtgaataccttctattttcaattcaggtactgttttgagcacttgcaatattgcatataaaaggaactctttaatgttgagataaaacaaaatgtgggtcaaagcctgtgttttattatttattggccttctcacagatggagacggactaaagacagactaatccctgacgtctgatggtatctccagtctattataaaactactttacagagatcctcctcagcctgagagattttcaactccaatatatttttttaggttaacaggagccatgtgtacatttataaaagatgttaatcctggaaagctgttacttgtggagtacaattaggtggtttccaatttcttaatgtggtcatgccactagagtgactttgtgatgataacattaatatctggtgtaaaaatctcttgaagatggcctgaatttaccaaaaacataattttaattggttatctttatgtagaaaatatttttaaatatcttgttcttgaaggcttcaatctgagaaattcccaaaacagtgtttttagtctattttaatcccatcatgtgctcctccataatacagatcacagataattatattttacaatcttcttggcttctagtttttcgtttctaaatactcacattctttcttagtacatgtaactgtatgatagcaccagttcttgagctcatttaagagaacatcacattctatagaactgctgcgtgtgtttgtggttatatcacattatttcttaaattgtataatcatttattcacccaaggaaatctactataccactgggataggtaatgaatagatcttattcatacatcaatggataagatcaagtctctacccacctataaagtacatgaattggttagttaaagaatgtacagagttaaaaatctgacaccctcagccaactctatcttccaacagtgggttaaaaaaattaaatagcaaatatgtgagtactgatttttatttgaaataaaaaccttatgtaaaagaaaattataatggaaattaaatagtatatataaatatgcttatacattaagtattataaagataaaaattggtttttttttttggtttgacgttaaactgtgtaagatatgatacctaaagagcagatcaaaattatatccctgctgggcacgatggctcacgcctgtaatcccaacactttgggaggctgaggcaggaacgcttgaaccgaggagtctgagacaaacctgggcaagatggtgagactcagtcttacaaaaaataaattagctgggcctgatgccccacacctgtggtcccggccacacgggaggctgaggcaggaggatcacttgagcccaggaggtcgaggctccaattagctatgtttgcaccactgcactcctgcctgtgcaacagagcaagaccctgtctcaaaaaaaaacaacagatccttgactttcaaacactaccaaattataagccaaatttgctggcaataaagaaaagaataaaatcacattcacagactctgtttattttcatcctattcaaaacagatacatctttgaacacaaaggatgccagagaatcctgtttatcaataactgtcagatgacagatgattcagagtattatgtgacagccggtgatgagaaatgttccactgagctcttcgtaagaggtaaaaatgaaatctcttattgtggtcaccaggagctgttggcttcttctcccagggataatgatcaaagtgaaagtaactgaggctcctctacactggcagctattatggatcctaatgagtcttctggtttgttgaagactagaacagcagaggggagaaagagaacctgttgagtacaaatgcctcatgttttgactcaagccaagcactatcttgcaaaaataattattctagttatagctttgaaacccaacagattttactggataatccttgtttcacacactcaattgatcacaaataggtttctcttgaaaccagcttcattaataagtggttggtaccaagcacactgaaaattatcatttactaagacattgtgaaaagagctggagggtgtgaatacagccatgtcttccttattttctttatgagggcttctgatgacagacaaccctgagatctctgtcatccatctggaactaggatcaaagatttgagttttatatattctccttcatcagaaatgtctagcatttagtatcttctttgctaaaagaataatatttgatatatgttttgtttgttcttgagaacaataattgatttgacttggagaactgtgaaaaaattgggagaatttacccagggttgcctgctatttattttgccaagaacagacatagaaaacaaaacaaaacaaaacaaaactcacagacagccacagtggctcatgtctataataccagcactttgggaggccaaggcacgtgatcacttgagatcaggagttcaagaccagcctggccaatgtggtaaaatctcgtctctactgcaaatgcaaaaattagttgggtgtagtggcatgcacctgtaatcccagctactcaggaggctgaggcaggagaattgcttgaacctagggggtggaggttacattaagccaagatcacgccactacacctcagcctggacagcagagtgagactctgtctcaaaacaagaacaaaaacaaaaacctcacttactgttatcaccatgtcaaccatagatgttgctttctcactgttggtttttcatctgtgaagaaatcagggctcatgggataggctttggatatttaatgattctgatttcccctttttgtatactagagcctccaattatggtgaccaaacagctggaagatacaactgcttattgtggggagagagtggaattagaatgtgaggtgtctgaagatgatgccaatgtaaaatggtaaatagccttaatgaagtctgtccatgtttaatagacaaaaaaattggaccttcatagttgatagaacaggaagtacaaatagcttttaaacctttgaaaacaatctccacctcatttgtgttagtagagatgataaataaaagtatactaatatactggggtttttccactcatgagactgaaaaaagaaccagagatctatgtgggtaagcacgtagggaagtgggtacttaatactaagtggatgactcaagtttacccaagtctatttgaccccaaagcctatggatgctcttaacctttatagcaggcttcctctcactatgccatattggcaacttacatgaaaaaacatatttagtgtttagtaagtttagtaagacttctttagatgtcttctaagtgggcttactaatgatagttgtgttaattcggttttagaaaagtttctatttgatttctatttgcaatgatttttaagtacatatttacatgtgtttttcatgtaacccctagtcactttattttcatagtacctcaggggaaaaaaatttagactgagaatcaccaattgcttttagaaataagagtttatttgttttgctcaggtggggaatgttttctcaggttccttgtgagtaatcttaaaattaaaaactagaaattttaaatcttaaaatgaaatgttatgttgaaaggtacagtaaattacacagcaggatttgtagtaattggtacagtgtagattgttcattctaatagagaatcatagttatctttaaaatgcattaaatgatattcttactaatgtgcttcaagagcctacatgggggtaatatccactcttagcagttgcacctgattcatcttgagtgcgagcaggtggctcgtgttcttttaacacaattttgtagacaatatttgttacattatgaatctactgatggatacagagattgattcgtacattttttaattcaacaaatagttcttgtgtgtctcatatcctccagaaattcttcaggatattgcaataagcaagatggacaaggtatttttcctgaaggatcttttacaaacctttttaatattttatcttaattcaggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgactgtaagtgagacttctttagatgtcttctcagtgggcttattaatgatggttgtgttaattcggtttcagaaaagtttctatttgatttctatttgcgatgatttttaagtatgtaaaatggatttcattccagctaagtgtctatgtcagatcaatcaggatatttaaggaaggaaccacgactcaatttaatagtagagcgccaatattaggaaggaagtataaaaatcacctgccagaagagttataattccaagaccgtaaaaataggggataaatacttagatacgatgtcatatcctgataatgttagctagctattcatcaaataaccattcaacactctgcaattacatttggcatgagaagaaagtaattcaaaccaaaagggctcaattgagaagattgtaagagctaatttgctagtaggcttcagaggcatgagagaattaatgtacttccctcaatgccctctacttctagtcagttagcaatggcagaatctctcccaatttgccataaaaattaaaacagcaaatatctcaagatgatgtcacaaaaagagcagaaatcttacttccacatttattgcttagtccagttgcagttcatataatcattgaattattcaggatcaatcccaatacattccttatgctttatggatctgtggccattttagtttaacatcaagaagtctttcagccatagacagatccttatctgatatttgtatccatttaaagcaattataatccattctgctatgatgtaacatgtgcatttctaaaaataattatgctatgcaaagtcatgcagtaaaaaccatagggtttgtaggggaaatgggattatgggtatgacactcaagaattttgctggtttattagtccgttctcatgctgctaataaagacatacccaagactgggtaatctataaaggaaaaagcttcagttgactcacagttccgcatggctggggagacctcaggaaacttacaatcatggcagaagggaaagcaaatatgtccttcttcacatggtggcagcaaggagaagtaccaagcaaaatggcaaaagtcccttataaaactgtcagatctcatgagaactcagtcactatcatgagaacagcagcaggggggtaaccgcccccatgattcaattacctcccaccacgtccctcccatgacatgtgaggattataggaactacaattcaagatgagatttaggtgagggcacagccaaaccacatcagtcagcgacatattttttaaaatataagaacccagtaaaaagtagtagcacagttttacacatgctaaatggttaataaatataataaatatggcacttaatgttgaaaaagacctgagatttgcttacagaattaatgctggaagtgttgtggcttgtgaactgttgtgaagcagtagaaagaggattattcaaaatctgatgagtagttgtgacctcagatgtaaatgggtgtggcttatatcacatggatgaactgaggtagctgatagatgtttgaggtgtgagtctgcagattttgtgcattccttgctgggtcatttcagctggatgcaattttctgcattcacctagtttttctaaggaatgaaattgtacagaatcaaatgtgaaattatcctctaatatattaattgcattggtacagcttctcactttcaaaacaaacattgtagtagagctcactataccattgtgaaatgccaccatcttggcctgttgggagtttgggcttggcatttgtgatggtctatcatttctacagtgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggtaagcgagccaggtgacccgcaagtgaggtttggtcccatttctactttctccattttctaaattacatatttggtgaggatatttgaagggtagccatagggagatcatctattcctgattcttcgcttccaactagcaagaaggtgtgatttctctgttgtatagcatgtcctactcataatcctgtatctgtacctcacactatggtactttgtctattcaaaatccattgactctttttccatttaaacatgaagttagaggccaggcaccatggctcatgcctgtaatcccaacactttgggacgccaaggcagacggatcaattgagctcaggagttcaagagctcctgggctacatggcaaaacctcatctctacaaaaaacacaaaaattagccaggcgtggtggcatgcacctgtaatcccaactacttgggaggtgggaggatggcttgaacccagtagggggaggttgaagtgagctgagatcacaccactgcatttcagcctgggaaacagaatgagagaccttgtctctaaaataaataataaacatgaagttagaggaaaaatactgaattctaattgaggacctgatcaaatggattaaccgtctctaaccaataagtgtcacaatgccttcccacaaatctttatttgcgtaggggacataatatcctagaatctggcaaagatctaaggcaagagtttaactttgaattcatgggcttttagggtatcataaatgaactttaggaagccccataactcctgtgaaattgtgagaaaattctatgtgtacaaaaatacatactgtttacacagaaaggattcatagtgtccatcagatattcactagtttgtgaccccaataaagttaagagctattgttcttagggtttgggatgtaaagccaaaatcaagattattcttggcatctcttgaatcttaaagtatagcattattgatatgttctattttagcctttttaaagttatgagatgaaaaaaaagaataatagactctgcatatacaataagcagattctatttgtggagataattccatatagtccaaaataaagatttaatttgaatcaataagtaggataattaaggcttctcatcctctctctctctctctctctttctctctctctctccctctctttcctgcactaaagaagttaatcagataaaggtcaagtgtcttttcagtttgggtcatatataaactagatctttggagtcttagaaatacattttccttgtttccttaggatccacaagttagtgatagccaatgccctcactgaagatgaaggtgattatgtatttgcacctgatgcctacaatgttactctgcctgccaaagttcatgttattggtgagtagataaaataattcattgcatagttgcgttcttttttgtttgcttttgcttaccatggaattataatatattcaaaactaagtgacatttaaggaaaaatacatcaattggtattaatcaccaatcagaaagattggtgacttataccaacaccttacaataaaatggttttgcaaggtgccaggcaccaactatcttgactcctcttatattctttttgattagataaaatattggttactaccatcatactagccaaacattagtgcagatatttacacagaaatgactgtctgataacaaagactatgcttaatattctagatcctcctaagatcatcctggatggtcttgatgctgacaacacagtgacagtgattgcaggaaacaagcttcgtcttgagatccccatcagcggagaaccacctcctaaagccatgtggagccggggagataaggtttgttttatgcttgcacacactcacatgcacacacacatatgcagacacactgcctaccccaccccttgccctccattattcagatgaaggtagaaaacaaataaatgtacagcagtacagtaaagatgtaattcctttgaaaaagaaagatgactgattttcaggcaaatctgatcatcattaatttacttctcatatttctgactattatgtagcaaagcatgttttgatgcacagtgaaaaaagcctcatttttattctaatgaaattggggggatgaaaaagaaaatgaattattaaataaataaatgaacaaagtcactttggatagtaataagtacaagaagataataaaagagaatgatacaatagcaagtaactgcatagtcaatggcagcctctgtgaagaacaaggaacccattatgtgaagatcaaacagaagacatttccatacggaggcaattacaagtgcaaaggccaaggggagagaataagcctgatgtgttggaggaacagaaggaaagccagcatggctggggcaaagtgaatgattgggagaaatgcaagtgagggtgaaatggtagagtagtgccagctcaagtgtgactccgtggctttctacaaaaataaaagcaaaaaaaaaaaattacatttaaaaagaagacatgaggctgggcatggtggctcatgcctgtaatcccagcactttgggagctggggcaggcagaacacctgaagccaggagttccagaccagcctgagcctgcatggagaaaccccatctctactaaaaatacaaaaaaattagccaaatatggtggcagcatgcctctaattccagctactcaggaggctgaggcacaagaatcgctggaacccgggaggcagaggttgcagtgagccaagatcacgccactgcactccagctgggtgacagagtgagactctatctcaaaacaaatttttttaatgttaaaaataaaattaaataataaaaagcagaatgagacttctactttcaaccagaattgaataacaggaaccagatttacctactcacttgaaataacccccaaaatagacaaaatatgtgaacaatgggtttcaagacattggacatcagatcgtgaaagacaatgactatgaaatatgataaacaaatgaaataagccctataattgcctcaagcttattgccataaaagagtatccaggcagtggcacaaggaagaaaaacctggacagaacccagtggactccctaagtttaggactcccattgtacaaggagaccaaggcagctagagttcataggatacatactatacatactggaggagagagctgcacagagagtccccctggagctctgcagaggaacacgctcaagtattcagcaaagatcagtgcacatttatgaggaaactacccaagattcaagaaaggaacatatgaaaggattaaagagaagtggactggcactcacacaaggccaatagtagtgcctgttccccctagctagacatgaaaacctcatcattcacagtgcattgagtagagtactcaggaaagccttgccttggttgcaggaataattaaccctagactgagcactgtcatggacccacctaataagtcataaaaacaagtctaaaagattcaatcaatttccaaataatttaattgcatttcaaaacaaagctcaagatttatataggaatacaaaaatatcaagcacccaacatgacaaaattagcaatatcctgccatccagtcaaacattatggtagagaaataagcaggaaaacacagctcaaaatgaggagaaaagtcagttacagccaattcagatctcacatgtaaattagattagcagtcgagcatatgaaaatagttattttaactgtattccatatgttcaaaaagttaggtggagaaatgttaagctctccatttaaattaaatttaagagaaatttaataaaataaaataaaaattaagagaaagttaagtgaaaaaagtgaactgaaatggaaaatataaaaagatccaaatctaatcacctacagatgaaagcaataaaatgtctcagataaaaaatatgtagatggaattaatagctaattagacattgaaggcaaatttgaagacatagcaatagaaatgatccaaaatgaaacacaagagaaaaagtccaaaaaaatttaaagaatcagttagacttcaaattttcattcgggcatgtaatcagcttagaagttgccactctatcctaacaagtaaaaagctggacaaacggaaaaactagcaactcctcttacatatgtcagagaagtgaggatacagggcaaactgccaaaatgtgagagtggagtgacacattgaaagtgttcagggtgaaaacccaccaacctagaattctgtaccctctgaaattatctttcaaaagtgaaggagaaataaagactttctcagacaaacaaaactttagggaatttgttgccaatggatctgtcttgcaaaaaaatattaaaagatgttcttcagaaaaaggaaaataatataggtcagaaactcagatctacataaagaaagaaagagtataaaataaagaataagtgaaggtaaaataaactttttcatttttcctattctcagttgatctaacaaataatactttgttcaaaatgataaaagcaacaatgtattcaattaggtatgcttatatagttatatttatgtattttatatataagtgaaatgaatgacagcaataatacaaaaaatgggagaaaggaattagggacatttcattattttaaagtacatgcactacttgtgaaccactgtagtgttgtttgaaagtggagttgggttaattgtaaatatatattgtaaactagggaaaccactttaaaaagtttaaaaaagaggaagtaaaattaatatgctaataaaggagagaaaatgaaatcacatagaatgcttaattaaaaccacaaaaggcagaaaaaaatgtagaagacaataataggaacaaagaagaagggcaaccaatagaaaataataacaaatatgacagatattgatcgagctataccaatatttactttaaatgtcaatggtccaaatatacaaattagaagcccaaaattgtcagagtagagcgaaaacatgacccaaagatatgttgactataagaaacccagtttaaatataaagttgcatccattaaagtatagggagagagagagacatgctgtgctaagactaaacaaaagaaagtatgagtaaccatattagcttcagacaatgcagactacaaagcgaagaaatttatctggaatagaaatgagcgttacataatgatgaatgggtcaatactccaagaaagcctaataatccttaacatgtatacacctaacaacagagcctcaaaatatatgagacaaaaactgatagaacggcaatgaaaaatagatgcattcactattatagttggagattttgacatccctctatcagaaatgggcagattcagcagacagaaaatcagtaaggacacagctgaactcaacagcactatcaatcaattgtatataaataacatctatagattacttcatccaatagcagcagattacacattcttttcaagcacacatagcatattcaccaaaatagaacacattctaggccataaaaacaccttaacaaatttttaaaaatagaagtcatataatatctgctctcagggacaatggaattaaactaaaaataaataaattacagaagtgaaactaaaaatcaatacataacagaaaaatagctgaaaatccctcaaattcctgaagattaaacaacacacttcaaagatgaaatcttaaaagaaaatttaaaatatattgaattaaatgaaaatacaacatatcaaaatgtttaagttgcagcaaaagcagtgcttaaagggaaattaatggcaatgattgcatatatttaaaaataagaaagacctaaaaccagtaatcaaagtttacgtgttagaaaacaagagaaagaagagtaaattaaattcaaagtaagcagataaaagacatgatacaaattagtgcagaaataaatgaaattgaaaactggaaattaatagagaaattaacaaaagctggttctttgtaaatatcaataaaacgtataaccctctagccgggctaagtaggataagaagagtcaaggctaattaacagaaatgaaagagggacattactacaaatcccatggacattaaaaggatagttaaggaatattatgaacaactctatgcccataaatttcacaacctagttgaaatggaccaactccttgaaagatacaatcttctaaaactcacacaagaagaaataggcaatcagaaaaggattatctctattaaacaaattgaatcaataattaataaccttacaaaacagaaagcaacaggccccaatgggtttgttggtaaattctaccaaacatttaaggaagaaattgtgccttaatctctttcagaatgcttcctaattcaatctatgaggtcagttttatcctaatatcaaaaccagaaaatttcagaccaatatctctcataaatgtagatgcaaaaattctaatgaaacattagccacgaggtcaggagatcgagaccatcctggctaatacggtgaaaccccgtctctactaaaaatacaaaaaaaattagccgggcgtggtggctgcgcctgtagtcccagctagtcgggaggctgaggcaggagaatggcgtgaacccgggaggcggagcttgcagtgagccgagatcgcgccaacacactccagcctgggcgacagagcgagactccgtctcaaaaaaaaaaaaaaaaaagagcaaataaaacccaacaatgtatgaaaagaattatacaccaagaccaagtgaaactcactctaggtatgcaatgctggctcaaaatttgaaaatcaattaatgtaatccactacatcaacaggctaaaggagaaaagtaacatgattatatcaaccgatgcagaaagaatctttgacaaaatgcatgaagaaaactctcagcaaaatagaaatagagggaaatgtattcaatctgataaaaaaaaaatctaccataaaaagaaaaacccaacagctaaagttatacttaacagtgagaaacttgacgctttcctaccaagatcagaaataatgcaagagtatcctcctgtcaccactgctttttaacattttactggaaggcttagctaatgcaataaaagaaaaaaagggtatacaaattgggaaagaagaaataaaatggtctttgttcacagatgacatggttgtgtagaaaatctaaaagaattgatacaaaggagatggattagctttgggagggagaaaaataaaaaataaataaaaacaaaagagaacatctattaaaatcttacattagaatttggctgatatgaggaaattttgttctattacaaaatggaagaattagagaattatttcaggtattcttactgtgatcacaatctcaggttattgaagacttatgagtcctgatacagacacaaaagagtagagagtttacctagtatttagtggcaaataaccagtttctaaattactttgaccttctctgtttttcctctttgtatattggctattgattgtcttatagaagatacaacctgggaatcagaaaaatgtaatcctgctttaaatttcaggtttaagaaagaagaaaaaaagtgaaaaaaaagaagaagaaaataaaagaaagaaaatataataggaggctcaacctcgctctgtctttactttgggaattagatgtgcattcttttatgtttttactagaaaaagaaaatggaaaattggccttgcagccttcttcaatccttttcggtattttaaaattttccaaacatctaagaaaatgaacaaatcattatttagtttctgataggagtttgagggtttctaatttcatacacagggattcctctcctagaatgacatgtctgcacttgtatttttagtcctccaattttctcttgggaaagttggtggctagtgggctttgggatcaaatcccatttctgctacttcctacctgtgtgaccttgagcaagatgagtctcagtttctttatgtgtaagatggtataataataccttgtcattagagttgggggagaattaaactgagaaaacatataataggcatgaacactatatagttacactatatagtccaccaaatacactatataatctatacactatacactctatagtctgctgaattgctcaatttataggagactctgaagtagccctgtttattgtgtaaatcatgccacattttgtttctccacttcttaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtgggtaagtcctccaggtaaacgcacttctagaatcaagctgacatgtcaagattcagagtagactttccttctttgtcctttccttccatttccttcctttgtctttcccttatcttctttttttttcttgcctagaggacttatcattggagaaagaagagctaaggtcagccatttggggttgctggtcattagctctccaaagtcatattcccttttggtgccctttaaacatcactgaaacacaattgctaaataacttcccacatcacaatcattacagagggattagatctgccttggtccttagacaactatcgaagtgcatttttcctaagcccaaagctgaataaaatgagtctagcagattactactgttccaaggtctgatgctctcctcttcttactttagtttctccttaaatgacatatttcaaattgaccaaaaactgaggtcatttttatcagacactgaactatacttacaagatattgtgactcgccatttttgacttggatttctaccagccaacatcttgagtcttgtaaaactctttgattcagttctgcggaagttcactttgtagttaaaaacaacaaccacaacaaccatattcaacatttagacaataatttcttggttaacattttcaaggtaaggaatgagagtcttgggtttcatatggggcttattctgtaatgttgggacacgggtttaagggatttggagacatcattatttttatttcgggcaaggggtgggctcatcttcccttatcccatattgagcacaaatttttgcccaaattagttactaacttgtatgagtctgttttcacgttgctgataaaggcctactagagactgggtaatttataaagaaaaagaggtttaatggactcacagttccttgtagctggggaggcctcacaatcatggtggaaggtgaaagccatgtcttccatggcagcagacaagagagagagaatgagaaccaagccagaggggtttccccttacaaaaccatcagatcccttgagacttactcactaccacgagaacagtatgtgggaaactgcccctgtgattcaattctctcccaccaggtccctcccacaacatgtgggaattatgggagctacaattcaagatgagatttggatggggacacagccaaaccatatcataagcataattcagtaaatatgggaaagtactcagaaataacagtttcaatgattatcaccaagaaacatattttcctattaactttttttttctactccctcttccttattttactttatcctattttttgtctgccacagacttccctgatcctccagtggcaccgactgtgacagaggtgggagatgactggtgtatcatgaactgggagcctcctgcctacgacggaggctctccaatcctaggtaactgcatgttggttagtctgtgtaactgccagtacagttgtgtcctctttacgcatcttagtacagagcacattttaaagtattgcatttagaagaaaacctattttactgtgactttatgcattcaaaatgaaatatatatgttgagatgctctgtaattactcgagatttaaatagctctgatgaatatcatctgattgctggtttctttttttgtttgacatttatacacactaattttgaagcaactataagcccaacttccaccatcctagccagtgaacgtctgattctacatgattttgtctatgaagaaatttattttagaattaaataattaggctgagcattgtggctcatacctgtaatcccagcactttgggaggcctaggtgggtggatcacttgaagctaggaattcgagaccagtctggccaacatggtaaaaccccacctctattaaaaatacaaaaattagccgggcatggtggtgcgcgcctgtggtcccagctactcgctactcaggaggctgaggtgggaggatcacttgggccctggggcgtggaggttgcagtgagccaagatcacaccactgcactccagcctgggcaacagagtgagactctgtctcaaaaaaaaaaaaaaaaaaaagaaagaaagaaagaaaagaaaaaatatttaaatgcttagaagcatttgcttcccctatgccatgagaattttttctctttgctaataatgagactcacaaaactggtcatttccctcttcttatcttccttgctgggactcagagtcaactacattgcctctgattatattgttcacctacagtgactaagttgctatggctgacttaactgtgatccatttttcttctctttgtagtataattttaatttcttagtcccattattttcatctatattttatattaatatttctattctcttggaataagataggttaaaaatatttacatacatatatgactatttcacatagattgatgacaaaatgcaaaattttaaggacttctattatctgacaatgtttaatttcagagaccaaggaaaaaccttagttttcattttgcatacctgcaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttgggtaagtcaagagagatgagtctttgtcatcagaatcattgccccagagtatgactgctttctctctgatccctaactggaacaggcctggacacttcttagagttgtaggtgggcaggagcttgaaacagttaggtacaattttatgtctaagaaattaaaaagtaggtttggtcaagttgaataacttcataacataggccctggaattcgttaccataattccagtgccaactgtgggtggctctgattgccattccccactgaaaacatattgctgagtccatggacatgtgagtactttccatttgcccttctgaaggtattaacctattaatataacccagcttagtgtaaacaactatcactgaaacaaattgagatcggttcaacaggctacacttggaaactggtttctttgctttacggtcacaccttaaatgttatctattaaatcaaaaaagttagttcagtgaaggcaaaaaaaaaagatatctccattgttttatggcaatgaggtatttttttcaatggaaaaaaatgtaatacaagtttgcacttggaaattagagagcaatgggaaaattactctagatcattagatcccaaaccttgccttcttcaacttctttgggcctcccagcttcccacaccggcttctcaatttggaaaaaaatccatgacagcatttccaaaattctcacattgatcagctctttgccttacacacatccatgctcaaggtgtcttaactgaatttcattaagatgtagggcttttgtgtctatttttatttgtatccccattggttttatcacagttcctgcactatagctgtgtagtaaatagtttattcttttctgtctcttttatctttaagctgtaacaagccctcctactcttctgactgtggactctgtcactgacacgactgtcacgatgaggtggcgccccccagaccacattggtgcagcaggtttagatggctatgtgctagagtattgctttgaaggaagtaagtacaaccagtagataaaatgaatactgtcatcaataggtgagatatgtccctcccctttcttttgtctctctttcttgagaacgcatcaccttcctacgaaaataagatcaagccaaacgtcatccttctgagatgtatataaactaagcccttttttagtacttggtgcttataaattgatatctcaaaagtatcttggctaggctgccagattggacactataattgaactaagagatgggaggaagagattgtaacaaaactttggggacttccacttcttaaactggtggaattgaattgcaccacagcaatataaaagtctagttatgatgaagccagttggaaattctaaaacctataatgagctgaagttaactatcaaaagagtgacctattttgggtaataaagggagactacatatttggctagtaatcatcacctgccttcatctaaaaataagatgaattaagaactgctcttagttttaaaggaagcagcattaaatcctcgagtgtataagaaataagttcaatatgtagcagtaacttatctcaggagttggggatataaaaatgtaatcagtttaatttaggaggggaagagaaacaaggccataaatttttaaaatcactgatagaaataatagaaaaagaaaaaatgacagaagaaaatatgggccagaattacctgaaaaccaaaagaatgtgaaacttaccaaaatcctgttgtgtttcttggtttcttatttgccataactagaaagggatgacatttgaaaatggctctggacttgggttccattctagatgctggtaggtaaacaatctcccaggaaacttgttcaaattccacaaacagtggcccaagacttcacctccaggaaaactctttggacaccaaactttaacacagatcctcgaagtgaaggaaggaggttacgaagcacatttgggaaatcaggaatgtgaacgcaaatgcacctcccctggaggaaactcactatggagatgaaacttcctatgaagagaaaactgctgaaaaagaaatcccaggtgcctggattggggcacctgtggaaatgctcacctctgttctggagggaggaagaggagagggacaatgaagtatcctgatacccctcaatccctcttgcacctactccacacacagagtcctataattggtttctccaggatttaaaaagccactaaccaaaagcagtggaaacgtcagaaatttcccagggttaacccagtaagggaaggggatagtgtcactaatgcaacaagtaaattcttgagcacttcagtttattcctcttccatcctcctgcccccatttaaaaaagtcatgagcactccattctgtttttttgtattgtccagccagcagaatatcccaatcttatgtgtgatgtggcctttgagcataaaccttttgtgtatgtatgaatcgagcaaattctttactcttttctttctgataggtttaaaaagtaagaagatacagcaaaatgatagatggctgtcattttgatgttacccaccttagataaaatacaatgaagtgtattttacaaaattttgcgtgtggtctgtgtagatacatatgtatatccgtatatacatatgtatatgtacacagtcattattatgtatatattttgccgagtaacgttctggaattagctttctatgggagttctctcacaacgtgtatctctttcttcttgcagtcttttcttattttctttatgtggctgccgactcttcattctcttttaatggctgttgtcctccagactaattttctatagtgtttaatgcttttagagacatcaggttttattctgtaagagaattctttgttttgtaagatcgtgtgttgttttggactctgcctttctctcgtttttgttttgttattatttttttaatgcctgcagcattttactcttctttgttttctttctgcactctagttttttctttcctttcttaaaaattctcctcacatgttaaataacttacatgttccttcctcatcccctgggacaccatcttctttgtctgtgtttccccaattaaagtggttccaatgtgaagagatgggctatttttgttccccctctggtcttgtttcgtcctgttttctcttgaaattgtctcttttactagttcttcactcttttgtacatgttttctgagtctcttattttcactttctcatccactgtctcttgactatgaaaataccaacacagaagctcccaagcagaccatttgtttaaagatgtatctctttttcaaagacataaggaatttttattctccacatgccttactagctgccaggatattctagttgcctgtcccttctccttgatactcctgttagggttagaacaagagagaggcaaaagttccaagggacagccagtccagtccccaatgcctccactcctctcctgatactgagaaagtcatcatcccaaaccagtgggtatgcccaagaccaccctgtgagccacccatgcggaaccctgagcaggctcaatttgttttcttgacagagttcattgtcatgggaaccagaactgcctcctgagctgctggggcagcctccaattctattcagaacttggaccctggtaaaacagggctggccttatcccaagggcctgcactcccagtcttgaatgagggagccccactgtgggagcaccgtgttccctggggacccaagagaatcctcccctgctggggtggcagagacaggcacaaggatagactgtctcactgtgcgctgctcccccgcagattccaggacctgctcctctgttttcttcagggtcttgctttgttcttctctatctcttcttcccaccactggaggtgtcccagcctcctttctcctcttctctattcttttcttttttctcctcttctctgtggcaggtgcctcaggtcagaagccacagtctgcacagagcaggctgtgctctcctgaggaacccccctaacaccgtttggtctcttccgtcactgctctgaggacaaatctctttgcacactttgcatactttactaacagagaatgctgactgctgatacgatattattctggtgtgaaagtgggtgtctttaattaattttaatgacggattctcaaaggtacatcagcaaaacagtctgatgaaaatggggaggctgcctatgatctgccaggtaaagtattccgtgaagctctcaaattttcttactatattataatgtttctgggaatattgaatgaccaagcatgaagaatactcatcacatacacacatcacacacacacacacacacacacacacacacacacacacacacatccttagagatgggggagagggagcagtgagttaataatgtgggatcaaagtcttctttctttctgtgggcaaaatgcatactaacttttagatgctgaaacatttgtaagccctgaatgctgggttaaaattctctcgatgtgatacacaagctgccaaaaactttttaaaattagattttggttgcaaggatagaattctaccaactccttatgaggaatcagcccatgaactgttttctctttgtgaaataagctttttctcttcatcaatgtgaataaatatgatcaagttccctctacccatgttagtgtcttacaatagtaaatcagccaagataaaaacatattatatgactataaaggtcaatgtctcattcataaagatagccttttcctgtttttctgaactttaatgtgtatagatgactagctatcatgattgcatgaatcattataaaaccaaattggaataaaactgctacagaattcttgtggacagttactattattcaggatgctttcatgctgaataaagatttttcagaaacagcagaatcttatagtttatttttcctgttatttatgttagctattttaggctgttttttatttaatatatgaaaaatgtccacccatgtagtcggagtccagaccaaagtcataatgtctctaaatgatgtattattatgagtaaaatactaatttggagttgactgtaatggttaagatgatttttttcactaaacagcattcctccttcttttccttttcttttacggacttcagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcataggtaggagacaaggctttcaaaagttagactccattttacatggttcactttttttttcttcaaactactttctttctcaaaacctcctattttgttgttactcctttgatattttgttaatgcttcctaagagttagaacttaataaagcagctctcttcaggcaatgtgggagatcaccttcaggtttatcttggtactctgaggaccagttagttaacctctcctggttccaggagccaactctggctgggctgcctatttacagtggagagagagtatgttaatacaaccatgcaaacaatccctacgacaaccatatgcctccaatgaatctgcagggtcagaactattttcataatattatgaaaatattatgtgtacctttcagtgttttgacatcttcactgatagtataaaaatgaaggtgagtaaaactgttgataccttagtatgaaatcaagtcagtgccacggagccatactagccagccttgccttcctcaccaccatgcactcaacagatgaaataaaagggccagttttgccttagagtctcttttttttatttttgagatggagttttgctcttgttgcccaggctggagtgcaatggcacaatcttggccactgcaacctctgcctcccgggttcaagcaattctcctgcctcagcctcccaagtagttgggattatagacatgcaccactacgcctggctaatttttttggtattttttagtagagacagggtttcaccatgttggtcaggctggtctcgaactcctgacctcaagtaatccacctgcctcagcctcccaaagtgctgggattacaggcgtgagccaccacgcctggcccttagagtgttcttaatgaagcataaaaataattaattttggctgagcacaatgcctcatgcctgtaattccagtattttgggaggctgaggcgggcagatcacttaagcccaggagtttgagaccagcctggggaacatggcaaaaccacgtctttactaaaaatacaaaaatttgctgggtgtggtggcacacgcctgtggtcccagctactcaggaggctgaggtgggagaatcacttgaacccaggaggcggaggctgcagtgagccaagatcacaccactgcacttcagcctgggtgacagagcaagaccttgtctcaaataaaacaaaacaagaataagaataataactttcatcaaatcttggctcttgagtatgttttttttctagacttgtgtgacaatgaaatgcaaagtatgtctgaagtacttaggctgcacactgcagtacaatggttgtccccaggaaaagcaccgtacaactgagttggaggatgaataggtgacttttttgcacagaagctccacttttacttggggaaataagtaagaagaactgcttcatccctgtgagcctatgagcctttgactccctgctcctgatggatttgcagtgacatgctctagtatcttcatgatgtttaattaatgaatattaatacacagtgggccagggttgcctattatgtacttcaccacagtcacacagggagaaagttactgtcgaactccaacagagtcacctaaatagcaagtgctgggtgctaacattttgtttttttctggtaaggaagaatggacagtcctcccagctaatgtggtgcctatagatctttcgtggaatgttcccttgcaaatatactcactgttagaaactatgaataactggccagacgcggtggctcatgccggtaatcccagcactttgggagactaaggcaggtggatcacctgaggtcacaagtttgagactagcctggccaacatggcaaaatcccatctctactaaaaatacaaaaattagccaggcgtggtggcatgtgcctgtagtctcagctacttgggaggctgagacatgagaatcgcttgaacccaggaggcggaggttgcagtgagcaatgccactgcactccagcctgggcgacagagagagactctctgaaaaaaaaaaaaaaaaaaaaaagaaactatgaaaagtatgcatagtatgtataaggccctaagagaaaatgtatttttctataaagttgctttaggcttattacaacaataaaaatacaaagttgcaataaagccaaggatgtcagggataaattttgctgagtcaaactgttaaaacatctctgtgtggaaaccacacacacacacacacacacacacacacacacacacacattttgaaccagttactatatatcgtctgttagtggcacatctcagagtttattgcagagatatgccacaagggtacgctggtgagcatcatgccattttgcttttgtaaggctattttcagacaccagactgattgcaaaattgtgctattttaccctctctcagaacctccaaagattcgcatcccaagacacctgaagcaaacctatatccgcagagttggagaagctgtcaatctggttatacctttccaggtaagagttcaagggtcgctctttttctctttagagggctggattagtttaggaagtgggaagaggtactctagcatttaagttcatcatgattcaggatttcctcagagggagaggaggtaaataaagaatgaaagagtattggagaatgattaagcaatctcctgctgtcaaaatagagaaatctatagaaaccgtcacagattttctttctgcatgagacaaatgagatatagtcttgcctgaagctcagcgactatggtgggcagggaagaaacatcaaggagataccaaatgaagaaatgcttgaagactcttttggtcctatacatttgtaaaacccatcattttaagtgaagctctcagtgtaacattcaggaaaacagtgtgtgcttagttcccacaatgaccccaaaccaaaataatttcaataagggggacaactgaaatttgaaataacgatgacactaactgaaatatatgaacaatattaaatcattgttccagcaaaagaatctgttcttcacaaaattcactagtctttacttacaatagtcaattttggtcttatacaaatacacacacacacaccctgcacctcccaacccttactctccaactccctattcatatgacacctccagacagtgctgttcaatagaactttcttcaatgttagaaatgttctatatcaatgctgtccaatatggtagccactagccacatgtggctgttgagcacttgaaacgtgtaactaggaactagtgtgactggagaaataaatttttaattttcttcaattttaattaattttaatttaaatagccacgtgtaccttgtggctatcgtatcagccagcctggccttagaatgtaggtctctacacacatttgacactcatatacacacacacacacacacacacacacacacacacacacacactcacacatgcacacatgcacacacagagagaactctgttcaaacccaggctcccatgaaaccaaactaaagggatggccaattcaggccatcctcattgcactccgggtgcaaacctaaggagagacattgtgtactacataccccccgcatgaaatcagaatgaaagccaaggaggaagtgaagcagaacacagcccaggaggaagtgggtggcttggcaaggttcttctcactttccttctcttgcagcatcaaataaaaccagaagtggcaacaaggcaggtatgggggacccagccccaaccctgcactggggctgctgagtcagccctcaagcctccacatcgttcctgccaccacaactaatcccagttcccagatctgggggtctgcgtgttcagcttctgtcactgagtctgagagagaaaaaatcatgagaacagggaccgcatagatctggcatcccagagactgttcagcccccaggaagggagatgagaccaaagtgtgatgtttgtatatttgtgtaatctctagagttcgcaaacattttctcatttgatcctcagaaacaccctgtgaggcaggaaggccagatttccttaccttgcttgagaagggaagaaactgaaagggaagttaagtgacttgcccaatgtcacacagaaagtcaatggtagggccaagaacagagtccatggcccggtcacttaattcagtggttttttccactctgtatattattagagaacacacatttttccctagtggctaacagcaagttgtacatttaaggaaataagcttgaactgtttttccctatcttcaacaacgtcgttctctgcttcccatgtgtgagtctgagcatccccaaccactcttcaggctctgaagcaggggtttggtgtgtagctctacatctcttattataacctagccatgttcagagcccacaggaaagctgtgccttacctgacagaattcatgcttggttcctgtctgccagggtacgcctggatgcttggggattctaggaaattcctttgtaatagaaatggaaactcaggttcatgaatgggattatgatttcttaaattctgctcttaaagaatagtttcaacagcgagagggaacagagagagaattctagacaagtctaaaatgagcagcacaggacagtagaatagtaatcattaacatttagatgatattggccgggcacggtggctcacacccataatcccagcactttggaaggctgaggcgtgtgaatcacatgaggtcaggagttcaagaccagcctggccaacttggtgaaaccctgtttctactaacaactaaaaaaattagccaagcatggtggtgcgtgcctgtaaacccaagtacttgggagggtgagcaggagaatcccttgaacccaggaggtggaggttgcagtgagccaagattgtgccactgcactccagcctgggcgacaagagccaaactctgtcaaaaaaaaaaatttagatgatattaactacaaaaacttatgtattgggcagaagctttctcagcactttaatctttataaccactctttgagataggtactaccattattcccgttgaggcacagaaagcttagtaacttgcccagggtcacacagacgttaagtggtcaggagctagacatagattccagggccccagagcccatgctcttaacaattatcctgtgttgtgcaggcttttggagactaggagacccagctgggagacctggttccagtgcttacctaactgcaggaacttggacaaattatttaacttctctatccaaaaaatgaggataatgataagcttgatgtgaagattaaggaaaataatcaatgttatgtacctaaggtagtgccttgcacataaaatacagattacagctttgctgctgtaattgctcaccaccagactagaagggtggtattttccagccctgcctagaatgggttaagccactgtccttctcataatgctgaagaaacatcttgagacaatatgatttaccctctctacttttgctgtctttctttttagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattggtaggtttagatgaaggagccagaaagttctgtcaaagcagtacagggatgaattgtccttgtccctaaggcaagagcaggagttttgttaggctggctctacataaaactctttttttagatttattttttaaaaatagataaattaggctgggcgtggtagcttacacctgtaatcccagtactttgggaggccaacgtaggcggatcacttggggtcaggagttcaagaccagcctggccaacattgtgaagccccgtctctactaaaaatacaaaaagtagctgggcatggtggcgtgcacctgtaatcccagctactcaggaaactgaggcaggagaatcgcttgaacctgggaggtggaagttgcagtgagctgagatcatgccactgcactctagcctgggtgacagagtgagactctgtctccaaaaaaaggacagtaagatttgttaccatttcaaaatgaattctcaccaactcaaaggactaatcacaggagatttaaggcatatatgttcaagaaaattaatgaatgtgctttttagtgaaatccttctgcactattctataacccagctgtctctttctcttagtttctcatctccctgatgataaaattatttcttatgttgaattcttacattctagacagtatagattctagctatagtttaacatgtttcttactacacctaaaatttgctaatgaagttttcatggagaatgaagaattttttttaatattaatataaggaagatgtacctaagcaaaattgaacagttaaatactgaattctttgatcctgccagagtagttagatacgtacctgcccaaaaaataaataaggttagttcttacttctgtccagagtcaggggaatagaggaaggaccccttgtggatagactcctctcacttaaattatactgtaatttttgcaacgtcaagaaataaatttaaggccgggtgtggtggctcacacctgtaataccagcactttgggaggtgggcagatcacttggggccaggagtttgagacaagcctggacaatatggtaaaaacctgtctgtactaaaaatgcaaaaattagccagacattgtggcacacacttgtggtcccagctacttgggaggctgaggcatgaaaatcgcttgaacctgggaggaggagactgctgtgagccaagatttcaccactgcactcagcctgggtgacagaccatgactctgtctccaaaaaaaaaaaaaaaaaaaaaaggaaagaaagaaatttaagagcagagctagaaaaacgttgtttccaatcattgttatcattgtatttcagtaaatttgctgaaagttgctctaaccaaaggggcaacttcctgtaacagcctcccttaaagggtcattccctttaaactaagcactctttccccactggctaatccgttttgagttttgttaagttgcagggagtgttgaggctgctctgtgccctttgatctggcctggctccatactactggaaggcaaagggtctcagaagcccccatggtagggtctagaagagtgatgcctcctgtaacagaggaaagggtcttttaaaatatcctcatgaaacaaaatgtagactgggaaagaaagtgaccttgcagtgacaccatgaattcatcctgtagaccgtccaggtccaccccaaattgtgaagattgaggatgtctggggagaaaatgtcgctctcacatggactccaccaaaggatgatggaaatgctgctatcacaggctataccattcagaaggctgacaagaagagcatggtaaggtctggctttctctggttcatcagtagcaaaaggcacatttcatcagaggtaaaggagatggcacaagggcctcactggtaaggagccaactggggctatggagaagtgatgtggcagagcagaaaggaaaagacctgtggagccacagagctggtcttaaaccccagcattgctacttaagaccacatgtataaggaccacacgtgaccacaatcacttgagctctttgatctctattttcctcatctatgtaatgggggcacaaatatcccttgcttgattattacaaagctaaaatgatataaagcaactggttcaatgttcagtagaattcaataaactcattcattcaacaaatatttgctcaagactttgactcagatttacacccatgcaactctttctccttgtgaaataaatgttggatactgtgcacttatgtctacaaaaaagtaaaaagacagacaccagttagaacagaaagattctacaaggttacagcatgtgcaaatgcggaaaggtctggagaaaaagagcttaatgcaaacttgtccaacccgtggcccacaggcctcatgcaacccaggatggctttgaatgcagcccaacacatatttgtaaactttcttaaaacgttatgagtttttttatgattttttttcagctcatcagctatcgttagcgttagtctattttatgtgtggcccaagacaattctttttccagggaagccaaaagattgaaaacccctggcttaatgtgtttaaaaagcaacctagttggagtatgacttattataaacttattttatagatgaggaaactgaggcttgcagaggataaatgacttgctaaagatcaccagattttctcacgcctgaaatcccagctacttgggaggctgaggcaggagaattgcttgaactcggaaggtggaggttgtagtgagctgagattgtgccactgtactgtagccaggatgacagaacaagactccatctcaaaaagaaaaaacagaaccaaagttaataatatcagctgggagcagtggctcatacctgtagtcccagcactttggaaggctgaggcaggaggattgcttgagcccaggagtttgagaccagcctggacaacatagggagacctcctctctctaaaaaataaattagctgggtgtggtagcacgtgcctgtagtcccagttactcgggaggctgaggtgaaagggtctattgagcccgggaggtcaagactatagtaagccaagattgcatcactgcactccagcctgggtgacagagtgagatcctgtctcaaaaagaaaaaaaaaataataatgttaaataaatgtactggatattactaatgtttctctagtgatttagcttcaggtctttctcataataagttggcactaaaattctgtagttatactttattctacaaaagatagctaggaagacaaataggtaggtagacaggtagataaatagatgacagacacctaaaggttatgaaaaaatataaagatagtagatggcaactagggtatatgaatctaatgtgtaaatgaagattaaattacatagtcaattgcaaataagttgtgaaatattaaacaaaatatacattgtttcaacacattttaacaacatatattattactctccatataaaaatgagtggtctttttttctttttgttaataaagcatccttgttatttatcccaatctacagttagaaaaattgtatacttttaggtgattttcctccagttattatttttttttcttttaggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtgagttgggaatggactgacatttgaaaaccttggttgacagtgaccagacagagaagactggaaaaagagatgtggtgaaagggaacaaaaaaatggtaaatgtacattgtaaaattatgataatggtgttcaagtaaaattttaattttacaggtaaaatttaagtgaaattgtattattattgcattttttacaaatataggctttaattaattccaggttctaggcagtggatctataaatggctaataccccagaggctggaagaagtagacattttcttctagagtttctacttttattcttggacacctttattgtagctacacatgggacccactctgtgataaaaggagaaactaaattctatccttatcttttcttttcatcataaaccactcttcttaaaaccttccttgtgtattttcacattagaacaaatttctattcaaaatactcagaaagacaccaaagtcttctcaatatctggttcagtttcagatgacccctctggctttctatcccacgtgtgattggctatacgtttatacccctcagaatgtttgccacatggcatttgctcatctttgtccatgtttttctaagttcagggaagttttaatcatgtgtaaagtatgccaccaataatatattctcaggccaatttacataattttaacatatttgtaatgcttgtttttaaggtaaaatctacaaaaatccagtgtatgaagactttgatttctcagaggcacccatgtttactcagcctttggttaacacctatgccatagctggttacaatgccaccctaaactgcagtgtgagaggaaatcctaaggtaccatgttcttctatcacatcagttaaagtccctgtcttgtatttgttgtgttataatgtaagtaacaatgtaaacaaatccagctgctacttgtgtcttcccaggatgggggattagaaggtggtagtggtggtagattattaggcacactattcagatgtagtagtaaaaaatgcttacatttctttgctaagggattccttctaaagaaaaagcaaaccacctatttaaaaaagaacatctcctgtgtaaggagatggaagtataataatattgtttcacttggaaaattaggtggtaatgtcaagaattctgtgataggttaaagtaaacaacaatcacactacactgtctgcgataggttaaagtaaacaacaattacactacactgtaagacagaatatgaatgtgctttgataagggtacagtgtgctaagaagggagctatcatatccagttgaagagattagaaaggtttcaaggtttcatgtttgcatttgaaaagaacaacgaattaatgaatatcgcccatagagatgtacatatccctgggtgcaagacagaaagtaccctagaattgggaaaatttatgaacttctttttttcctgtatataccttgatcagaaatagggaagtcgtccgggcgcagtggctcatgcctgtaatccgaacactttggaggctgaggcaggcggatcacttggtcaggagttcgagaccagcctgggcaacatggtctctactaaaaatagaaaaattagctgggcatggtggcacatgcctgtgatcccagctacttgggaggctgaggcaggagaattgcatgaacctgggaggtggaggttgcagtgagctgagatagcaccactgcactctagtctgggtaacagaagaagactccgtctcaaaaaaaaaaaaaaaaggaaaatcaaaggaagaagtcagactaaggatgagagaaaggtgctgaactaatgtttacttggaaatgatgttggtacatccaaatgggaatgatgaggaagcagatggagaggttcacccggagcctaggagaaaggccagggctgttgctcttggtttgggagtcccatacataaagatgctacattctaccccttgccaaagctttagaaaggtgtgaggctcagtgatcgctcccatttgacgggtggaaggaagaagaagactgtgtgaaggagacagaaaaggtgccatctctaggttctgagcaagacaaaataatagaagaggtggaagagagaatgcagagggtgcatatttacaaaagaaaggagaagacaatatgagagtgaggagtcactgatatcaaatgcagttcagaagtcaaggagaatgaagtcatcttcctgggcaattgggtcattactgatcttgcattatctgattggagtagatccattgccatgggatgatgaatatagacatcagaggacagattaagtaatgaggaggcagatgcagttcataaagaattaaaaaacagtatcaggaaaaggaagtgaagaaaatcaaatgatcgtgacactttatggggtttctctgaaaaaaatgctcagcaaatatgcactctctacaatgagttaacaacatggacctatggatgacattgttttttaatttgaaagtatttaattggcaaataaaggtcatatacattcaagctgaacaatatgatgatttgatatatgtacacattgtgtaatgattatcacaatcaaattaatacattcatcagtaccgatgctgtacattcgatgcccagaacttgttcatcctgtaactgaaagtttgcacccatgtagatcaaattgaaatgcaactgaatccatttgagaagattgccctagagttacctctgaacacatctggctttctttgttagaactgttagtttgcttatttgccaagcactaagtagagtttaatgtgagaaatagtgtcaagtaaaagtctatccttctcagatgcactttctttttaagccatgctttaaaattctgtcactggctttgatggtctattaatatgccaattacagatatgttttgacctaagtttcttcaatttgaacttcagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaaggtatgacatccaatatctcacgtatagactaaagttaaagaaaatcattgaattattgttcttaatgcttattgttcttaatccaaattgcttgccaaaatgctgcagcgagggtgggagagggtggtgagggcaagggaagcagggagggaattaagggagagaagacatttttacatcctgcattcacttcactttatttgtggaaggctacttgttatttaagtcaacttatttttatcttatgtgatttgtgctaagggactgttaatttcagtggaatgttagtgtgtgtacagcatggtaagaatgaaaggggctatcactttggtgacataacccatctataaatagaagcctagtgtaaaaatccatctattgaaatgacagttgagtaatctgcactatttttaattagtttactattttgtaaagtttgttattttctgatatttatagaaatagttttgctaattaagtgtttgatattacacatatagaatatagcatatacatattataacaggctgcttttcaaatctctaactggagaacttccatttataggtatacatttcatttatactagttttcaaagtgtagcaactaatgtaaaccaagaaaacacataaggatttatgcggttgaaaagcataacctgccatcttaatcaattttcaaattaatcaactaccatttttatgctgatatttttctttacaagcagaacctactttgggacaccatgaaaaccccttcaaagagtcaccattatgagataataggtgacatgatcctaatgtgttttctctcattcttaactgtattatattgccattctgtaataaccaaaatctttctttttccaacctctctataatgaagaaattataatcaaaaactagtaaatatctattttagaaaatcatagtaaatgcttgggtatttatgttttttaaaaagagtcttttagtcctaaatctagtataaatatgagagggaaacttcttgaacaaaataactttcatatatatatatatatatatatatatatatatatatattttttttttttttttttttttttttttttttttgagacaaggtcttgctctgtcacccaggctggagtggaagggtgcgatctcagctcactgcgacctctgcctcctgggttcaagcaattctcgtgcctcagcctcttgagtagctgggattacaggcatgcagcaccacacccagcttatttttgtatcttcagtaaagacgggtttttgccgtgttggccaggctggtctcaaactcctggcctcaagcaatccatctgccttggcctctcaaagtgctgggattataggcgtgagccactgcacccagctgctttcctcttacaactttttaaagctgtattctttctttcacaattcataattgagtgaaaggaaaaagatttgatttttttttcctcacaaatataaggcatataatattcttagaaaatttcaagccttactattgagataacccttacaaatttaaacatttttagctgctttattggctttaaatgattaagttcataattgcaagtcatctggtttctaaactgctagccttattagttccaaagtattgttgatgcttttgtttcaatatccccccaaaaaacaaaaactaaaaaaaaaagtaccacttatttatgctttgaaactagctgaatgttgttaatgatataaaatgatgctttaacaaatggaacaatatttggggccctccttaaaagcgaatagtattatacatatacatgatatattctttttagtgaaaatgtagtaaatggtacagtaattaaatttgataaaaagaataatgtattctagtacataagttcgtaataaagtatcaattgtgatatattgataaaagcttttggtcctaaaagtaaagctgaaattgtttatcatcagactgttactctgataataggtaacttgaatcaagttgagttgtgaaaaaaggtaagaatgtcaactgagaataaataaatactggtacaaatattctgattctgcagtgatatatcaaggagtaaatacccctggacaaccagtcttcctggaggggcagcaacaggtttaaaaagtttatatcccactggatattctactttccgttccattcctcttacatgaaaatgcaccttgcatgtaaagcttgactttctcatttgcttttaattgtaccccttagcagctcatggcatacagtgcttatgccatgaacaaggaaggccaaattattcaaggatattaagtaatgtagaaactaagttttgtcagaaagctacataccataccacaagtctccatgaataaagccagaaagctacatttgaagatgatctcgttttatataataagactatcaaaacttgggtatcaatatttctttaatattttcattttttaaatgtagagagacttttttaaagatagttgacagcatagtttccttacattcatgatgcaattcagagaactgaacatttcaaacattttttttgatgttctgagcattttttatggaaagaggatacaaaaatagatccaatatttagaggctgggcgtgatggttctcgcctataatcccagcactttgggaggctgaggtaggtggatcgcttgatcccaggagtccaagatcagattgggcaacatggcaaactcccatctctacaaaaagtacaaaacttagccaggtgtggtggcacatgcctatagtcctagctacttggagagctgaggcaggaggatcacttgaatctggaaggtcgaggaggcttcagtgagccaagatctccagcttaggtgacaaagtgagactttgtctcaaaaaaataaaaaataaaaaaaataaattgggaaacttacatatttaaaatattcccattacaaattcacaagtagaatatctgtaacccatctatctgttgaagattttggacattttcatggggactcaaattatttcacgtttatgaacttaaaaggaaagaaaattccaggctctattacaaaatgtatcaagcaataaatgagtactatcatatatatgtgattcacccccatttggaattgcaaattaagagttttttgcagctgggtatgcaacctgataaaaaccctgataatgtagatctatgcctgagtttacaatatttgttttgtgagtttccagagataataacagctttcaaaagaggaaaaaagtaaggttcttttttgaaagctttgtagattgtatatagaatagctttgtaacataaggttttgtgtctatttagatcagtcatatatattccatgcagaatacaatattatagaatacactagtctaatatttgtacttgataattttgccttttagaatttcaacatatatatatgtacactaacactttgtctattgtctatgtttttcttttgttgaaaaacacgatatatatatgttgtagggttttggtttttgtatttgttttaagctaatggtttggaagctcttaccatagatattcactatacaatcagaatgactttgccacctattcaggcaaagtagttgtgcatattaataaatgttttacatattaatgatccttttgacgtgactggatccccacccttcatttcatgtgcttctattttcctacatcttttacatgactaaggattaatgaaatcacctcttcataatcatgaccataatttcatccaacaagtactcaagtttggtgttagcactttattaatgcttacgacttctctctctctccctctttctcttttccttagtcattgcacaataaggatttttgaatgtataatatcatctaaggtaagctttcatatggttttggcatatgaagcttatgactgtcataagccataccaagcctgtggagtatggcatgattttcattacataatccaatgaaaatagacttattttaaatccctaactttgtagttttaatttgtatttcactatcttgaaattaacagctagtacttatccatcacagcagtctcctactgacatgaagcaagttgttgaatgcagtagagcatgaatgaaagcatttaatgtagacaaaaatgggtgatacccaagcattctgaattatttgcatcaaggaatggacatgtacataagtggcatcatttctaccaatatgtgacttgagttgtttttttaaaaaaaggagaatgactttctcaaatttgcattaaagaagtttttaagaatgttcaaatggcatgctgctttgtctggacgtgaatttattagcaagtagtaaagcacttcactaaaggaccatgaatttttgtggtttcatggattctctcttgaagggtacttttatttttttaatataattcagaaactcagaaggtaggtatgaaatattggtaggtgtttctcgcaccttcagaaagtattggaccggtcttattattataattttaacaaaatatttccaatttttgtgcttttgacatgcataaatgaccaaagttaaagggagtagtttttatcttttctaatgtgcttgaatcgaaactctctgtgcctaattaaaaagaacattaacaaactggaagcagatcttcccactgatccataatgtggtatgcatttattctgctgttcagtcagaacatttaaatcatctatgaggaatcacaaaacctctcaaagagcaataaatactttccaaccacttgggaatttaaatgaagattgaacaatagtaggggaaaaactgctgtggttctactgggaacttgcttttccttctagatgccaagtgctttaaattctaaatgtactaaatccaggagaagattttccaagtagagactgaatgaatctttgtaactaatgggaacatgattagtcacatttccaggcagctagtcaagaagtattgtttcagcgatttttcaggtagatggttttgatttgtctgttttccttttggtcctctctaggtgggctctccttctgcagactcctcttgcaaggcgtacctccaaacataattgattcatatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaactttcaaacaaattttctcagtagaagggatggtacaacaaatctgaagtgtttgtgatgaaatgatacaatatgcattcatgcatttagggttgtatgccgagacacaaaactgaggctaaaggctgggagccagcatgcccctgaacccaggtctgccctccctgtgtctctagcaaggcatcttggccaaatctgccagagcttctgccaaaacagctagtcatagtgacagagggctgttacagacaacagacctattacagagttagggtttgctgatggtatccattcaatttgatggaaacctttattaaaaaatctagcagctgagaaacatttatactaacccataatattttcagcaacttcctttactcttcctgatataaagtttcagttaagggagtagaatcgaactgtaaggtaccacagtattactgtttattccctcgcctcccctctgtttttctttttggtcttttgttgcaggagctaaatatattgtgacttgttggtgggcccatggcttctttggatgacattttaaacatatctgctcttttttctttccagattttagctgggaagttctatggtggtcatggatctgggttgatgttgggctcgtaaagggaagggtgaatgattcaggtcgttgcagtacatttgagaacaaaagaaagtctagtttatgtccaaactatgttggctctatatatctctgttgaaattggttggtgatgttgccttactggttgttaagaacattggctatcacccctgctcctatgctcccaaaaactccagaataatattgtgtgcaatccctgtgtaaacaccaattttattttattttatttttattgctataacccattgtttttttatatatatatatttttattatactctaagttctagggtacatgtgcgcaacgtgcaggtttgttgcatacgtatacatgtgccatgttggtgtgctgcacccattaactcatcatttacattaggtagatctcctaatgctatccctccccgctccccccaccccacaacaggccctggtgtgtgatgttccccttcctgtgtccaagtgttctcattgttcagctcccacctatgagtgagaacatgcggtgtttgtttttttgtccttgcaatagtttgctgagaatgatggtttccagcttcatccatgtccctacaaatgacatgaactcatcattttttatggctgcatagtattccatggtgtatatgtgccacattttcttaatccagtctatcattgttgggcgttccaagtctttgctattgtgagtagtgccgcaataaacatacgtggtaaactccaattttaatcaagaaagctacgtgcacagtattggttaaggtattttaacataaaggaagtctggctcatctataaagacatgaaaaccttatgtctatgtacaaaccaaagaaatgacaatgtggcaaacccaatcaacgtggtccctgcagcccagctgctgggtcttagccatagtgcaacagctgagctggctgcttaactcaaatactctgagcactttggccaagacatcggccaagctagttaggctgcttatgtgtgtatggttttacatagcctaaaagagactgtaaaacctccctgctgaattttggttcccc

SEQ ID NO: 12102 - DNA, 6798 bp, Human
tcctcctgagttcaagtaattccctgcctcagcctcccaagtagctgggattacagtgcccaccaccatgcctggctaatttttgtatttttagtagagacagggtttcaccatcttggccaggctggtcttgaactcctgacctcgtgatccacccgccttggcctcccaaagtgctaggactacaggcatgagccaccacgcccggcctatgctgctactttctatcatgctggtaaggccaagaacagaattaagacctcactgctctccctcaacatgcttagggttcttttgttgtccagctatgttccctccttccctccatttcctgtcccaaaaggacatcagaattctcctggctccctgctgtgaataatgagaggaaggaacactggttcttcacatgcctcgcagatctcatgttccctgtgaagtctcccatgagtccccagcagggttccccttcctcttattgtccttgccactggcttgaacttgtcagtttgatctgtcgtaggataaggagcaggacattagtctatggggaggaaaaaactgggaacaaaggataaaagatagagggagcagattgcagcccaaagctacacgtcaatggaacgggctgtctcctgacgtgagcagaagctgaacagtagccgcctcggaggagatttgggcatcaggggctaggtagaaagaggtgatcaccgttgtctatcagatggtaagttcgagggcagggatcctgtctggggtgtccctataatccccagccctaagactgagccttgttcactgctagtgtctaaggtctgcccactgcattggaaggaatttgtcctctcagaccctgaggcacctactgagaggtgaccatggcctgagaggcctgaagattaaatagtccctgctctacctgacatttgagacctgcatgatacgtgtaaaattgatggctcagacagtaagaggcagaacaaccaagcccggtggccaaggagagaggagatttaaactgagtttgaagggctctgttttttctactttttcacccccgtccacattaatgagccaggaaaattctggtgttggaaaaagagttgaggaggtaacatagaaggacagatcaatggtccggagtgagacagggaggagacagggagcttaggacatcttgaccttgccgctctggggaaggtggcaacgtgtaggctgtaaattctaatctctgctctgaccacggctgctgtattaaagaggaaatttctctttacccctgccaagaaaaccaaaacccaaataatttctcttgcctcaatttacccccccagatgagacctaagagaacatacagctcaaagctgcttgggaaccccaaaagtggaatctgttagctgctctgagtcttgatccttcttatccctggatactgagtgcccatgaatgcccagaatctgaagcagtcccattctttccggagggaagtctttaaaagagtctcatcgactgatgtagtgtggttaaggtgctgtcaggaagcaaggagatggataagttggctcttaaggccccttccagcctaagcctacccttccttgttccctcctccccctatacccaccagcttcttcgggactgcaaggagacagcaggcaggccgcccagctaggagtaattgaaaggagcagatgagaggggaatgtgtcctcccccaacgcccctgccccacaggggctgctgagaaatgaaaactaatcaaattacacccgacggcctcccgacccgtgcacaggagcccgcctgggccaggggcaggctggcagggtggggtgggggccatgcgggagaaagaaggggaatcacatctaatccactgtaaacgccttgatgtgcagcaacagcttagagggggctcaggtttctgtggcgttggctatatttatctctggttccatgccagcggggagggtttaaatggcacccagcagttggcgtgaggggctgctggagcttgggggctggtggcaggaacaagccctttccgaccccatggagctgtatgagacatccccctacttctaccaggaaccccgcttctatgatggggaaaactacctgcctgtccacctccagggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtaagtggccatcccatccccctgccccaaggggacggggccagagggaggcacctggacagcctcaagaccccaagaggggctcagagggttggtgcaggtgccagacagggtcgaggggctgcaggagcccttccctggtcagagctgggctatccagctgacctcctgtgtcctgtgttctttccagacaagataaaggcagtggggaggaagtgcagaaggggttggggtggggaacataggactgaagaaagatcaggagcaaggccacagtcagcccaggtgagggtgaggattaatcccagtgcctgagtcagagcctaaaaggccaggccaagttcaccagagaagactgctttgcccccatcctgggtgtggctgagcagagagaaaacccactcagtctcattggaactccagcaggcctgcacagagcgaccttcactgggccacaaaatctgtctccatcacccttatcgccagagtcaggagaaccagggacccctttaagctggtgtcctgtgagagcagaaccaccacccaggatggaagccaggaaggcctggaagcagggcctctggggtgtgagaggagctagttacaaagattctggggttggggatggcctgggctggaaggccacagcctgtggcccaccctccaaccccaccacaggtacttctgcccactgggactaggcagagagagacatcaaagaatggctgtgccccgaccttgggccttcgccctgtcttgcaggtgcccagcgaatgcagctctcacagcgcctcctgcagtccagagtggggcagtgcactggagttcagcgccaacccagggggtaagtgaggcctgactggtaaccttggctccaatccctcagtccctccctgggccaggttctcccctcttaccttattccttgctccggtcctcttcccttgggtctctctagggacctgctgactccaaggcccaaagggtgggctgggaggttctgtgtgcccctgcagtcttgaccagcaaaggagtgatagtagctcctgcagctccccagctgatgcctggtggttgaccttctccacagagaggacaatgtccctgccccaggggtccctgtgaagtgctgagtcagtgctgcaaaactgggccgagcaaagggcaggtccagtctctggggagctccatcctgctccaacttgagtggctgcttccaaaccctacctactaggggagttcagaaaagaggcgcatacacacacacacacacacacacacacacacacacacactcacagagcatggggaaaggcagggactagggagtagaactccggagctttgtcattcatctgtcctggaaaacctctgtcaccccaagggtcccatcctctattctgggcctcaagaacccccactgctcacccaggtaccaccttcccacctccccttacagatcatctgctcacggctgaccctacagatgcccacaacctgcactccctcacctccatcgtggacagcatcacagtggaagatgtgtctgtggccttcccagatgaaaccatgcccaactgagattgtcttccaagccgggcatccttgcgagccccccaagctggccacagatgccactacttctgtagcaggggcctcctaagccaggctgccctgatgctaggaagccagctctggggtgccataggccagactatccccttcctcatccatgtaaggttaacccaccccccagcaagggactggacgccctcattcagctgcctccttagaggagagggcatcccctttccagggaggtaaagcaggggaccagagcgccccctcgtgtatgccccagctcagggggcaaactcaggagcttcctttttatcataacgcggcctctaattccaccccccaagtgaaacggtttgagagacgcagtgccctgacctggacaagctgtgcacgtctcctgttctggtctcttcccgatgccagtggctgggctgggcctgccctgaattgagagagaagaaggggagaggaacagccctctgttcccaagtccctggggggccaaacttttgcagtgaatattgggaaccttccagtggttttatgttttgttttgtttcgtgtgttgtttgtaaagctgccatccgaccaaggtctcctgtgctgaagttgccggggacaggcagggaaaaggggttggggcctcttgggggtgatttcttttgttaacaaagcatcgtgtggttttgccattgttttgtattttttttttttttttttttgctaacttatttggatttccttttttaaaaaatgaataaagactggttgccagaagagtgtcggtgatgatgcagagggagggaaatgactgacagccctgccccttcccactgagcagtccagacacaccctagtgggtggggctccacagcgctaagggcctcatcttgctggtggtcactaggcactggggacccctgctcttttcaccatgataaaggaaatcgagcatgtctggacctcagtctaggtggagaccagattccacagacatccttgtgggacacggaggacaactggctatgactatacttcaaagccactgctcacaggctgctgtgctctgtgttatgtcccaacaggtccgctggtttcagttaactgagcacctcgtaagcccagtgctcagcccacagccaaggtgcagagctagaagttgtggtttcccttccctagtccccacctctgccctggtgtcacaataccaggagccctgtagagaagtgggaggtgaggaagggggatcagacactgtcatttccttgcgggccaaatagcatggcccctccccattctcctccattcccttcaggccgaaggggattgtggttcctgcttgcagctcccagcatgaaggagattcagatttagctcggggagggtaaaggggtccacaaagaacaatcgaagagaagctggggttctcttcatttggggtgctattttcaaacattagcttcctgaggttagaaggtgggtgggaaattgagaacagagatttttgggtagacattacatgaggattaactggggagttaacaggagctagaattcaaacggaacatggacatctactgaaaactttattaattccaactgcctggggctaagttcatcagatttattgcaaattataagtttcagaatcatcaccgaagcagggattcagagcatggtacgttccagccctgcttaatccttcggggcccttgacaacggacttaacccagtgttgcctgaggctctagcgaccaccctgcaccagctccgggctcagctgggccatctctcccacacccaccctcctgaccttactgctggagaggagagttaccactgtgccccccgagtttcttcagaaactctgcctaaggaaaagaatcagaagaagcctctggaggctcccagaactcaggcgagggtgcagaagggagggtctcccccactgcctgcttgtcccaaaccagtcaggcagggcttattgggaattgcaaattggcctactctgctcccattggtgggattttcttcttttcaagttggtatcactgagtttagtctttcccccttggaggggctggagaggaagaccaaggtcatttccatgactcttagccctgattcactgccctggggaatgaggagggcaactgggtgggctgcagtgccttggctctggaatctacattcactcccttattaccctccgaaaatactcagaacacattcatggaggatcgtctcccttcaagttcatttcctctgcccctggcacctcccacactcccagggtggaaaccaccctctcccctgcagctatgacctgcccatcccttgccctccttcttactgggataagaagggctggccaaggaaggcactcagctctgctgaaggacaggttctggggctgctggatatattttttaagtctgctcctcttcagttatcctgacaattagacagtgagggtcacattcagactcgggaaagaatgaacagtcctcagcactgtagtcactgtctacttactttttcatgtctttaagtccttaagggaaaaacagtttgctagaattccacaggtgtgaatggcaaactctgctaagcagcaggccagcctcactcgttattttcacagaataaacaattgttatcgaagcatggggactttcttaaattagcaaatgc

SEQ ID NO: 12103 - DNA, 8059 bp, Human
cccaggctcctgggtgaattattttatcctcccctatgcgctttgtcagccaagtgaatgtagaaaagcaagcaaaactccagaaccccacaacgattcacgccacgcttcggtggcacaactcttttcttccccttttagattagtactgtgcagggaaggctgcacctgctaccttcagacaccggggatctggctaggaccctcttcctctacccctactctctcctcccgtccccaccctctcccagatgcaccccaatccagcctctcaaccctgtcgctgtttgcaaactcgagggatgtttagtgcaattgcctttaaataagcaattcacgtaagaggtatttattgcagagggtttcaggtctgggagggggtaaggagttagttaatgaaggattagaggcaaagctgggaaagaacgagtagacaggccagtttctttctttctttttaaaatctattattctggaaaacccttgttcgaaaagagtaaagaattgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcacggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaagccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaatt

SEQ ID NO: 12104 - DNA, 23704 bp, Human
atcttagaagcagtccctgtctggaaggaatgactcttcagtgatttctgaagaggtgctctttgcctggcctcttatgtccagccatgaaggtggtggctcaccagcattcatgctgaaaaccacaatgatgtctacctgtcctttccaggccagggctgtcccctggactttgtgggttacacaggaaagaaattcacaggacagatatttttttcccccatgaatgaatgaattagcttcagccgatcttggaagtcacctacagactgctagcgtgctctcttcatgagcactgttttttgtttgtttgtttgtttgttttttgagatggagtttttgctctgtggcccaggctggagtgcaatggcgctatttccgctcactgcaacctccgcctcctgggttcaagtgattcttctgtctcagcctcctaagtagctgggactacaggcgtgagccaccacgcgaagctaatttttgtatttttagtagagatgaggtttcactatgttggccaggctggtctcgaactctcgacctcaggtgatccacccgcttcggcctcccaaagtgctgggattacaggcatgtgcctggcccacaagcgctcttgatctcccttttgtttccataactggggagggtagtgagattttttttttttccaggaggaaactgaaatccaaacatggttaagatttgggtgttgggatagactttgcagacacccccatcaactctgtgctccagggtcttgatgtctgggaacgaagaaatggagggaacaggaaaggggtaagcatgggggtgggtggcatgcttttggggttgggaggcatattatttggacttggcaaggtttctagggcaagatgaatttggtcctagcacatggatgggtacacagatatgagtccatttcaccacttttctatttattcccttctacaaaactttcttgaaccctactgtataccaggaattcagagaagaaaccataatccctgcctgcagagctcataagcccatggagacactcacagtctggtgaagtctatattgttgaagatgcatctgtttgtttgttgatgggtgtcagtgtgtgtgtgcactcatgaatgtgtgtgtttgtgtgactgtatacatgtgagggcttatgcagacacgactgtatacatgcatgtgtgaatgtgtacatatgcgcgtttgaatgtccggatcacatatgtgcccgtgtgcatgcctggagaggtgcatgtgtgggacagtcaggtcggcaggagtgcatgagaacggtgtgggcacacgtaagtgcacgatcacacatacaagtgagcttgagagtgtgtattcctgtgcactgtgtgcacacctgtgaccccttcaaacccctcatttgagaatcaaatgatgtcggaatggactccaccttgaatgtcgatggccgaggtaagggcgcctgcgcccctcccctccccctaggcctctgcccagggatctcctgcactgggaaggggaggggtggggatggggtggaggtggggtgatggactgagatgaagggcagggagggcaagcgggcattcttactgatagggggcagttagggagcaaggctccagggagaaggtgaagccagaggcggaggaagatgggtaagagagtgaaccctgtggcgggccgcagccggagaggaacaggaaccgcagtggggacgccctggtccccgggcccacagcatccgggacggacgcgcagtagcgcgggccgggaactgggtaccagggcgggatgggtgagaggctctaagggacaaggcagggagaagcgcagcggggtgcggggaaccgcacgccctccctttgcctctgcttcccaccccgaggcggcagggcgggcgggcgcggttccgggggtgggcgggctgggcggggcggaggcggggccgcagcactggcttcacccagcctctcccgcccgcagccagagcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgagtgttagccggagggggcccgctccctttcccgggatcagaactccgagaagagccgggcgccgccaccaaggaaacagaacagagcattggggtcccagatactgagggtgggtggtgggaaaggacctctgatgccgggaccacgaaggagggtctagggttcccggagcgcagaggcgactctccagggtggagatgagggcaagaccggagcacggatgccggtcctcaggtaccgcagggggcggtgggggagctgggaggggtctttcaagagggggcatggggctctccgatgcccaggttcttcggaagaggacactcgaatgccgggatcccgaagggactttcccctcagcatctcggtctctggagagtcgtgggacagaaccaaggcgagagaaggagggggaactggacggggactagagatgagaggggcgagctgggctggggcggggagcccgggacgacgggatggaacaatggaggaggtcggagggactggaggcagaggggacccggcaaggacaatggggaccggccagacaatgggggggaggggcgtcggagggagaggttggggagcgggagagaggttgagaagtgggttagggagggcagaagaggggcgacggcgagggcggcagagagatggaagcagaaggaaaggagacagagcggggcgcggaccctgaagtggtcggggtcccgcctgcccgctgagggacagtgagacgagaagagagagcagaggcttggacatttccagcgcctgtccccgcgctcctgctcgcggcctctcccagtcccggaattggggctgcggatctaaggctgggaggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgcagcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcccagtctggctcaagcgcctcgcttcttccctgggggaccgcgtggggaggcgggaataatcgcatgtgctgagttcctactaagtgccttgcacttccctggtagtttctcttgaattatttaatccttataaggtcctagcaaggtgaatttagttattcccacttcgcagttgaggaaacagaaccttctagactttcaggcccgagaccaggctcccccagtgagtcagtggtggcgtctttgttggaacccaggatgcttggcctgggatgttctctttcctacatatgccaggctccctcccgccccctaccttctagatcatggaaggagtcgtggctctgagagattaaatcgtgccctatgcctttggccccacacatttagatctgagccccttctccacacgcagaggccctgccccctctcaagtctctatgctacattatcttgggtaattagctcctttcctcccaactcctcccctatccaaagggagtgaggggtatgtgccagtgcctcccctgggtttgcatcgacctcaaaaggccctccaggtgtttgaaaatctctcccatcccatggcggtgaccacggccccattcacttaagagctctttgctgaagctgttggaatggccagggctgattatactgaaacattcgtatggtttcaaatactttcaactgtttcgctgtttctctcttttctctaattaaaaaaaatgaaaattcttaaaagtcaattcatctaaggatccttccaccttagttccttgtaagccttgaaatggccaaaacaaaaagattacaagcgttcttaaaaatgagatgaaatcattctgtcaaatgtgaaatgactaagtgtaacacatacaaatttcagggaaatttatctgtcatccctataaattaatccttttggatctgattttggagcaattagcctgaatgttagtcacccctccctacttggctaaactctcccctcctgcctggggtctccttaagatgagatgcttctttgataactaacatttattaaattcctactgtagaccagacatatttgcataaattatttcacttaattctcccagcaatcctgggcaatagacattatcaacccaatgttttaggtgagaaaaactgaggtttagggaaattaagtaatttaccctaagcaacatactattaagaagcagatctaggattttacaacatagggaacataaaacaaggacaggaaatgcatggttactaattatctggcccctactccaaatgcagtttttaagagaagagagaggacctcaggctgcagcagggagaacaggtttcttggcaggggcatttgcacaaagcccccacaccacccaagaccactgtagacagatctcctcagctgtccagagcccaacaaactggaacacagccaatggccacaaagtagaccctggaggacagaaaagaggggtcccaaagtacataaataccttatttacttgtgtaatacttacagcaatcctatgatgcaggtactgtcatcattacctaattatgacccaggacaagtgtggagccaggattcagagtggcgtgagagctcacagattgtattcagaggcttgcctcctcctggttcagatcctatttacatacctttatattttttattatttttattttatttatttatttatttattttgagacggactgtcactctgccacccaggctggagtgcagtggcacgatctcgactcactgcaacctctgcctcctgggttcaagcgattctcctgcctcagcctcctgagtagctgagactacaggcgcccgccaccacgcctggctaatattttgtatttttagtagagatggggtttcaccatgttaggcaggatggtctcgatctcctgacctcgtgatctgcctgcctcggcctcccaaagtgctgggattacaggcgtaagccaccacgcccggccggcacatgcctttctaccaaggcgagttccacagtttctgaagattcaattagaccttaaatagattagcgtggtgggggaagggttgcttcaggtcacactctggtagcagcaagaagtgacaactgataccttgacaggaagggaggaaacagaaaagctatattaaaaaaaaaaaaaaggctgacaggagaactcaaaaagacaaaagtgtggtaatttgggaaaagaacaaaagagtttccctgtattgcagcccagagtaatcgctggtgtaaatacagagtccctgagtcatgggaagccatgaagctttgctccagagacagggaagggtgcagccaccatggtgaaaagcaaaaatgatgagagcagcaaagcctggcagtctggaatctcggctaaccaacagtcgctctcccagagttctggttaattgaggtcatacagtattttcatgtatttcaactccacgcgtgtatgcattgtgtccctactgcatgccagataccgcatcaggccctggggcaatccagctccctcagggagctgacagtccaatgagggagtctataaagttcaggccagacaaaagcagagagaaccggagaacaggctggatgcgtaacatggcagccccacctaatctgtgagcggtgggtgcaacaggaccacttccttgaggaagtgacatttaagcagagccctaaaggatgaaaagaaatcagaacaggcccttctggaatcttgcctcttgagggaaagcctgcatctgggaccctgaggctcctggtctgcagatgttcccagcactgagtgtgttgctgccctggaggaggtgcggcaacaccaaggttccacctcctctgttgcctgtgcctgtcctgctggtctcatgaggaccacagactccctcctgggttgatccaacctgtctatccccctgactcctctgtttccttccccaccaaaccctgatgaggccgcaggatattttaaaaggctggagggaaaggagtgtcttggccatgatctggccaatgtagaagaagcagaatgcccaaaacaagcttgtaaagcttccctctggtcccacgaccccaaagcccatacttctcagcatcaaatgagggctgcatggtctggagctagcaaagcaggctttggagttttattagacattaagttttttttaaaggaacagaaatataaagcaagcctccaccagccccttcccctggggaatctggtgttaaattgttacatccacgagcaaagatgcttcagtggcaggaacctgactcccctttcccttggttccagccctgttcccagtggccacatgggggagggggaggactggtggctggaaatcaaaccgtggcagggcagggctgctgggtggtgagagcagccactgtcccatcattgataacagttctccctttctctccatcttggtgcgaggcttttgccaaatggctggccttttgccctggcaccaggctgttgccatctctgtagagaaatgaagactcagagggaagatgggcaagcaagacccccagtgtagagtcaggattcaaacccaagaccctggccctctcctttctgctcttgggcatggacatcttccatttattatttaatatgtggaattaaggacctggagtaaggccctgctggcctttgttagaaaaaggccctcctctgggtagatacaacccagcaggtgcaaagcttagcaaatggagtttgggataggtttcagctctacttgccccgttggctgggagccctgtgcaagctacaacctgtccaaccattcatgacatccctgttggtaggccctccgctgggcctccggccaccttccccatgtggtatatccttgggattccaggagttgctgtaaccccaggatgaactttgcagaaggtcagcagctgaagctctgacctcacacccccagcagcctgcacgggcacactgtccctcacttgcctttcccctgtcagctttgatgttcctaacgcctccctggtgagctcatcccagcccaggtggttctaatagaaggcagtgggaggagggtgtttgattccccggaagaaccccccccaacccaccccagctttctcttgccagtctgaccctccgatctccctccatccaggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagtgagtagagggtggcgggcaggaggaggggagaagaatgggagggaggagaggggtgaaagggaggggcgctggggagaagcatgcccagtagaggccttataagaccaccactgtaaggtcatcagaagtgggtctgacccagtgtaggaggcgcttctcccagattcgagaagctgagaatggagaagggaagtgtgcagagggaggaggggaaccccatgggggatctccaaggggtgcccattcccagctctggagaaggcagaggcttggtagaagagtgtggctgggcagggaggagtagctgatgctaagaccagctaaaaatatcatctgcactgcaaaatcaatggctgccacttatccccggtgtgtttgggggaagggagaggaggatcaaatcctggctgccctgaaggctgaccttgggggatcctgggggtgtggctgttcctccctacaggccaactcttctccagctttgaccaggaagcagagttttcccgaggcagcagggatgggggtcagagcgccatgaagacgtccttactgtggggtgacagaggggaggggagacggggagctgtgcccattcctgcctgggatttcttccttccttccttccttccttccttccttccttccttccttccttccttcctttctctctctctctttctttacctttctttcctttctttcctttccttccttccttccttccttcaacagagttttgctctgttgcccaggttgggagtgcaatggcatgatctcaactcactgcaacctccacctcctggtttcaagtgattctcatgcctcagcctcctgagtagctgggactacgggtgcatgcatgccaccatgcctggctaattcttgtatttgtagtagagatggggttttaccatgtggaccaggctggtctcaaacttctggcctcaagtgatccacctgccttagcctcccaaagtgttgggattagaggcgtgagccaccgtgctcgaccctgcctgggatttctttcaggaggggagagaatctcatcttcctgggctggtgggtctgggccccttggccccagtcttgtccagggtctgaattccctcatgcttttgagtcaggagtctcggtccctgatcggtgcccccagtcctcagttgctgcctttgggccgtgggctccctgcccttttcctgactccctgccttctacctggcactcgatgcccacctggagggctcgagggaaccatactcagattattctttaatccggctgggaataaggggatagagctggggcctctgaacccacctgcggacctagtgttacctctggatgtcccccctgagtctatctgtcctccaggcaaccccaactcttggtgttccccagacacactgttttcccatctctgtgcttgtggatcctgtaacaccattccccagccaagaaatgcctgggcgtatgtgtggaggtgggacatcctccaatgcctttgccgtcttgcttcatggccacctgctctggccctggcctaacagggtttccattccagggcgggggtggccaaccatcagctatcccagaacctccaaatctgcctctcttgcttcctagactccagcccaggactctcctcccaggacctaaatgatgggaaccctttcccttcagtcaaaggaccttcagcaggaggtggggcggaggacaccaggagagggaagttccagaatctctggaagggaagggaggcaggcagagaggtggctttgagaatcctcccttccacttcctccctcccctccattttcccctccttccctgtctccccctcctccacctccagctgcattaacaggctgcctttacaagcccactttatgggacggagaccccagcggactttccctctacccttaaaacgtttccacaaggaaacctattaagcccctgccttcattctctgccaaaaaagaccacatttttcacaccacctaaaaccctctcccaggagttttctgctaattttctgtgttttgccatgagcaggcttctcctcttcccctcctgtgtgactagacttaccctccatcacacgccagccagccaggaccctcttgtttgtatagctcagacatcctgcctttgctgtttgtgtttggacgttctttctgctgtctgaccatattcctacctccaaagttcaatgtcctcatcgctctccacccccatggggcccaatctttataggatcccaactacgtgccaaagctttatggctgaatttcatttattcctcactacaaccctgtgactgcagatattgctccttatttttacagagaaagaaaaagctcagagaggttaagtaaaacacccaaagtcacacagcttataagcgatggaaatggattttgaatccagatctgcctgctcctaggaaaagggacacagggttcctctgtcagaattcacttgaaactgaagtctccctccaggcccttcttcctgggtcttttcttctctcctctaccctttttcttttctttttctttctttctttcttttttttttttttttttttgacagcgtctcactctgtcacccaggctggagtgcactggtgcagtcttggctcactgtaacctctgcctcccatgctcaagcaatcctcccacctcagcttcccgagtagctgggattacagacgtgcaccactacacccagctaatttttgtattttttatagagatggggttttgccatgttggccaggctggtcttgaactcctggcctcaagtgatctgctcgccttggcctcccaaagtgctgggattacaggagtgagccaccacgcccagcctttgtccccagttctgcccctttcacttctctctggcttttccttctttgccttctcatccccccaccacacccccgaagccagtgaccccttgctccatcttgtctctgatgcctttgaataatgttgagacccccctacaggcctcagtttccccctaatggcgctttagcctttctgcttctgcttccacattctgaacaatctgtccttccctggttctcaggttcctaaatctatgctcttcctgtccttggagcaaggataggtcctgccagatccagggtggcacagagttccccacccaaagctggaaggggtgaagaagatctggccctgttccttcccctccctgtacaaggaggcaaggaccctggcgtgcccagcctccttctccttattctggagtgcacatccagtaattaagaaaacatgagtgaagaatgagcttggacatctcccttgcatcctggccgaaagggcagacgacgcatgtgcagatctcaaaagggtgatcatatagttgtgcagcttgtgtactgctcaacaatatccatctgagagagtgagtgtgggctaagagccagctctctagcttcagtggctcctgccttacctgagccctcttgcctgcaggtccgtccccaccctcaggatccaagcccttcagcagcatgggggtagtgccatgggtgggaaattctgctgtctaaccccggtcactcccatttaggctgcatctgagcccacacctgtgtggagaggaactgaaggcagatgaggcaggaggctccctaggggaaggcctaccttgcctggaccgggttagcagcccagctctggcccgcggggagggctgggtgggaaccacgttcagattattccttaatcatgctgggaacatagtacaggcctgggaactctcaaagagaatttgccaagaaacttagcggcaccagctgggttatgccggaaagcctcccggccggccagtgcttctggagcctggaggatgcggctccgggcctcctccccctttcccagttggctgccaccaactttcacaggctaggggtcagggtcccttggaagagggtgggagccgatgagaaggctgaaggaggaagtcagcgtcctggcaggcaataggggagggagagactccagctcctgcgtcccgggtgcccaaaagagcagacgactaaatctggtgtccgctgcgctcaggcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgagggtgagtgcggttcggggggcggggggagtgggggtgcgggggtgggctgggggcataaggaagggcgctctctggaggtcgacaaggaccctgcctggcctgctggggcagcttggtgaccttgaggcagcgtgcaccttccctgagcttcagtcctttcctggtaacctaagggaggaggtcattccccatcctgtctcagcaaagaacccctctctgtgttaccttctttgggctgtttggaaagtgggcgttctcagcgtcccaggccgcgggtactacattgtaactcatcctccgggacgcatttctctgtggcttcccgctagtgattagctgaacagcaagcagctcgaaggtggccactacccccagggcacagaacgggagaggtctgatccatgaggcaggctttctgaactggaagagcagcttgaggaccctcaggagctgggaccctttgactctgagccctggtctaggtccatggtgggttttggctctgggacctgagatggaacccaccctgtccttgactgacgttagggagtccactcctgtctctgggcctcggtttcctcactggtcatatggctgccagggttgttgcgggttagggaatacagtggggctggcccacttcagcttgccctgtctaggggaggggtcaaccgtgttccgcagtttagtgaaggatgaggggcatgcagggaacactaaggaggggctctgtggaagaagaaggaggggaggggcagacctggggctcaaaagcccggggacaaggcagtgcatgctcgtggctgtcagctccagggatggatgggagctgggcgtgcccaccttagccaagcacaggccccaaggagatggggtggttcttgggatgggagaaggaagccccgtgggagccagggcagagctgttttggtctctggttggtgacgtccgtctcaggggagactggtgggcttttccacttcggggagaggctggcagtgcctttacatcctgtccatcatcctgtggccatgcacacattgagctatttccctttgagaactaacctgcatcctcaggttgcctttaccctgagcaggcaatatagtacctccttcagtgagcccccagtttgatgggagagatagccttcgcccagtctaatgagagagacgtggtcccagcacttagtccccagctgaaggagagatagctctcactttagagatcccccattctgatggaggcagcagagcttctgcctcagttagcacccagatctcctgcccctggggaccctccagtctgataggggctccaacccacacctgccttccaagtcctgccatctctggctttaggagctcaggatggggagggctgttacgctgggctaaggccaggttgagctcaaagcttcctgccttggagaaggaatgaggagtaggatgtggtggttctgttggcaattgccctgggccaggagacaggcaagtggcatcaggcgccaggcagagcgcaggaagggtttcagcagccaggcatcaggcaagcaggcagctcatttctgtaggcaagtccagaccagccagctgggggcggggcggggggacttgggggcgctgctagagcaaagaaaggtggtgactgtgggaggagcaggctttgtcttttggggcattcacagattcctctcagataccagcccactttcccagccaccccgaaggaggagggtgctcctgagggagtgttcataccagaccctgttcccctttcagcttcaggctctgaagggttaaatgtcagctctgggacaagagaccatttcaggaaatggaatttgattcttggttttgttgccccctcccctccagcgtaccatactttccccgcatttacttacgtttcaggtgtcaacatggtgactcacccaccctcagggcagaagggctacccgctgccccagtgaaattcggtttgaatagggataacctggtccctccatgcagcccggaaatggctgtcaggacctgccaagggcttagtaggttggaatgctagtggacgtggccacatctggatctcatccccccgcccccgtcagaggggattggagagatgagggcagctccccaagagtcagtgccgcctctggtctggccacgccttgctaccctcccagccttcccctaccatgctctgatctcggtgatggtctcattcattgggcacccggacatgtacactccttcaccctctggcttggggtcagtctgagctgagctgtgtctccagcctctggacttgggctgccccccagcttgcccagtcccctggcagagcaagagaagaccctccccagtccaatgctccacctggggctgccagaagacagggctctgtctccttcactacctctggcccctcccaggacggagacggggaagggtggtttgggtgacagatggcagcccctcactgctggcagccagatggattctagattcacatctgggggctttgcccctcagaaggtgctgaaaacgggcctttgaagcatttcatcttgagtggaagaggccagaagatgggtggcagcttctactcctgcttgggtgggcaaagtgggggctgggagggcagagctgggagccagttaccctccccttcaccccattggcatgtcctgcctgctttccctccctgccccaggcgtgggaagtgaggagggacggggtaggcaacattgcccagacaagtatccccaggccgtccagagcccacaacccctagcactgcccctggctgtgtggcagaatggaaaatcccacccactggtgccaggaagggctgggtcccctgccagggaggctggcaatgcccagctagcatgagagggtctaggtgggtggcaagtcacagtctccccccgccagctgaggcattgagctggacctgcctcatgggccccttctccactggctctctgcttcctgaccaaggagggttggggctacctgatgctgtcatctctggttggcaggatcaggctaggtgggagccaggcaagacaggaaacagaggctggccactgtccaagggctggctggagggaggcaatccagctgcccccgcacccctcctttccacccaagcctagagcctgagacatgaggtcaaaaagtcggggagtgctctcagggaggtggtgtgggggaagcacctctctgaccagacctgtgtaccctcttctttccttaggacaggagtgactagggtcatcaaggacaagctggggccagagagacatttcccagagtgactccagctcaaggcctccctgtggtcaggcttctttgtgtgtttgctcctagataggcctctctaggtactcaggaggtggaatagaattccaggaccatagccccagatggaagggagcttagagactgtctctcttaatagccccattagataaataaggaaatcaaggttctgagagaaaagggggctgggccagagtcacccagcaagtcagtggcgaagctgaaggagatgcagctctgtgggcccacaggccttgctctttagcatcatgacatcatgcacgcaatcccagctgtgcataacagctgggcacaagagcacctggagccagggcggggacacaggaagaacacggcagtgggttagagctaaaagggaggagtgggggaagtgggtcctcactcctgtggccttttctcccagagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtaagagagggcacggtggcgacagagaggggagatgtttgccctcaaggaagactttgctgtgaccttgacctgaaaacatacacacccttttaactcaaccccaaaccaagctcatcctcactcatcatctgccgccccactccagggtgcagcaggtcagcaggaggtgaggggagaggatccacctgtcctgtcctgtcctctcctgccctgtcctggctccagcccctcccactcccatgccgcaccactccctgactccccacccccaactgcttgtgtcctcatccccaacctccttcaccccacagtcacctgcgtgtgcatatgtctcttccccttcgcttgtcacactgggaatgctgtggcacccacatccaggaatccaggatgtgcacgaactcccagaaggcattttaaagctttaaatgcattttccattctttctaaaaaaaaaaaaaaaaaatcatcaaagtaacacatccgtgtttaggaaaatgcaaacaagaccaatatctttcaaagcaaaaagtaaaagcccccttttatctccccaaatcctacttctctccttattggaatctgtttgaaatggatccttcccaactattttctgtgtgtctttttttataaacatgtatataaaccttttataattacatgtaaacatggagggctttttaggcatcagtgagatcacattgtacatattctacagcttacttttttcactcaatctccctcaggagacctttcctcaggaatgtagattagctgatcatttgtaaccactcattcaatagtatggatggatggtaatttatttagccagtccccattgatggacatttgttttttttttttttccagttttttgttattgcttataattgcagaggaaatccttttatatgtcactgcccacatgtgggagtattttagaagggtagattgggagaagaggagttcctgagcagtcacttttgctgcactgctcattccaggaacatttactgaacacttacagagggcccctctgccctcatggagctttcagggtaggtgggggcagatgtgcaaagaggagccttagatggtggggtggcggttataattgggcacccgccatgcccctggccctcacacggcagagcacagatactcagctgcatcggccactacagcccctcgccccctgaaacctggcctgtcctctggctccaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccagggtgagcagcggcccgctggggagctgaggcggagctgaggctgaggaaacagaagcaattaagattagactccaggaaggactgtcgggggggcggcagggctggctcagcggtgcccctgtagatggatggagaggctggccgaggggaatgggagggagaggtcctctctagaggaacgacttgggaaatggaggcttttacaagttggagcatccagactcatcaagctaattgtcccccctgggggctaattattgcccaaagtagctgcaattagcctcttgccctggacttctggggaacaagtagttaagtgtgtaccctaattagtggcccatagcccagctccgggacacttgctgtagttgtctagaactgagaagccctatctcctcctctgccatgattaattgctgggggggaagagaggagggatggggatagggattgggctggagtgacaggaggaagggacaacgagtccccccaggtgccttcacttcctggtgccccacccaggaccttgtcttggccccaggcctccagatggggaggagcactgcctcggcccttcttgggtctcaccccagtgcccactgttggggaaaggagttcaggggtaggacctgactctcctctggtttctctgcagccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagtgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggaatgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcttgcaagtatgttttagcatgtgtttggttctggggcccctttttactccccttgagctgagatggaacccttttggcccccgagctgggggccatgagctccagacccccagcaaccctcctatcacctcccctccttgcctcctgtgtaatcatttcttgggccctcctgaaacttacacacaaaacgttaagtgatgaacattaaatagcaaagaaagaaaaatagtacaaagagattttctggaaatacacatggtttgaattgtttgggattgggtgtgtggcagggacccaggtataatttccaattcggtcaattcctgccctcttttcccccacaccaaaaggggaagttttaacagaaatccagtaagttcccatgtatcactatggggtgaggtggggaaggagaaggggccctttgctcccagatcttggagagggaaagtgaaaatggccacgcaggaagctagccagctgtgaacttgaccagatgtcagaagtgaaactgaccacaggcaagtcagaggctcgccaggagggccaggtcacaaccccacagctcccagccacccacgtggcctgggagacacacacacacacatacacaccacagagagagagagagagaatctggctccagatggcctagcaggaggcattcggcaggcctggcctggagttaggcaggcaggcccctcccttgtagctctcgtgggcaggtcctaacccaggctcctgacagcctggcttcgagccccgcctggcccaggcctgggagctcccagggctgtagggctcctggccctgggcctgtgcctgtctctgaggctcagcctcagcccctgctggttgtttggccaagtcctccggggagactggcttgtggtcactgaggaagacaaagggaggcttgctcttccagtaaaaacagcaaacaagcctgcctgacctccagatccagggagaagggccagccaggcccagccagagtcagacaagggtggaggggaggttctctgtcttccattcccctcctacgcccccagactgtgaggggtgtaaggaagatggaagatgttgcgggagggattcagagtaggtaagagaaataatcctggtacttggaaaatcagtgtgatgggaaagacaatctctgtcttgagcgaggctcccatctaatgaaggagacagtcccagaattgaggatattctaacctgatgaaggaggcacacctcctatcctaagggtgcccccatgctgatggggaaatatactctttgacctaagagtggctctccactctgccccccactcttgtctggtgggggaaaaccagatgctgtcctgtgaaataaggagaactcaaatccctgccttcaccagccttacattcttgagggagctagagcagaccggccctctatggtgtgtactgctataatagtggggggatcctaagcaagacccacccacaccaggggtcagggaaggtttgccagagaagggatatggaagctgagtctttaaggatgagtggagttaactagacaggtcggggggagagtgcttctggcagaagaaccagctcagcaaaggccctggagggcgccagcacagagcacacgtggcctggggaggctctagggcccagagcccagagagtgagtaggaaggtgatcagtggggcctcagcggggagggcttgtgaagagacacactagggggtctggactacattcttggaacactggggagccactggggggttttaagtataggagtgccatagacagacttgtactttattattgattattttttattttttaaaatttgagacaaggtctggctctgtcacccaggctggagtgcagtggtgtaatctcagctcactgcagcctcaacttcccaggctcaagtgatgctcccacctcagcctccagagtagctgggagaacaggcacacgccaccacacccagctaattattttgtattttttgtacagacggggtttcgccatgttgccccggctgcttttgaaattctcggctcaagccatcctcctgccttggcctcccaaagtgctgggattacaggtgtgagccaccacacccagcccagacttgtactttagaaagcactagctccagctgcagagtggagggtgctgggtggagcagggtgggctgagaggtgggagtcagtggcg

SEQ ID NO: 12105 - DNA, 8302 bp, Human
caggacagcctcagcagctggagctctgacaaaatgtcctgggggcaagggggaagctgaaggggcagtgctgtcaggggccagggcctgcccaccctcagggcgccttcctgctgcttgtccctgggggagggtgggctccctcagcacggctggaggaaagaaacacaaacatcacaccctggactcagtcagaggcaggaggatggatggacgggcaggcggggggttgatgtgggcaagtgtgagtgcacgcgtgtctgcatgcacctgtgtctgcctgcaaaggatcccctaccccggggctttggaggagctcagggccctagctactcaccattcccaggacagtcccagagtctcccagcagagggaatgagtctcctcgagtctgcaggagtcggatctggaaaatggagggaaaaatggggaaaaaaacccctctcttcttggtgaagggctgaaggcaagtctctattttttgagatggagtgtcgcactgttgcccaggctgaagtacagtggcgcgatctcagctcactgcaacctctgcctcccgtgttcaagcgattctcccacctcagcctcctgagtagctgggactacaggcatgtgccaccacgcccggctaattttttgtatttttagtagagatggggtttcaccatgctagccaggatggtctcgatctcctaatcgcgtgatccacccacttcggcctcccaaagtgctgggattacaggagtgagccaccgcaaccggcccaggtctctttatttttaaaacccagtcactgggccaggaaagggaaggggactgatcttggaggtgagccacagcccaggcaaagccacaccacctgagacgacactgagcgtgcaggcggtgaagtggtcttgtccctgagctgagggtgctgcccacaagaccctgttcaaacctgatgatggggcttagaacaagggcaacaatctgcccagggccgctgtgccaggctggcagccacacaggtgccgccactgcccagtgatgggtgctgagcccgcttccttcctgtggcttctctcctgctttgggcacatctgacacagctcaacaggctggtatttctggcggcggtggactggctcattgagtgggtctaaggtccccatcaactcaacagatttttattaagcaacttctccatgcaggcacctgagagctaggaggaatgagagacacagtctctgctctcagaatctgccatccagtgaaacagctgggggtgtcaacagctccctccattgtgagtgtctcactcccagtgccaacatggggtcccagaggaggaagatgcaggggaaggtgaggtaggaagagtgtgggtggcagctccaggcaggtcttggcgggaggggggcctggaggctgtggtacctgagcatgcaggggaggagacaggggctggggcaaggcggggtggggaaagcaccaagtgcgcccgggacagcctggaagcccgtcctgtccccagtaactggaggacttagccctacttggtgtgccacggtggctcagaggcaagggggaccagagaggcaggcacacccaggaggcaggagaggagctcagagcgccctcagctgagacaggcaatgcagcacccagaggaaagcaggtctttcttactccaggccacaagccagggatgaggagggcagcgtcagcaggcaagggctggtccagaagtgtcctcatgcccagggccaccacagccccgccactgagctgccgggcatggcctgcagcaggcccctcctcaccttctccttgtgcagggcgttgttctccagcccatccacctgcagaagtttcttggccaccccaacacacggcaggtctgtaaggacgccaaggtggcaggccaccccaaagcctgccagagagaaaggagggtggggttggggaggtggggctggggcctggcacagggattcaggacaagccagtcttaccaaaagcttccctaagtgagcagaggtctgtggacaggcagagggctggggaaaccagatctaagtcccaagcagacctgggcgaaagccccctgtgcccgatgtcctgggtgcaaggccgtggaggaagcctccttctctctgacacggtcagtgccagggtcagcacctcgctggcgtgctgggatactgcagctctccggtcatttcctgcacctcccagcttcctcttccctcgacggtggcctgccagcgctggcacgagcatgtgggtcggcacatgacaaccctttggctctgcacccatgtgcgagggcagcagccagggccgagtcacacttgctggccaggaaggcccaatgtcacccctcctgggccctctctgggtgctgctgcgccgcccgcagctctgtatgtaacagtaaaagagcccatctccctaggccgggcgcggtggctcacgcctgaaatcccagcactttgggaggccgaggcaggcggatcacgaggtcaggagatcaagaccatcctggctaacacgtgaaaccccgtctctcctaaaaatacaaaaaaattagccgggcgtggtgatgggcacctgtagtctcagctactcaggaggctgaggcaggagagtggcatgaacccgggaggcggaggttgcagtgagccgagatcgcgccactgcactccagcctgggcgacagagcgagactccgtctcaaaaaaaaaagagcccatctccctcagccacgctccctaggccaaggttcctggcatcagtgggggcctgggtacacctgtctagttgtggacaaggggcctgacgggccatgcaggttgggcggctggcagggaaggccactctgagcccgggccctgggacatcttttggtgatcaggtcagaactggatagtggcacctggagatgagccagcacagggcactgtagagaaggcagtggcggacaggaaagaggtaaggggtgaagcgaaagtagacagtcctttaccggcggtgggggaggcggggctgagcgcactgcgcgtccccgttgcgccgagaaagaagccattggagggggctggcggcagaggccgagggcccagcattttctgtgggggacgacagaggtgccctctcccccccctcttccccacagtgccctccctggacctccaagagcaggattacctcggtggtggagtaccccgtttccatccacaagaaggacctatggagccacagggagagtcacagtcagctgagctgcccctcggccctcaggacagggccatccctgaggcaagaagggggcactgtctctggggtccagctttttagaaatcctcattcctctcttccaggaagctcatgagtctctccctgccactgtggtggtggcgacctgcagcagccttccctcccccagggggaaggagggacctttctctcgtcctagggatgagacacctgcctggggcatgaggcccggctccttctcccgcagctgctgcaccagctccagcaagaagggcacctctcggaaggccaggaagcccgacacgtagggggctgtgaggctgaccatgcggctctcctcatacaccacctgacaccaggcacgcagctcagtgggaagcacagccttcggccacctgctccatccccagtccgtccatgccctgcccccctcatccttccctctcccttacgtcaccctcatggctccccttccctgcctcacctatgagatgatgggtttggaagaaggaactagaagatgtaccctgcaaattggtggtgggcaggtacccccgggacctggtccataggagcagacccccccaggacctggtccgtagcagcagctcccccgggacctggtctgtagcaacagcacccccaccccgcccccaccgggacctggtccatagcagcagccccctgggacccggtccatatgagaacccccaccccggacccggtccactggaggagccccaactcccagacctgatgtgtatagtaggagcccctgggacctggtccataggaggattccctggtatctggtctgtatgaggagcccccaggacctggtccataggaggattccccgggatctggtctgtatgaggattccccgggacccggtccataggaagattccccgggacctggtctgtaggattccctgggatctagttcataggatgagcccctgaagcctagactgtagaaggattccctggaatctagtccataggaggagcctccgggacctggtccataggaggattccctgggatcaggtccgcgggagccccccaggacctggtcttcatcagaagcaaggctaaggctgctggctgcatcacctctgcctgccccttgctttcctggtgtctcctcctttgtgtattgaagccgatgccccaccccacccctccatgggttgttggaggcttaaagaagacacagtgttggccaggcgtggtggctcacgcctgtaatcccagcactttgggaggccgaggcggacgatcacctgaggttgggagttcaagaccagcctgaccaacatggagaaaccccgtgtttactaaaaatacaaaattatctgggcgtggtggcgcatgcctgtaatcccagctactcgggaggctgaggcaggagaactgcttgaacccaggaggcagaggctgcagtttagagcacaacatggcaggcctgagtctcctaaccttgtgttttccttagtcacactgcccttaatgtgaagacgtttcccactatgtccacattctgcagacctgtctaccttcctgcagttttgttactgaatcccccaaatctcttggtgacagctttcaaatcacaacttccactcctcacttgtggctggatcaataattaaacacaccaaagcagacggagtgctctgtattagcacagagggttggggatcattctcacaacatcttcatcaatgactcaatggggaaactgatcaaatctgcccatgacccaaagtggggagggtccattctgataacagaatttgggttcacagagaagccagcaggctggatcactgacatccccacagagtaaaagtcactttgcacagtgacatgtggaattcaagtgtggcctgagttcccacaggaggggcgtggctgcttacatctgaatctctcccataatgttatcattcaggtgacattatgggatgactatgatgtgtaatcagtatgataatgacactgtggctgtggaggagaatgtcattctcaggacaggcctgctgatgtcttctgagctgtcacagtcgctgggatgtacggtacacacgcacacaaagagcgcatgtgcgtgagagagaatattccagagcagcaacagctgaacctaagtagaaggaatacaggtgtccaacgtatccttttccaatttggggggatgtatgtacattttcaaattaaaaatctgggaaaagaaaaatcactgtatgattagcgtagggggcaggtctggatgaccagcaatctcaacataagccagtgacctggtgcccctcaaaagctaccagtgtttccagctacaccgactgaaatggcgtgggtgacagttaggtctagggacttgggtagaccacatccaagttcctgcatttgattctgagtgcagacggaaagatggattgtgtgaacggagggcatgaccagagggccactgaccagtgaagaagctggacgtcatcgcagcctcttgggacagtgtggtcaaggagcaggcagctgtttccagcagcagaagggctgacaagcagaaggcagggaagatccgttctgttttgctacctgaaggcagaactgatcgatgggagtcacagacaagtaggagtcagctccctgcggagcagaacacactagccattgctcagcgtccagcacacaacaggctccaccaggcctgtggagcagcacacaccagccatcgctcagcatctggcatggaatgggctccgccagaggcctgcggagcagcacacaccagccatggctcagcatctggcacagaacgggctccgccatcgtttgtcagggatgctaaggacagtgttcttcacggtgggaaaagcaggccagtggttctccagcccagctctgcttcagaatcacaggaaagcttattttaaaaagcagattcttatgctatactctgggagagtttttcccccagtaagtggggtagggctctggaatctgtttttttttttttttttttgacagagtcctgctctgttgctcaggctggagtgcactgacgcgatctcggctcactgcaagctccgcctcccaggttcacgccattctcctgcctcagcctcccgagtagctgggactacaggtgcccgccaccatgcccggctgattttttttgtatttttagtagacacagggtttcaccgtgttagccaggatggtctcgatcgcctgacctcgtgatccagccgcctcagcctcccaaagtgctgggattacaggcatgaaccactgcgcccggcctgttttttttcctaacaggtttactgagatacaattaacataccataaagttcacttgtttaaaacatataatgcgatggttttggtatttacagagttgtgcaatatcactacaatctaactttagaacattttccttaacccctaaataaacctcatcctcatcagcagtcacttcccatccatcccaccccaactccaaggcccaaggatccactttctgtctctgtggatgtgcctacggaatctgtttctcaacacacttctgggtgattctgctcctgcaggtccacggtcgggcattcaggaaccagtggaccagactgttccaagatcctttcctagtctaagctttcatagccggaacaatgaataccgacgaagtagcaggtgctttgcttggtgctggggttgtaaaagaaatatggtacaccctactcttgagaacctacagtcagtgggaaaaatggaatcataaatgactaactttaatacaatgtgagaagcgctctaacagcatgtgcattcaaaagaggcccaggatgcagatgaggtgattaatttgcagccaggagaagttggagggggaagggaatgctgtgttaactgctttccatgcatttcatgtactgctcatcacaattctgtgagctggatattaataccactatcatcctcaagtcagaaaaaaggagacagaggcctagagggcaaagtggggagtggcagagttgggtgtgagcatgagtagtcaggaccctaagactgtgtccccactccctatgctagcctacacaatggccaggggacctcttagagtaggggctgctgaatatcccaatcttagcacacagtaggcactcagtacatttttgcttgatttggactgaaaagggcctcccaagtaaagcacaaagccatggaagcaggaagacgtttgtcaccttcgggagtcagcagaggagcaatgcgagtgacgccaagaggcttccggagctgttgactcttatgtgaatcatgagcccactgtccattcacacacgtatctcttgaaggaagagtccagcgtcttcctcatgctatccatggtgggcaaagcaacatggtttctaccatcatggagtttatattccagtagggaagacaggccagttccatcccagcaagacaagaggaagcagagggttgctacggtctaaatgctggtgtcctccccaaattcctatgttgaaattataacccataggtgatggtattacgaggtggggcctctagggaggtgagtggatcaccatgtgagaacacggttaagaagctggccctgtgcaacctgaaagagcgccgtcaccacaacctgattgcgctggcaccctgatcttgagcctccagcctccagaactgtgagaaataaattcctgctgtgggtaggccacccagtctaaggtattctattacagcagcccaaacggactaagacatggtgctgagggacaagtcctcgtcttgtgggatgagagggagcttagtggaggacgtcatgtctaaactgagcccaaagagatgagtagtagttagccagatggaaacccttccagaagaaacattactgcaaaggtcaggccgccaaatacagcgtagcacacacgtgagggactcacagtgggctgtaggaggtgggaagaactgagaatagtggtgagggctgagcctccagcgtcatattaaattac

SEQ ID NO: 12106 - DNA, 260293 bp, Human
tctaaggtgaggacagtatttcctacttttatgtagttgggagcagtaaatggaaatgtttgtggaaagctcctcataaaatttcaaggccttttgtagatatagtgttttaaaggcccagagtctggagaaaagaagagataggtacaaataatgaaaagggagactagatgcaacttcttccttattccatgcctttattttcaaaatactataaatgttgaatattatagtatttgtggtttctgaaattttgagataattttaagaagaggaataattaataactgttccttccttggctcaaataatatttaggaaatactagtaggtgtggaagagcaacacaataaatgtttttatttaatttccctgagcataacagagagcagatggggaattctgggcctgcccttttttactgttagccaaggagagcagaaaaaataaattgttttccagacatggagccagttttgtgttctcgttgctgatgtactgtgaaaggatttgaagggtgtgcatgcacttgtcacattcatgtggcttagatttgtagtggaaaatgttattctagattgtcaaaattgtgagaagccatgctaacctggtctgtgtaaaaatgtcattattattgttattattactattttcagtgattcgttcaaagagttaagacttaaaattctgataataagtatttctgaaaatgagacaaagacaaaatgctaataaaatttttggcttataatttgtttcagccaaatgcttgaacttgttttattgtgtttttgcttaacgatgtcagcttttcattaaaaggactcagtgtggttgcttgccttgtctccattttccttggtctgagagcaaatactcaggctcagtaagtccatgcatatgataggtttgaaaatgcaggatggaggaggatgatgaaactagggagagaaagaagaaatcggaaaagagagccaaaaataaccaacaagcttaagctttcctagaacatggtctaacaggttagctttgttggtaagatcagtgtgcctcaaagttaaggagtatatgaatgccctggggcttggataaaaatgtaatttctgatttgttaagtccagggtagggcttggcaatgtgcatttccttccacctcccaggcgatgatgatgctgctggccttagaaccactcttggagtgcaacaagggtcaaaagttgggttggacctcttggtgggggcatatttaaaaaatctcaataaagataacttctcaaaagtatagctaaacatgatttaattttataccaacttatacactaaaatatattctaaaattcaaaatcattgaccaaaaataaaagcatttgtttggccatgtcaccctgattgttttcattcgttgctttcttaggtcaggtctcttgataaatactctgtgaacaagttaaggagtcttcgtcttccagatagcatcctaacccaggctgtcatctggttaacatgtaaaatgtccaggtggtacctgtatcatcatggatagggctctggagaagcagacagaccacctggcttctatttccagctttgccaccaagctctgggactttgaactccacacgtataaaatggaaagcatctagtgtattgcccataataggggtttaggaaatgtgtaaggagaccctcttaagagtatatctaagtagtttcatgtcttccatgctttgagtggaacaggtcagagaggagaggtgttgaggataaaaacatgtcccgtaacttttaaggactttactgagatgccccatcctttcttcttgtgattttagttgttcaaactttcttctactgcatatctaatcttttgttttatttcattaaatgctagttgcaacctgctcagagcacttacctttggttttcttttatctgctcttatagagatgaggaaatagatcaaagcatagcattgttgaacatttctcttgttacccttcctttgcagattattcttctgctgttcagaaattttcccagacgctgcagtcatttcagtttgatttcattggagacactctgactgatgatgaaattaacatcggtaagtcttcagctacatgtggtcatatacctgttgaggcagccctgagaccatgtagtctttttgatttgtggatacagagcacttggacatcttcatccactgtggtccaatgccaaggccctgggaggttgattaggaaggatcaggaaactttccctgccagtcccatttcctcctcacacgacagcaatcaaaagatacccttaaacttctactgagatttttgactcagacagtctgcaagcgaccttttctttaaagcatagttattttcctaaaggatatattaaaagggggacttttttggtttatttcccaaaatggttggagttagattcttctaaggaatcaaatttccctagaaagtgttaaattagcatttgtgtgtctacaacttatcaggaacaggttgcttagcatctctcttgggaattggatttaacaactcactctattagttgtataatcttggagaagatatttctgtctctgagtctcatcttgtcctctgttaaaatggggttaatatctatcaaagatgttaaaaagaggaggttgaatagtagaagtcaaaagaagtttgcgtttgtattatttgttatgaaggtaaagaggagaggttaacaaacccctgggcctattccagctcaccacctgcttttgtaaataaagttttattggaacatacccatactcatttatttaagcgttttctatgggtatttttgtggcacaagaatagcactgagtagttagtgaccaccactggatggtcctcaaagcctaaaatcgttatcttctggccatttaagaaaaagtttgctgattcctgagttaaagggttagtgtagagcatttgctagatgagaacactgaaccaaagagctattatgaatgatctattgttactggaacaagttagtaacacagttatatttattagccctggaactaaaatgtgaaaatgtattattattaataaatgcctattatagtcaattttaataatatataaaagtataagttacttatgataggaagatattcctgcacagaaatagtatcttggacatacttttatattatcctttaagtctttttctctacatatatctgttttctttgtatgcaatgtagttcatattaaatatataatattatctttctaaccaaatattttattataagcattttcccatgtaatttaagatttttcacaagttttatgggtggtttgtatggccttgttttgttcactactgttttcccagcacataaaggagtgcctggcatacagtagatgttcaatgaaatgttggtaaatgaatgagtaatggatacattcaaatttcattattatgagagctatacttcatttaatatttagctattcttggaaatatagcttatttccatttttcactattataagtaatatttcaatgaacattttttagatttagattggtgaccattttggttaaatgtgactgtgtaactagtgagtcagatatttgtatttgtattattttcttattcactccattttattttacttcagtaaatctatccaggtccaagtgcatgactatttaaaagttaacattatgggctctggaatcaagtaacccaagtttgaactctacctctacatcttaatagctctgtaaccttggcaagtaacttcacctctctaagtgttaaattttcttatcttgtaaaatggggatgagataatgccaagtgtgcatagtgtctaaatgaatgttaggtatttcaacattattattaatataagatatttttgtacttctttttaaaaataactgctacttgcctatcagttggaagattgggagatacatggtacatgaaattatataaatggctcctttttctggtataagggtctgattttgaacaggtgcctattgataccaaagccaccaacagatctgagacttttctcatgtcttcctttatgttgaactttgagccttaattctcttaatcccatgaacctcactgcaaatgtcaatgagtgctatgcaggaaaaagggtgtgtgagcctgggcaaaatgacttataaacaaaagaaaaatgactccttggtgatgccaggttcctgtgggggtctgtggggctccatcagagctgctgattatgacatctttgctgcttttttaaaaaaagaaagaaagacagggtcttgctctgtttacccagactggtcttgaactcctgggctcaagctatcctcccaccaccttggtctcccaaagctctgtgattacaggcatcagctaccacacccagtcttttgcttcttttttttttttttttttttttaagatggagtcttgctctgttccccaggctggagatcagtgggctcactgcaacctctgcctcccgggttcaagtgattctcctgcctgagcctcccgagtagctgggattacaggcacccgccatgatgcctggctaatttttgtatttttaatagatacacggtttcaccacgttggccaggctggtctcgaacacctgacctcaagtgatccaacccatcttggcctcccaaagtgttgagattacaggcatgagccatagtgcccggcctttttgcttcttaatgtatgatttataataactctttaactcagtgatcatttgcctgccaatttcagaagctcctacttatcatttgaacactgcttttaaggatgctgacttaatgaactgactttcattattgaggaccaaagagaggttttgaaaattcattggcctgtcatggtcattgtccttgttgaatctcattttgaaagctgggaattgtggtggtagtgagaggaagagccagtactccaacagctgaggctgaggctctctggaggcttcgagaaaaaaatactggggaccctactgggaggctattgttgggaaagagcagttgctttggaagctgagaacgcagagtgtgccatgccctcctattgccaatactgctggccctgagtcaatacatcttgtttcactggaaaaaaaaattgcttaaagcacactttggatggaattgtgatacccttttggatttcacattatatgtgcagagggccttctcattaaaaatttttcattattggctccaaaaggtcactcagtagcattgtaggtactcgttatttagcagaaatgacagtgcttcctagagctcatggagaaagcctgaggattctgaagagttcctccccctgacgatcagctctaggacttaccctgaatagtttatgtctaacagggacaagtgggaggccatgtgtcattgatctgaccgtgacttttttcactgctttagagttagacatctatgccttcttggcattgccttgtctttacctctatgtctctgtaaccaaaggaaatcccaggtgtctaagaagtcttgtgtctgcttagatttgagttttatatgttagctatgggatcttggtaacattaattgagcttgttgagcatctgttttccacatcagtatagtgggggagtataatccacctcacaaggtcatgaggagcaaatcagataatacttatatcagagagtgtctgtaaatcatttagctcagtgtctggcatatagttggtgctcaataattcattgttattgattctactaggaacactatagaaggtaatttgtggaaaacagtgttggtttgaaattatatttcccaaattaaccaaaggaaaatataggattgtaaaatgtccatgttggcagggaccttaaatagtatttagttcattatttctcgtataacttcatatccgagtcacctgaggatctcgtttatcctgtcacaggacctaccttatacctaaagaatcagaatttctatagcggagcccagggccttgatttttacatagtctttataacatcagcgagcattttgtaaccccaggacagatctcaagcttttccaaactgtgctccttggatcctcagtgtctcccgtctttcatgatcaaatgaaacagcggtttatattgggctttcatgtaagaatttgcttgaaaaatgggatttgtagattaaacgagagaaacagacacttttagagtgctcccaaatagcagatgtcattgtaagcactttatatagactaatgagagaaagagagacagaatagtagcaagtttatccctcaattcaacagatggagaaactgagatccagaggtagggatgtgattgtggaaggtaccacacagctacatagtaccagatttactattagagcctgaatctcctaaggcccaattgattcattcaataacattttattgagcatctgctataaagcttgtcctcatggacttcccaatcatacaagttttggcataggcaaatgacttgcaatgtcaccatagcaccatgagctagaaagaggcctgtttgccacataggcttaagagaatatgcttactttttttttttttttttttttttttttttgtgatagagtctcactcttgtcacccaggctggagtgcagtggcgtgatctcgactcactgcaacctccgcctcccgggttcaagagattctcctgcctcggcctcccgagtagctgggattacaggcatgcgtaaatacatgcccggctattttttgtagttttagtagagactgggtttcaccatgttggcccggctggtcttgaactcctgacctcaggtaatccgcctaccctggcctcccaaagtgctgggattacaggcgtgaaccactgcacccggccaggttactcttttctcaggatcccttatatgtatttttgttcattagtaaataggtagcgtgtccactaaatgacataaacaagggattcagagacatagaacacatcttcctgccttcaaggagctcatagtctattaaaggaggtggataactaaataggcaatggtaacacaatgtgataaggactatggtagaggtaagcacatggtagcccctaattcagactggtgtgtatatgtattgggggacgggatgatgcggagaataaacatggaagccttctcagagaagtgatatctgagtcagttccagggttaaggtgaaacaaggcaggtggctagggctcagatttaaggaggcacttactctcagggttgtgcaagtacaggctggcacttgagagtgaatatacctccttaaagtttacagcctgggtacctgggaattatttggtgaggatcttcagagggcctcgtattttaacttcaaatttcaatcttgtcatcagcagagcatggcatccattaggtgaaccctgatagcatagttcttttattctgtgcatctaccttgctacatcttttccagaaaatgtcacccatggggttttagtgggttgtttgtttatgcctgggggaataaaagtcatgttctaaatctcagactgtaaatcacatttccaccccagttatgctaacatatttaaagaaacacctttgtggaccaagaagattgatttaaggtcagacttctagatggaaagttccatcagccacccattactggtttctgagacatgagggtttaacattgtcagtcccctgatcctgatttttgtttaatgtgaatattattcattgctaaacaactcacagcagatcataaacctcttggttgagataaagaagggactaagaaatagtctcttgagggcttttgttggtatttttttctacaaaaccagttgaagtatcttttgagaagtggtggcaaatgtcagttgttttagagtcctggaggtcaggcatcttaaaagaggaatggctaaaatgaaaaaagaagcactaatgtaaaagattgtatttaagtaaagagccaggagttgaattctgaaggttcagtgattttcatgagattggtggggggaaaatcttttggttatacatcttgaagctcttaagctcatatgtcagttggtgacattgttcacaatattgattatctttcatataggggcatgcatgaaccaaatattttgccagactttcttagcacaggcaatagcttttctggggaaagttctagcccaatgcaccttctgctgtggtgataagcccttagaggtttatatcaagttattgggcttgagtgcatagggcttcttctcagatcctgaggaaaagagaaaatacaaggtaatcagaagtctctattgggatctgggccgtcaggttttagttctccatgactcgaagtcatatgagaaggtgataattgggctgggtacggtgcctcatgcctgtaatctcagcactttggaaggcaaatgtgagtgactcacttgagcctaggagctgattctaaatgctttcagggaagcatcagattaaaacataaaaacctatgtgtagatgagaaaggacttaaaatggcagtggccaacttattactgatcattttcaaaagtggaagacttgatgaaattttattaccagaagaataatgcaactgaaaaatacatgggatttatgtggcatataaaacaaaagaaatatcaatccataaaaagattttacaaaaaatctataatcataataacactattttcaaggaagagtgaatattatatttataaaaattggtaaacaacctttatgaagaaaaaagtcttcagacataacataataattctgacataatataccatgaacatagcaagcttatagttagaatataccaagaatatatcaataatatcaagtaaagctgggctcagcgatgcatacctgtaatcccaggtactcaggaggctgaggtgggaggattgattgaacaacccccagccacccaaaagaatatcaagtaaagagattgagaaatcttaataaaacatactgtggaaagcaagaacattgatcgttctctaagaacttcctgtatagcattcaatttctgaaatatgtacattggtaacgtttagcccatttaagctagggaagtctgaacatctcttttgatttcatggtgcttcctgtgcaactcagacgataaaacaaaaagcaccaaaactatgcactggacaattaaggaagttattgccatagggagaacctttattaatgaggaacatctcaaagaaatggaagaaaattggggtattgtagaggcaggtaaacaagggagtcacctgcaagtcttatgggaggcatgaagaagaatggagattgatgctatatatgaggtgcaaagtctatatatagactttgcagtctaaccatttttcagaacacagaaggatgtgggatgtcttaacactggctgctttcttggagccctggtctcagttccacactcagtggtccgggattcacaaagcagggcacaacccagtgtcctttcaaagctcccaggccctctgaggttccactggggaatttgagtgaagaagatggcactcatgcagagtgaggagactgctgaacatgagccccctattctcataggctttttgtacctttttgcccatttcccttctgactgatctggagactgactgctggttaagtgccagccagggtcaagtaagtggtacaaaatgatcccaagacgttcctatttgttgagagatctagcaaagtgaatgtcattttctcaggagcatcatttggcaggcccaggcttcaggcctgtctgccatttactctttctccctcattaaggtctcttggactccagtaatctttcactctgagctctcttctctatcctgttcctgccaccatattgtatccatagcaatgacccttatatcttggctcacttttcttcatggggatatggtaggatttagaaacatggtcttggatttggctggacctgagttcagactctgacctgtttatttactgactacatgatcttaggcagttttcattaaaaaaagtaataattgagtttattggtatctttgcattataatataaacatgctttattataaaaatatggaaatgaacaaaaagattattattagcttccgtatactgagtacctactgtgtgcctactgctttgtgtacactatctaattctcagagcaattttaaggaggtgaatgaggctaatggaggttaagaaacttgcccaggatcacatagctaataagtagcttaagtgggattttttttttttttaatcagggtttggctctgtcacctaggctggagtgcagtggcaggactgtggctcactgcagccttgacctcccaggctcatttgattttcccatctcagcctcctgagcagccagaaagcacacctcacctggctaatttttgtcgcttttttttccctttctttcttttttttttgagatggagtcttgctctgtcacccaggctggagtgcagaggcacgatctcagttcactgcaacctctacctcccaggttcaagcaattctcctgcctcagcctcctgggtaggtgggattacaggtgctcaccaccacccctggctaatttttgtatttttggtagagatggggtttcaccatgttggccaggcttgtctcaaactcctgatctcaagtgatccacctgcctcggcctcccaaagtgttgggattgcaggtgtgagccacagcacctggccctaatttttgtagcttttttcgtagagttgaatttcatcatgttgcccagactggtcgtgaactcctgagctcaagcgatctgcctacctcggctttccaaagtgaagggattataggcatgagccaccatgcccagctttaagtaggtctttaaatcatttcatttttgactttaaaatttatacatatatgcactccataaccgtgttaatgtcatagtaaataatcaataaatagttaagcctgagagctagatttaattaaaaaaaaaagaatcaattattttgatgtatttttttcttggcttttttgggggtcgaaacaattttctgcatatagctgtacttgtgtacaattgttgcatacagatttttatattctgtttttaaatagtgtgacactctagctattttgtcatgtacagaaaattttgtgtaatttcctttttaatagcttcaataatagtccattaagtggacatacttaataatttcccaatcattggacattttatgtgttttcaattattcatcatcagcaataatgttgaatgcctacctttggatataaaggtttatccctctgtattcagaattagttctttttgtttgtttgtttgttttttgtagagatggggggtctcacttttgtagagatggctcactgttgccatcaggcatttgagcaatcctcctgccttggcctcccaaagtgttgagattacaggtattttccaccatgaccatgccatgattaggttttaggtatggtttcccagatacgaatttacaatgtaaaagggtatagataattttaagctgtttgatccacatttgtcaatttttacaattgtttggaagacagtgcataacactgtaatttatatgaccttgctaaattaaacctcagttttctcatcactgaaattgtaatgatgaataataaaacacttgagaaacatctaccatattgcttttcccatctcacttttccgaattttttgtaatttctttgaaattttccaaggataatgttctcttgctgtggtctttttttaaaaagaaaattcttggattggtaaacattattgaggaattttgcagtaagttttataagccctgctttgtggtggtgttgcggcaggggatgttgctattattgatgatggtgttgttgtttgttatggttatgcagggctgttttcttccatttcttagccaattttcttagtcctcagtcctagtatctgaagagagggcaaaaggactctaatgactttggctccttaatgactattctctcccacactctgtaatggacagtctgatctcctcactaaagcttttattgccttcccattaattctacagagccgtctgcagggttagtttttagaagatgctgtaattaattatccatgatatttggttaaaaatagatccgtaagaggctttataggacctcaagattctgagtcagaaataacccttgtccaaaccttccgcttttgcctttttcttttgtcttttttttctttttctttttctttttgagatgaagtttcactcttgtcccccaggctggagtgcagtggcacgatcttggctcactgcaacctctgcctcctgggttcaagcaattctcctgcctcagccttccgagtagctgggattacaggtgtctgcttccacgctcggctaatttttgtatttttagtagagacgggggtctcacgatgttggccaggctggtcttgaacgtctgacctcaggtgatccatcctccttggcctcccaaagtgctgggattacaggtgtgagccactgtgcctggttctgcttttgcccttttcttgatttgctatagatatgaccaagggagagtgaatatgaggatatttggagaagaaaacaccatttgtggggccagttggagggacagtgaaaacaatgtgacatagtgctttcactatgactggggactgtagatagaacattgaaatggggtcctcttttgactgttcagctagctgtgtgaccttgaacaagtcagttccaatctctgggcctcagttttctcaggaataaaatgacatagttggactaagatagatgatctgtaaaagtcttaacctttttagaaagcaagtgattacaatcttagaatcaagaggctatcttgactttgctacatgcttcttgccctgtgccacatacttctctaggcatttgcagtcttccgatcaagcaataaatgtactcatagggctttttcaggccacatattcagcaatgaggtttttcttgactcagcaacttaattttaaagtgatttaacaattactgaagctgtatgttaattgaaagtaaggatcaagaagctctgaccaggttaccacggtgggaatagttgaaaaatgacctccaaaaattcgatctttcataaaagcagcaaaaacactggcagaaatttccaaaatcaacttttttaaaactccaaaaacgaaccaaaattttgcaacaaaacagtgcatgtttattaaataaaaatggctgaatagttgagaaaacactgagctctatgacattttaatttgccatgttcctattcctttctgcagttccatagtagctttgaaaactaacgtctgtataatcatgcaatgtgtgcaaaccaccattctagcagccatgggtgagggtagaatgggtgtgaagttactcaaaatttgagaaatatcactcacagggcttatgttatttgagttgactcagagtttactctttaaatggttgttgttgttgttttactagcgcattttctttcttttgtgcattttttttttttttttgagacagaactcctgacctcaagcaatcctcctgccttggcctcacaagcaatcctcctgccttggcctctgagattaaaggcatgagtcactgcaacccacttgtgattgttttttttttttttttaatttcttttcttttccttccttccttcttcctttctttcttcttttccccttcccttcccttctcttctcttttcttttctcccttcccttcccttccctccttccttctttcctttcttcccttccccttctcctccctccctcccttttctttctttctttctttctttctttctttccttctttcttccttccttccttcctttctctctctctttcttttttttcttcctttctttttctttctccttccttccttccttcctttcttcctttcttaatttcttttccttccttcctgccttccttccttctttctctctctctctttctctctctctcatccaggctgtagtgcagtagtggcatcttggcttactgaagcctctgcctcccgatttcaagcaatattcctgcctcagcctcctgagtagctggaattacaggcacctgccaccatgcccagctaatttttgtatttttagtagagacaagtttctccacgttggccaggctggtctcaaacttctggtctcaagcagtccacctgcctgagcctcccagagtactaggattacaggtgtgagccaccacacctgcccctagggcattttctaaaaccattcagtggcagttgtttagtactacagtttccacagacaacaaaaagaataaagtagcaaataagaagctgaacaataaaccaaacaggacaaaatggagaatgaattatccttggagagctttgaagagctgtgagatattcctggaaatctaggagtcatgcacatgagaggggctttgtacatacccagcgtttgtatctgtctagaagatacaaacaaggagattagacttgagacatctaatctcccacttctggctgaccttcagctctttgcaaggaggagtgaaggctaaggcacagttgtaaactgtctggctgaatgttgaaggcacaccccacaatacacagagagcccttcagcaaaggcttggagatatttgttcaaaccatttaaagaaatctctgtccaatcacttgttgaccagtaagcttactgaccagagactttagtggtttcatatgacaaagaatgcagactatagaatgagtccatgaagccaatgtaacaacaagcaaccacaagaacaacaagctctggggaaagagaggagttctgatttccaaagttgccacactatttagaatgttaacttttaaaaaattatgagacatgcaaagaaatagtaaaatatgacccttgaacaagggaaaaaaagcaattaatagaacctgcccccgaggaagcccttacattagattttctagacaaagagtttcaattacctatttaaatatatttaaattaataaatgagaccatgtctaaagaacttaagaaatgaatgagaacagtgtctcacaaaatagacaatatcaataaagagatagattttttttaaaggaatcaactgaaacttgcagttggaagttgcagtataataactgaaatgaaaaacttactactgggggttcagcaccatattgtactgggaaaataaatgaccagcaaatttaaagacaagtgaattgagatcattcaatctgagggaaataaagaataatgattgagaaaaatgaacagaacctcagatacctgtgggatatcatcaagcataagagcatatacagaatgagaacctcagaagaagagagtgagacaggaaagaaagaatatttgaagaaataatggccaagaaattggcaaatttggtgaaaaacatgaatctgcacatccaagaagttaaatttagagatacatgcctaaccatatgagtctaatgaaagaaaataacagagataatcttgtaaaaaataagagaaaaatgaaagaagagaaatgaatgaaaacagtcacaacatactaaatcttatgggatgctgctaaaacagtgtttggaaggaaatttgtagcttcaaattcctatgttaaaaaagaacaaagatatcaaatcaataaccaaactttccaacttaagacacttgaaaaacaagagcaaactaaagaaacaaaagtaaagaaataataaagactaaagaggaaataaatgaaatggagaacagaaaaagaatataataataaggcagccttgtcaaaataacaagacagtcattgaaaccaaacatctgttcttcataaagttaaacaaaattgacaaacccttagctagactgaccgtgagactacttgaattactaaaatcaggaatgaaataggggacattactactaatcctagagaaataaaactgattataatgaaatactaaatatagttgaccctcaaacaatatgggttcaaaacgcagaggtccagttacaggcagactttttctctttgatttggatagaaaaatacagtatttgtgggatgtgaaattcacacacatggagggccaacttttcatatgtacgtacattcacataaaacttgttcacaaatgttcatggttgcataaaccagattcagaggtcacatgtgtttccatttatgagaaatgtctagagtaggcaagttcatggaaatagaaaatagattagtggttatctgggtgttgggaggaagtggtaatggggtgtaatgctaatggggtttgggtttcttttgggggtgatgaaaatgttctgcaactgtacagtggtgatagttgcacaactttgtgaatatactaaaagcccgaattgtacactttaaaatggtgcattttattatgtctcagtccatttgtgtcaccataaaggaatacccaatgctaggtgatttatgaagaagagaggtttatttggctcatggttctgcaggctgtataggaagcatggcatcagcatctgcttctggtgagcacctcaggaagcttccagtggtggcagaagaagaaagggagtcagtgtgtcacacctcacctccaacattggggatcaaatttcaacatgagattttgaggagatagatacccaaactatattatatggtgatatcaattcagtgataataataagcacctaataaagatattgtcacaattaaaccctcaagcagaaggcttggcacatttaatgtccatgaaatttagtcttttcctttaaatgtttgaatatgatatttgtcacatttcctttagaggtaaactgatcgtgtctggaaaaatgccaattaaaatctctgactcttttcttagcataaagtatttggggacagaaggtcaataaacatttccattttttcctgtttactctttctgagtatggtgtttatcttttctatgctacggttgagctctgaatgaatttagtgttttcaaaggtgatctccctgggtatttgcagcaacttaatcctcagaagaagaaagaaatgtcattgccttgcatcctgtgttgactccaaaattcatttccttgacaccaggaatgctggacttgttcagttgttttaaggaggaaactcaatttttgattaaaaatattagtatagacaaatttgtttttccaggctttcattcagatgccagtcgagaatatacttcctgcttctggagagaagttgaggaatttgaataggcactaaagactatttagcttaacttacttttttttgtatataaagacattgaatttctgagaaaggaagtgatttgcccagtcatcctgccagtaagtggcacaattggcactagaagagtagaaagtttgggagggtggaaagggtaatgtttattatttactttgtgttgacactacattcaccatccaatttagtttttacagcaatagtctctggttggtcagtagtggaacagggatccaaactcgtttcagggttctatagctgccaattaattacacagcaaacctcttgccccttccctaatcttttagcttgtctatgaaataagagaaattctagctactcctgagtggctgtaaggattaaataaaatattaaagtgtatggggattgataaaagaggaaagaaaagaaaagaaacattcaacaggtgctgaacacctgcttttgtcctccgatttgacaccttcctctagtggccatgtgggcatagggcactggtccctacttcctgttgcacagatctctatccatttgtctgtcaagcaccatgattaatttgttttacatttgattctctccttccagctgaatccttcaaggaatttgctgaattgctcaacgaggtagaaaatgagaggatgatgatggtaagtcactaacgctgtcactgaagctgagttcatgggtgatataggggatttttcctttcctttatgcttggattgatcctatactattttgatttctgtcagatagcttcttggtgctataaaaatagttaggtaatagatctggttattatgtctcaagcttccaccctgagagtttggcattagatagagggaaattaacgtgcaaatcccatctgtgttcatttcagtgaaaaataatttcagtggatattaaactgggcctttgaacatgttgacagaaattgaggtctttagtgtttttagccaaattatccatttgttaatctttaatttgtggagtagttttacttttatagagaaaatcagtagaaaataaagatagaactcatataccacctttctctctcccattcagttttccctattattaaacatcatgtgaatgtgatacatttgttataattgatgagccaatattgaaacaatattattaactaaagttcatagtttacattagaatttactcttggtattatacattttatagatttgacaaatatataatgacatgtatccaccattacagtgtcaccatacagaatagattcatggccgtgaacatttcttttgtccaatctattcatccttctcttccttctccagtcctgaaaccctgacaaccactgatctttctttttattgtgttttgccttttccagaatgtttatagtagatatcaaacagtatgtagccatttcagattggcgtatttgacttagcaatatgcattttattttcctgtcatttatttttatcattaagtaatatcccattgtatgatttaccacagtttgtccactcacctactgagggacatcttggttattttggcaattataaggaaaactattataaacagttgtatgtaggtttttgtgttgatacaaatttccaactgatttggttaaataataaggagtgtaattgctggagtgtaaattgtcagggtatgtttaattttgtaagaaattgccaaccaacttccaaaatagctgtgccatttcgcataaccagcaatgaatcagagatcctgttgctccatgtcctcgccagctccatgttcttaccagcatttgctgttgtcagtgttctggattttagccattctcacggatgtgtagtggtatctcattactgttgtaatttgcaactccctaatcacatatcatgcagagcatctttccatatgcttaactgccatcggtatatcctttctggtgaggtatttgttcagttcttttgcctattattaaattgattttcttttgttaagttttaagagttctttgtatattttagattccagacctttatccaataggcatttgcaaagattttctcctcgtctgtggcttgtctttttattttcttaatagtctcttttgcattgcataggtttttaattttaatgaagtccaacttacacatttttgctttaatggatcatacttttggtgttatatctaaaaagtcttttccaaatccaaggtcacccagattttctcctatgttatatttttggaattttttagctttttgttttacatttaggtcaatgattcattttgaattaatttttatgaaggatataaggtctgtgtctagattcactgttttgcatgtggatatccagttgctccaacactgttttttgaaaatactattctttctccttgaattaccttttgtcctttatcaaagatcacttgactatatttatatgggtctgtatctgggctctctatttctgttgcattgatctatttatctattctttcacaaataccacactatcttcattactttagcatggtagtaattgcactgtagtaaaaagcattgaagtcaggtataagcttaagaatcagtttgttcatatccacaaaataacttgctgggattttgactgggattgcttttaagatcctagagatatctttttgattttgattaggatttgcttttaagctaccagggaaaaactgatatcttaaaaatattgacttttcctaattataaacgtgggttatctctccatttatttatatcttttttgatttttttcatcagagttttgtagtttccttatatagatattttatgtattttgctagatttctacttaagtgtttcatttttatgaagtctaattattttaacagcctaaaaataatctttttgtgtggtccttagaccggcagtaccatcatgaccagcaccagcagaaaattattggaaatactggtccttgtacccatcccagacttattggggacttaaatgttgaaatgtatgcgttgatcaatattcatttttattaggggcatgatggtaagatgggaattctgttttacttttctccatcagatgactttttgtgggcttctcagttttgttaaagctatttattccaacagccagaactaatttacctataaaatccctttcttttcaacagtgtggtactgacttctcaaaatactgctcatagaatctagactcctagagaagtaggaatgaaggcaggacttggaggtaggggaattagagaattaaggctctaattctggatctgtcactaacttgttgacttcagattaattacttcatttttctgggctcctttttcttatttgtagagtgaggaaaataatccccatctcttatggttgtttaaagtgctccaaataacatagtaaacatggacgtgttttataaggggaaaatactgattatgtaagcatggtttttagttatctttagttactcacaggattctgcttgtggaaatatgatttgggaattttcttagtttaaaatatttgcttttaaatgtactaagaagagaccaatatgtgtggtttccctggaccctcttagatggcccccttgctaatacacagtctactaaatgttcttctctgcccacagggtttgtggactgctgcctatgttgttttcaaaggcatttgcccccatttcattcagatagcactagaaagctcagctgtacttctctttagccctagttgtttctccatctcttttatttacccaataacaaagccctcacatattgaagtagtattcatcttttgagatgttgtttttctcacccttcctgctgatactttgccacatgactgactcattttcttctgtctttaattatgttgtgcccttttgtcccaacaacttttcaatcgtatattgagtgtttgctccctatttcccacttaattccaggaatgctgagatggttaggcttaatgagtgcctttcaccccatgccaggaattcattgcttgattataacttttccatttcctggctttgtagcaaaaggacccctctaccccagtctggataatttagtgggtcttatattgcattttatcctttgtaaaagaagagtccaaagtaagctttagaataacagtaagaaagttcacagcactcaagcatggaaattgcctgtgtctggtcatctccataaatgaatataaattggggaaggaattatgatggggagaagtgaggaagggcatccctgtgatgttctcaaaagtatactgttggggctgggtgcggtggctcacgcttttaatcctagctctttgggaggctgaggcaggcagatcgcttgaggccaggagttcaagagcagcctggtcaacatggtgaaatcccgtctctactaaaaatacaaaaattagctgggcgttatcgtgcatctctagtcccagctactcgggaggctgaggtgggaggatcacctgaacctgaggaggtcaaggctgcagtgagccatgatcatgccactgtactacagcctgggcgagtaaggccctgccaaaaaaaaaaaaaaaaaaaaaaaaaaaaaaaaaagagcgggggagggccttgaaaagtctgaattgcacacttcttatatgattatgaagcttgcctagattcctttctgactctgaaggggcctctgttggcaatgtgcaaggtctgtttttgaagacggccaaaagtgacctaaagaggcccccataatatttcagcctgtctttagtgctctttttttaaaaaaaaattttttttattttattttttgtgacggagtctccctctgttgcccaggctggagtgcagtggcgtgatttcggctcactgcagcctccgcctcctgggttcaagtgattctcctgcctcagcctcctgagtagctgggactacaggcacccaccaccatgcccagctaatttttgtatttttagtagagatggggttttgccatgttggccaggctagcctggaactcctggcctcagctgatccacccgccttggcctcccaaagtgctgggattacaggcgcaagccactgcgcctggcccagtgctctcttttgatatttcatttaccatcaaagattcctgagcagtcctgcaatactggactgaatatcatctctattctgctcaacaccttcagtgttactttggcctttattcaataggattctgatgatagaaactcactaatgagtttaggatgtcactcgttatggtgaagagtctacctgaggtagcaggtgggagtttttgtccccagtgagctcacacaatgaatgcagtgattagaaaagagattaaaggccaaatttacttcaaaggggagtcattgctagagttctaaggggtttaagaataaaatggagtgaaaaagaaaaaagaggaaatcctcaatgtgacttttttctacattcctaagtctctattctgaccagaaaatagtataataaccaatgagtgtcatagagaggaaaagattcagagtatctgtttgtgctgtaggagactgggagcagtgttgccaaagtgattaagggaaaatgatgtcctgcaattctagtaaagcatggactatttttcagactgaactggggtcaaacatgtaaaagtcagtggccttatggaccctgtgagagaagttgctgacacacttgcttatgcaggacaatcccctttggagcatgaaaagccagcaactctgccctcctgggggttcctgaatatgcaagggcccagctccatacagtgctttagaaagtagtatgtacacttcttattcaaaggaaaacttcctcaatgtttcacagttggccacttcttaggtattacatttatttatttatttatttgtttttgagactgagtcttactctgtcacccaggctggagagcagtggcacagtcttggctcactgcaacctccgcctcctgggttcaagtgattctcctgcctcagcctcccgagtagctgggattacaggcatgtgccacctcgcccggctagttttttgtatttgtagcagagacggggtttcaccattttgaccaggctggtctcgaacccctgaccttaggtgattcacctgcctcggcttcccaaagtgctaggattacaggtgtgagccactgcacctggcctgtattacatttttttaaactgcaaattgtctttctaattatctattgcttcataacaactttttctaatattagtggctgaaaccagggtccccaacccctagcctgcagggcaccagtctgtggcctgttaggagcctgaccacacagcaggaggtgagcagcaggatagggagcattactgcttgagctctgcctgctatcagatcagtggcagcattagattctcataggagcaaaccctgttgtgaactgggcatgcaggatctaggttgcatgctgtttatgacaatctaatgcctgatgatctgaggttgaatagtttcatcctgaaaccatctccacctccccctaccctgggtccattgaaaaattgtcttccatgattctgctccctggtgccaaaaaggttgcagattactggcttaaactaaaactaattatttgtaattattttttgggttaggcattcagacgggtcagctgggcgattcttctgctccaaatgatggcatttacctggcagatgagttgatatggagggtccaaaatggttttcctaatgtttggcaccttccagtggggatggcaggaagggcggattcagctggtatgagacattgactagaatttggcctcttctgtttggtaatctcagggtaattaaacttcttatgtactgtctcaaggctcctagtgggagtattccaagagaactgggagagaactggtgctggccttttatgacctagcttcaaatgtcacagagtgttacttctggagtactctatttgttcaaaatattaacaagcccactcacattcaaggtagaggggacatagacctcacctctcaatggaaggtatgtcagagtttgtggccatgttttaaagcttccacaatagtaaaggagaaaaatgactttctgtactggacctatgacaccaataacttaatttgtgggtatttttagtagaagaagtcttattttcaattaaggagagtcactggtgtaatttttttttgataccataattgttagtggagctttgatttcctaagcaaccaaaatgaatctttctatgaatcagacctgcatagagaagtctttactaggggctcttgcagggtggaatttatagactttcctgcctttggcaaatgagcacactcagagataaagagaatgttaagtgtcgtactgggaggtaggttatagtacgattaggactcaatggggtttcatagatccagtagaagagaagagatgtgatgagaatcagacagggtctggaaatgttagcaggcaagaggtctgattttgtaaaaatcagcaaactttgggaagggtttcatgattttttaagtctaggcttgtagcaaacaagttttagaaagccaactataaaagcactggtgatcaggagacatagagaatgactctgttctcaaggaaaacattttttttcttgcctagttttatatttttttttgctgggtgctggctgtcctggatgatagcattaggagctgcagtagatcagaatgtcagggttcaccaagatgttctcatacaaaggctggcagtgccattttaggagttttcccatttagttgaaccttgaatcatacctatacacagaacaagaggcccaaattacctgaaagacacgtataacctatgcactaatgccccacaactttccacacttttggggaggtaggttaaaaattgcttcttagattggagaactcagatcttgtcaaaactggctttttcctctgttgtctatttttgttatgaagatatatcttgtcttactgacacctatgtctcatatgacaaggaaacttgtcttttagttttctgtcttgtaattaataaaaattaatgcaatgattcccaaaatgcagccctttagatgccttctctagggtcttccattttagtgattctaactctcaccatggaggcacaaaccccacttgttgccttgaacatatacaatctcataagaggtttatatgaagaaaaagctttgtatacctttacctgcccaaagaacaaggggtcttctttgattttgatgttttcatatctccagaacatatttattattgccaatattaatagtccctgaacaggccattcctattagcttctgagcatttatatttaggtaatttgaaagcctagtctagtgttttctgcgatgctgtaatgcactccatattctgaaggaaatgttctggttttatggcacaggcaggactgtaaatgttttatcctaatgctatcactgcacactcatttgcctctgatgaaatgatttgcacttgctgcaattgtccttttcttgtatttgccattctctttctcttctctttttcacctgtccttcaggtctcctgtgtcctctgctggacatcacttcagatatttatcgattaaaaactcaggtcagactatcattaaagttacagagaaatgcccctcttattctttctcccatttcttctcaatgcatttgatttttcagaaacaatatagaaacaaacagtaacaaaacccaacaaatcagcaaaccatttaacattttgcaggttggtatataaatgaaaatgtagtaacaaggaatcttgtatctgaaccttgttaacctagaaattgttttgtttgtttttcctttttgtctaggtacacaatgctagtgatttgctgattaaacccttggaaaatttccggaaggaacaaataggcttcaccaaggtacattttctgtatatgcataagattttttaaaatagcaatcgaatagttgtatgggctactattcttcactttacaaagatatgcaccaatctgctggtgctttgctcttggcctagtcagcctcctaaactgtgcaaaataaatgtttgttgtttatgtcaccctgtctatggcattctgttatagtagcctcagctaacatgacaaagggggtggggaggtgggtgattagtttctatgagaaaatgatcacgaaagagagtaagaaaatctagaattggcctctgactttgtggccaacaggctctgtatctgtgcataagtttcttcttcttttggtgtttttgttgttttgtctggaaaactagctagctatcatgtatcaactgcctgctatattgagcactaggctaggtgctttacgttcattctttaatcacaaggactttgtgtgcttctggcattttccccatttcacaaatgaggtaactgagccttggacaagataaataacatgaccaaagttatatagctggtgatatagtttggatctgtgtccccacctaaatttcatgttcagttgtaattcccagtgttggaggtggggcccagtgggaggtgattgcatcatgggggtggatccttcatgaatggttcagtactatcccctcgatgctgttctcctagtggtgagtgagttctcatcacatctggttgtttgaaagtatgtagcaactcccccacttcttgctcctgctctggccatgtaagatgtacctgctttcctttcaccttctgccatgattttgtttcctgagacttcaccaaaggagaagctgctgtacttcctgtacagcttgcagaactgtgagcccattaaatctcttttctttataaattacccagtctcaggtatttctttatagcagtgctagaacagactgatgtggttagtaagtgatagtggcctggatttagacctaaaggtctttttagctttacgttccatactctttacattaagctatgctgtctagatctttgctgtctattatggtaactactatctatttaaataaaattaaattaacaactcagctcctcattctttctagccacatttcaagtgctcagcagtcacttgtgtctagtagctactgtgttggacagtgcagataaaatacatttccatcattgtgcaaagttccgttggacaatactgagtgccagttaatttcattcttttcagcttgaccatcacatggatctctgtgattctccaatgtctgttgaagggatgttaataattttcatttttaatcttttcagctaggtgtaggtctgtttcatgagctctcaatgtgtatccaccatgtagcaaaggtagtttcttctaccagggctaaaatacagcatcttgtccaagcatctagttttcttaggactaagagcataccaaccagtagatattatttggaatatgatgacaatcagtttggatcaagaatttgaaaacagcaagtttttctttttttaaaagacactttcttgccaactcagcctcccaaagtgctggtattacaggcatgagccaccatgcctggccatgaaagtaccaaattttgagaagaaagagcaaattagtggttgagctcccactacctgctatcatcagattgacatgggcattgttagaaatgactggtgttcaagcaaagtgagttcccctcatagcccagcaatacttgtttcactggagtctcattaacatcaatacttagttgggagaggatatgattgaagaatagaagtatatttaaaattacaactgaggataaaaatacttaaccacttgtgaaacaatttgatttactttcattcccttataagaataacactaggaaagtaaggatatgctaccatggttgccctcatattatctgagcaaatggaaatgaatttgtattatgtgcagtcatgcgtcgcctaatgttgttctgagaaatgcatcattacatgttttcatggttgtgtgaacttcataggagtttgcttaacacaaacctcgatggtctagcctaatacacaactaggctatatggtatagcctattgctcctaggctacaaacttgtacgggtgttaactgtactgaataatataggcagttataacccaatggtaagtatttgtttatctaaacatataaagcatacatataaaaatactgtattataatcttataggactgtcattgtatatgcggttcattgtttactaaaacattgttttgtggtgcatgactgcacttcctatggcccatgcctgcactgagggttttacatatgctttcttccttaattctcacagcaaacctgtgaggtaggatttttaatatccattgtctcaatgaagaaagtgagtctcagaaaggttaaatatgtatctatcttttttcatacttctttaccagtaaggccaacctgcatatctacaaagaagaccaacttagtatgagtcatgtctccaataaactatctagaattccaatagtcaaaatgaagcttataggctacccctgtgtgttatcaatttattgccaatcaattccaagcctctcaatacctgctctgtgataatggacagattttctttaagcatctttcctttatagtgagcacactcttaaactttctcagtagagggagctggagggacgttgcaggaggagggggatctcttgaagtttccagctgaggcgggggtggggcagggtggggaggacagctgatggaactctgacccagccacccacccagacacatggtgcctcaatctccttgaagccttcatgaccatgctgtccctcagcttccttctgtagaccccctaccccacatggcccacttgctggctgaagagttatcatgcagctattaccctctctgcagggccctcatacattgagcttgcaccctagggggttctcaccaaacaaggctggccccgttgagctcacctgcaactcagttttcccaccttctctttataccttctccgctggtcactgttggcctgcttttttgtaatctggtgagttgcctcctgcttacatagtaactatgaaccaccgggccaaatcagcaaacattctgctatccggagtgttaaattactccttttctttttttgtgagacagggtgggtctcactctgtcacccatactgaggtgcagtggcagaatcatggctcacttcagcctcaacctccctgggctcaggtgatcctctcacctcagcctctcaagttgctgggactacaggcacataccaccatgcctggctaattttttttttttttttgtaatttctgtagagatagggtttcgccatgttgcccagactggtctcgaatgcctgagctcaagcagccctcctggcttggcctcccaaagtgttagaattacaggcgtgagctaccacgccccaccaaattactgcttttcaagtgaggtctgaaccccattaaaatttctccttatttgagtacttttccttaaacttagagtaccatatagagttttcttatatgtcaattatttgtaaggttttctatctcctgattggacttagcctggtatacccagcactgctgctagctggctttgtgagttcactggttgtgataggtgctatattaggcccttactcatacatatccagttctcatttgaacctcagaacaatcttgcaaaagttattatcccccattaacaggtggggacactaagttcagtgaggtgtagcctctaaggtcactcagtagcttggatatgaattgagatctggttgtaagtctagggctcatttcactttgcaggaaacagcacttctctccgaaccttagttttctcatggctcatgacaacaagaacaatggacaaatattccaaatctgatcttctgttagtttgagattctttttttttaattattattataatttaagttctagggtacatgtgcacaacgtgcaggtttgttacatatgtatacatgtgccatgttggtgtgctgcacccattaactcgtcatttacattaggtatatctcctaatgctatccctcccccctccccccaccccacaacaggccccagtgtgtgatgttccccttcctgtgtccatgtgttctcattgttcaattcccacctatgagtgagaacatgtggtgtttggttttttgtccttgtgataatttgctgagaataatggtttccagcttcatccatgtccccacaaaggacatgaactcatccttttttatggctacatagtattccatggtgtatatgtgccacattttcttagtccagtctatcattgatggacatttgggttggttccaagtctttgctattgtgaatagtgccgcaataaacatatgtgtgcatgtgtctttatagcagcatgacttataatcctttgggtatatacccagtaatgggatggctgggtgaaatggtatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatgaccagtgacgatgagcattttttcctgtgtctgttgactgcataaatgtcttcttttgagaagcatctgttcatattctttgcccactttttgatggggttgtttgtttttttcttgtaaatttgtttgagttcattgtagattctggatattagccctttgtcagatgagtagactgcaaaatttttctcccattctgtaggttgcctgttcgctctgatggtagtttcttttgctgtgcagcagctcttgagtttaattagatcccatttgtcaattttggcttttgttgccattgcttttggtgttttagacatgaagtccttgcccatgcctatgtcctgaatggtattgcctgagttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcatatggttgtatatatgtggcattatttctgagggctctgttctgttccattggtctatatctctgttttggtaccaataccatgctgttttggttactgaagccttgtagtatagtttgaagtcaggtagcatgatgcctccagctttgttcttttggcttaggattgacttggcgatgtgggctcttttttggttccatatgaacttcaaagtagttttttccaattctgtgaagaaagtctttggtagcttgatggagatggcattgaatctataaattaccttgggcagtatggccattttcacgatattgattcttcctacccatgaggatggaatgttcttccatttatttgtattctctttgatttcattgagcagtggtttctagttctccttgaagaggtccttcatgtcccttgtaagttggattcctaggtattttattctctttgaagcaattgtgaatgggagttcactcatgatttggctctctgtctgttattggtgcataagaatgcttatgatttttgcacattgattttgtatcctgagactttgctgaagttgcctatcagctaaaggagattttgggctaagacagtgcggttttttaggtatacaatcgtgtcatctgcaaacagggacaatttgacttcctcttttcctaattgaataccctttatttccttctcctgcctgattgcccttgccagaacttccaaaactatgttgaataggagtggtgagagagggcatccctgtcttgtgccagttttcaaagggaatgcttccagtttttgcccattcagtatgatattgtctgtgggtttgtcatagatagctcttattattttgagatacgtcccatcaatgcctaatttattgagagtctttagcatgaagcgttgttgaattttgtcaaaggccttttctgcatctattgagataatcatatggtttttgtcattggttctgtttatatgctggattacgtttattgatttgcatatgttgaaccagccttgcatcccagggatgaagcccacttgatcatgatagataagctttttgatgtgctgctggattcggtttgccagtattttactgaggatttttgcatttacgttcatcagggatattggtctaaaattctctttttttgttgtgtctctgcctggctttggtatcagaatgatgctggcctcataaaatgagttagggaggattccttcttttttattgactggaatagtttcagaaggaatggtacgagctgctccttgtacctctgtattctgtacctctgtattctgtattctgtacctctgtattctgtacctctgtattctgtagaattcggctgtgaatgcatctgctcctggactttttttggttggtaagctattaattattgcctcaatttcagacctgttactggtctattcagagattcaactccttcctggtttagtcttgggagggtatatgtgtcgaggaatttatccatttcttctagattttctagtttatttgcatagaggtgtttatagtattctctgatggtagtttgtatttctgtgggatcggtggtgatatcccctttatcattttttgttgcatctatttgatacttctctcttttattctttattagtcttgctagcggtctatcagttttgttgatcttttcaaaaaaccagctcctggattcattgatttctttgaagcattttttgtgtctctgtttccttcagttctgctctgatcttcattaactatttgttgccttctgctggcttttgaatgtgtttgctcttgcttctctagttcttttaattgtgatgttaaggtatcaattttagatctttcctgctttctcttgtgggcatttagtgctatcagtttccctctacacactgctttgaatgtgtcccagagattctggtatgttgcgtctttgttctcattggtttcaaagaacatctttatttctgccttcatttcgttatgtacccagtagtcattcgggagcaggtcgttcagtttccatgtagttgagcggttttgagtgagtttcttaatcctgagttctagtttgattgcactgtggtctgagagatagtttgttataatttctgttcttttacatgtgctgaggagtgctttacttccaactatgtggtcaattttggagtaggtgtggtgtggtgctgagaagaatgtatattctgttgatttggggtggggagttctgtagatgtctattaggtctgcttgctgcagagctgagttcaattcctggatatccttgttaactttctgtctctttgatctgtctaatgttgacagtggagtgttaaagtctcccattattattgtgtgggagtctaagtctctttctcgatctctaaggacttgctttatgaatctgtgtgctcctgtattgggtgcatatatatttaggatagttagctcttcttgttaaattgatccctttaccattatgtaatggccttctttgtctcttttgatctttgttggtttaaagtctgttttatcagagactaggattgcaaaccctgcttttttttgctttccatgtgcttgggagatcttcttccatccctttattttgagcctatgtgtgtctctgcacgagagatgggtctcctgaatacagcacactgatgggtcttgactctttatccaatttgccagtctgtgtcttttaattgcagcatttagcccattcacattaaggttaatattgttacgtgtaaatttgatcctgtcattacgatgttagctagtgattttgctcgttagttgatgcagtttcttcctagcattgatagtctttacaatttggcatgtttttgcagtggctggtaccggttgttcctttccatgtttagtgcttccttcaggagctcttgtaggggaggcctggtggtgacaaaatctctcagcatttgcttgtctgtaaaggattttatttctcctttactcatgaagcttagtttggctggatatgaaattctgggttgagaattcttttccttaagaatgttgaatattggcccccactctcttttggcttctagagtttctgccgagcgatcagctgttagtctgagggacttccctttgtgggtaacccgacctttctttctggctgcccttaacattttttccttcatgtgaactttggtgaatctgacaattatgtgtcttggagttgctcttctcgaggagtatctttgtggcgttctctgtatttcctgaatgtgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgtttgtttctttttattcttttttctctaaacctctcttctcacttcatttcattcatttgatcttccgtcactgataccctttcttccacttgatcgaattggctacagaggcttgtgcattcatcatgtagttcttgtgccttgactttcagctccttcaggtcctttaaggagttctctgcattggttattctagttagccattcatctaattttttttcaaggtttttaacttctttgccatgggttcaaacttcctcctttagctcggagtagtttgatcatctgaagccttcttctctcaactcgtcaaagtcattcttcatccatctttgttctgatgctggtgaggagctgcattcctttggaggaggagaggtgctctgagttttagagtttccagtttttcttctctgttttttccccatctttgtggttttatctacctttggtctttgatgattttgacgtacagatggggttttggtgtggatgtcctttctgtttgttagttttccttgtaacagtcaggaccctcagcttcaggtctgttggagtttgttggaggtccactccagaccctgtttgcctggtttcggcagcagaggttgcagaacagcagatattgacaaacatcaaatgttgctgcctgatcattcctctggaagttttgtctcagaggagtacctggctgtgtgaggtgtcagtctgtccctactgggggatgcctcccagttaggctacttgggggtcagggacccacttgaggaggcagtctgtctgttctcagatctccagctgcgtgctgggaaaactgctagtctcttcaaagctgtcagacagggacatttaagtctgcagaagattctgctgccttttgtttggcaataccctgcccccagaggtggagtctacagaggcaggcaggcctccttgagctgcggtgggctccacccagtttgagcttcccggctgctttgtttacctactcaagcataggggcaatggcgggcgcccctcccccagcctcgctgctgccttgcagtttgatctcagactgctgtgctagcagtgagtgaggctctgtgggcgtaggaccctccaagccatgcatgggatataatctcctggtgtgtcgtttgctaagaccgttggaaaagcacagtattagggtgggagtgacccgattttccaggggctgtctgtcactcctttctttgactaggaaagggaattccctgaccccttgcacttcccgggtgaggcaatgcctcgccctgctttggctcatgcttggtgcactgcacccactgtcctgcacccactttctgacactccccagtgagatgaacccagtacctcagttggaaatgcagaaatcacccatcttctacgtcgcacacactgggagctgtagactggagctgttcctattgggccatcttggctttaccctgatttgcatttctctaatggccagtgatgatgagcattttttcatgtgtcttttggctgcataaatgtcttctcttgagaagtgtctgttcatatcctttgctcactttttgatggggttgtttgtttttttcttgtaaatttgtttgagttctttgtagattctagatattagccctttgtcagatgagtagattgcaaaaattttctcccattctgtagggtgcctgttcactctgatgataggtccttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataagatgtaaggaagggatccagtttcagctgcctacatatgggtagccagttttcccagcacctagtttgagattctgagggtaattaactaaatatttgtccgctgagtactagaaatacagtacacagaactcgttgcactgtaagtggaaaatataccctaaaatatactctggattttgaagacagtttgaaaaaatagaaaatattaacatttaattttgattatatgtttaagtgataatatttgaccacttatttattttttctttttgaaatgtgactactaaacattttaaaattacgtgtggcttgcattatctttctattggataacactgacctagacaaagaaattacatttgataggtagctcctgcccatttggtagatagttcatgggctttatcaggctttagaatcaagaggaggaagtatttgatgaaaattcatatacagatagttatttaattaattaaattagttaacatatataaagttcttagtacagtacctggcaaataatatgcactaaataagtttctttcatcaattatatgtgctaaaaaattttctttcatcactgtaattcttgttagtactggtaatagaatagggaggatagaaagtgctccatgaaactgtccgattgacgatggacttactgtgaattaaaaatcaaaaaagaactgagaagttaatgaatgaggcaggaacagagggataggggtgttgaacattgagtgtttcccaagtggctactggcatatgaagaggtttcatattactaggtctcccagtatgtgtctctggctttgcaggatgtgggaggatatctctttgtcatagaagtggaggttcgtagggaggaaggatgaaagcaatgaaggaaggaacaaaataacacagagaatgctctgaactaatagtgaacacattccatataaactcatcctgttattcaagcaggattaacttcttcaagtggcattgatgcttcaagtggcactttaccttggatgtgttttctatagtggaatttgggggcaacatgtcttttataacagaactctattggttaaaaatatttgtaaaccacctccttatggttaaaccagatagatcttcctgttttcaattaaataggttatgtctttcaacttctgtatggagttggtatatttatgcaatgagatggacatttgttcctttcctttcctgtcctgtcctgtcctgtcctgtcctgtcctgtcctgtcctgtcctttcctttcttgtcctgtcctgtcctgtcctgtcctttccgttctgtcggactttcgctcttgttgcccaggctggagtgcaatgacgtgatctcagctcaccgcaacctccgcctcccgggttcaagcgcttcttttccctcagccttccaagtagcttgaattacaggcatgtgccaccacacctacctaattttatttgtatttttagtagagatggggtttctccatgttggtcaggctggtctcgaactcctgacctcaggtgatccacccaccttggcctcccaaagttctgggattataggggtgagccaccacgcccagctggacatttgttttttttctaactttaatgtgtgatctgcagtttcatcagactaaccctatttcacaatccttactttttgagaaaataattaatgctaacttttccattttaaaaattaaaattttataacagatatatgcatagacatatttttaaaaataaaatagtaatacagagtccacaaagaaaatcaaaagtcttctcatgtttatccactactcagaggtatccactgttaaccatttatgtttcattcttagttatttttatattttaaaatgcttatattgctatgttttattttagtttaaaaattatttctccatgctgagaatacaggagatcattgctcacacttcccccttactttccctcttcttccactctttgataattataagaccattttacttcttgtactgcttacttctgttattttaaataatatacttaaactcttatttcttatttcatcaacttttgactctagctttgtaagatgaagatattagcacttctgtcttgcttaacccttttagccctcaactcccatcaaccacaccttcatttttcattttaggggttataacattactattctagtctggaaccttaatgtaatcttattgatattattaatagacttatttgacagtggcaaaaagaagtggacaatccaggatttgaacccaagttctttggctgcgagtccatgaattttgacatatcttatattgggttaatgtaagagttaatttctggagccaacgatagatgaaggatgattcctttctttgcccctttttcctaatttcttctctactatgtttaaagttctttgagcagccacactctagatttctttttggttcactcctatccctcccacctctcaaaattcccaacacatgcaaagtttgtgcatccttccccatgtgtacactttatcacttgatttgcagaactgttctcaccactattcgccttcctataatcatgcaacttccccgcctccccccaccgacttctctgacccaagattaagggaggacaagcaagtcttagtccagctctgtttataatgggtctttcatcccgcagtgtagaatgctagactgtccagtagggatggcagaataaagactcagtcatcccctctagccttatgacagggagggtatttgtaccctttgattcatattttttgggtcttgtcagagttgcccacagtatgatgttttcagttctttttcaagggtgcccttgccagagaggaacagccactgaattgagcttttttgtggtttctggtgggaccagggccaaattgtctgactaagacatctgagtctgcatttaacccacttcatggagagtgggagctagtgtggaagctatgatatagtgtgttctcacccaagagatggcaggcaagagggcattgatgacaggacatgggattgtcagtcttaatgatgtttctcatccatgtacagttatcacagaaagaactttaagaaaaggacctgttctggaggtagatgagactgaaaacgtatcaaagatggcacaaacctgacagtgtagatgaagacaaaggtgttagtgttggtctgcattccaaaggccagtgcttgctctgggaaagaggggaaggaaacatcagcaaaccacccattgatagatccaaataatttgaatttccatgtttgggtttcaatggctaccagagtgcattagcagggaagatcaagtggccaaggtgctaaagaattaagctatgtgacagtaatccgtaagtgatttccaagtctgtagcaaacattttataagccttacaataataactaccatgtactaggtacttggtttatgtcctttcaattattattatttgtatcctacagatgtggaagtcaagacccataatggccaaataacttgtagaaggacacatagttattaacagaagctagtttaaaacagatttttgttactccagggactgtgctctttctactaccctgcactctgaaccctgctttgtggggctcgtatcagaagattaaaaaaaagattaataatgcctgtcaccagttcaatggatatatacattgtggcaaattgtcattattctatagcaatgagaacaaatgaactagagctgttgttcaccgtaacatagatgaatctgagaaatacaaggttgagttaaaaaaaaacagtcacgaaagattacctgctatatgagtccatttctataaagtgcaaaaacaggtaaaactaagtgatgatgttagaagccaggttagtggttacctccaagagtcggggtgttactgaaaaaaaaaaaagaatcacaaaggggctttcaagggttcaggtaatattttgttgttttgaccttgggtgctgatgacatgggtgtgttcagtttgtgaaaattttttgacatttgtatagtgtatttttcagagtatatgttataatttcaaaaaatggaaaagaacattagaaaaccttaatatctcctttgtagcaccttccaccagcaatccgtgtttcttcatacatggagacaatggctttatgggtttatcctcctgattatcctcatatatggaccttcttcctctatgatgactttccttcccttttatctcataggtgaatttccctaagcagtatatagtattgttttacataatatactggttaagacagtggactctggagccagactacctgggtttgcatcttggctcttcaacttagtagctggtgagtgtaggcaagtcacttaacttctttttgccttagtttcattatctataatatgggataaattatagtacttaccacatagagttgtggggataaaatgccttattatgtgtaaaatgctcagaatagtttggtacatatagtacataacatacaaatgtttgctactactgattttcatatttataaaaaaggaatgatctgcaggtgctcttttatatattgctttttttctcatgatttcttaaacaattatcttttttttgagacaaggctttgctttgttgcccagggtggagtacagtggcacaatcacagctcactatagccttaaactcccaggctcaagcaatcttcccattgcagccacccgagtagctgaaactataggcatgtaccaccaaacctcacaaatttttaatatttttgttgagatgaggtctccctgtattgcccagactggtctcgaactcctggtctcaagtgatcctccagccttggcctcccaaagtgtttggattgtgaggcattgtgccaggctcattctcttattgatggatgagtcatttgcttccattttttatgtgagtgcaaacaatactcctgtgacagtgatttacatgtctccttgtgcatatttcaactcttctcctgggtatatacttagaaatagaatttctatgttgtagaatctatgcatttttactagatgtgttgccaaattggtctacaaaatggttgtgtcaatttatatcatcactcatcactagcagtataaaagtgttttatttgctgcatatccaaggaaaatgagttagttcagaaagatgcaagagaatttgattcagcaagtgtgtattgtgtctctaatctgtatatagagaaggaagcagtcactggtggaagagaaatttgctgtacagacacagagcagctctacttaataccaaccacatatgtaaagtatctggcatagagtaaacccctttgctcaagcaatctgggaatgtacccacacagctgatgtggtaatgttattaccctcttacaaggtaatctatgtctgaaaaataatgtggcacatatacaccatggaatactatgcagccataaaaaatgatgagttcatgtcctttgtagggacacggatgaagctggaaaccatcattctcagcaaactatcgcaaggacaaaaaaccaaacactgcgtgttctgactcataggtgggaattgaacaatgagaacacacggacacaggaaggggaacatcacacacaggggcctgttgtggggtggggggttggaggaggggggaggggggaggggtagcattaggagatatacctaatgttaaatgacgagttaatgggtgcagcacaccaacatggcacatgtatacatatggaactaacctgcacgttgtacacatgtaccctaaaacttaaataaataaaaaaataaataaataaaagaataatggccacatttagcctgaagagtagagggtggaaagggaatattatcttgttgtcagtgacatagaatggaccatgacccaggatgaggtcatattttttccatctcccttgccatccttcactagagtagaagggaattgcatcaaagagcggagagacactagttttctcttcccgtctataaccaaagtgaaactgttatctgccccttctccctatcccggtgccctttctacttgaactatttgagagcatttttgtaattacaagggtgatctcgctgaaatgaggtttccttttgtgagcttgtaactcggttcctaatattagctggcttcaaagtcatgtctggagttgacaggagatacaggaaatcaagagcatgtatctccctaaattggattgtaatttggggattccctgtttttggaggaaatgtcaaatgttctatatctgagttttccactacaatagcttctagcaacgtgtagctactacatacttgaaaggttactagtgtaactgaaaaactgtattttaaattttagttgattttagttaatttaaggtaatgtagccacctgtggctattggtagctgtgtaggtctaataaatattttgttggtagaggaaggtaagggagctaatatttttttttcagtacctgctatgcattggggtctatactgccatctaatttttacagtaccctgtgaagattttatcccccattttacagaacaggaaaccagagctcagagaggatgacctacttgttcaaggtcacacaggctacaaaatggcagagccaggatttaaatacaggtctttctggtctctccaattccaaagtccattctctttatcctgaacagggtggtataattttgttcttgctacttggcttcagccatatgccagaaaagcttaaaattgaatgccttctaacagtaattccatattcttaactgttaatttgcattagcaaatgggtttctggaagctctaataaatgcataccttgcagatattgtgtgttcagttccagaccattgtaatgaagtgaatagtgcaataaaatgagtcacaaaaattttgctttccaagtgcataaaagagttacatttacaccgtactgtagtctattaaaggttcaatagcattatgtctttttttttgtctttttttttttttaattttttttgagatggagtctcgctctgtcacccaggctggagtgccatagtgcagtctcagctcactgcaacctccgcctcccgggttcaagcagttctcctgactcagcctcccgagtagctgggattacaggagtgtgccaccacacccagctaatttttgtaattttagtagagacggggtttcaccatgttggccaggctggtctcaaactgctgacctcaagtgatccacccacctcggcctcccaaagtgctgggattacagatgtgagccactgtgcctggccctcaatagcattatgtctaaaaacaaaatgtatatgtaaaattaaaaaacaaactttattgctaaaaaaatgatgctgacacagagacatgaagtcagcacatgctgttggaaaaatgatgctggtacacttgatccatgccaggttgacacaaaccttcaatttgtaaaaaattcagtaactgtgaagcataataaagcaaagcataataaaaatgaggtgtgcctgtatattaagattccagggactttggtaatgatataggagttaagaagaaatcacttaggcagatagtaagggtataggagtccttggtaagacttttctttttaatgaaaagcagcctcaaatcattttctaacaatgcgcagcctgtaaagtcgagctgcagacatagacaagcaagctgagagcttgcatgagtgaatgctggcaggaactagagactagatatgttcaagatggctcctccatcatcctttctctgccagccatgtgtacagtaagaagcagacaagatagtgcccgccaaggagaattcatttgtggaataagattagggcggtgagaccagccttccccttgctcctgatcaaaccaatctgtgagccctacctaaatcagacactacctcctcaagctggaccataaaatctggtgcattcgcagtgagcaggtcctttccttttggagacccccctctctctgtagagagagctgtttctctttctcctctcttctgcctgttaaacctctgctcctaagctcctcgtatgtgtccgtttcctaaattttcctggcaagagatgacaaaccccagacaacacagccacttcagtaatgactttctgtcctaggatatttgggaggaataataaatgcctaggaacaaagtgattgaatgagtcagttaggctttttgtatatttttagtcaaaaatcattataccatgtcttagggttcttcaaagagacagaacaaggggtgtgtgtgtgtgtgtgtgtgtgtttgtgtgtgtgtgtgtatgtagagcggggtttagtttaaggaattctcttatatgattgtacgggctggcaagttcaaaatctgtagggcaggctggcaagatggagactcagggaagagttgatgttgcatctcaaatccaaaggcattccctcttcctcttcctcagtcgtcttcctcagtctttttactcctgaggcctttgactgattagatgaggcccacatatccgcaagactactggtttaaatgttaatctcatctaaaaactatttctaagtaaatatctagactagtgtttgagcaaatgtttaggtaccgtggcatggccacaatgacacataaagttaatcatcaaacactatgagaacttttgttgttgatttaattactttccttttccgtattcacataacttttatttcagtatattgttataatttttgttgtgctattttagtagttattgttgctcatctcttactgtcgctaatttataaatttaactgtatcatatatatgtatgggtaagtgacttaagaactcttgaggcaggcagttagaagtttcagtcagtgtcctccaggtcttttctccgtggttctcttagacttcacctcagggtcataagatggctgtcacagctcaacatattacatactcacatgttagcatcccaagcagaaaggaagtgggggagctcttttttttttttttttttttcttgaggcagattctcgatctgcctcccagtctggagtggtgcagtcttggcttactgcaacctctgccttccaggctcaagcaattctcatgcctcagccccgcccaggtagttgagattgcaggcacatgccaccacgcctggctaatttttggattttttggcagagacggggtttcaccatgttgcccaggctggttgtgaactcctgacctcaggtgtttgggaagccgaggcttcccaaattgctgggattacaggtatgagccaccatgcccagccataaagggctcttttcacatggcatagtttgtcttttatccaagagaaaaatgtcttaccaaagttgccacctgactttccctaataactcattggcaatagcggagttgtgggcccactcctaggacaatatttaggaaaaagacataggagtactaaaattcccctttggcctgggaggggggctcacttttttttggagaacgttgcttgcctgcctgatatctgaagaaataggaagaaagaggatggctattgaattggcaatgaacagtgactgtcataatggccttttgagaatagagatgctggactctaaccaggagcctctggaatatattcaaagggcaggaaagagaaaaatactggttatctatctatagtactttaatataataatcacagaggcactttcaccatatcttgttttccaaagagagattgcctcaaagacccagagagggaatgtgacacctcctaggtcctacgggaagctagtggcagagcaaggaataatactcatattcttttgctaccttcatgctgcttgtaccacttttgttcctccagcaggtcttaagcactgttccacagtgagcaggtctatgcacacctacccctgaagtctaagaaagctgagaggcttaagaaagaagctgacatatccagtttctgagagagaaacatgtaatagatgtttacaaatagaagccatagtcttgggcagcagtgagacaagatggtggatccctgtgccgttaccccctagacgcagggcgtacataccacagggacggaatgtgtaggacaattgaagttgacctgcccggcaaaggcaagaatgctgtgtgaatctttctaagggcaggatctatggtcaaagttattctgatctacgggcaagactgataacagtagataaagtagaaatcttagaggcatttccagaacagaggttaatcagaagtcaatatagtagatttgcatccaagatggagttgctttagcttctacaggcactttaagaacatatttggcagtgatttctgcctatatgatgtaagcatattgtggtttaaaaattttaaaaaatttaactgaaattgacttattactatccatttatattgtagcttacatttagcagcagaagagaccttcaaagttattagtcccacctcactttacagttgggggaactgaggcttagaaggttaagtgactgacccaggagcatagatggttagcaggggagatgggatcagaacccaggtcgcctgattcctagtcagatgtaatcaccagttcttcagagatattccataaatataatattttgggcagagctgtatgagttttatttttgttcaaattatgctgagataaccttgtagacccaatgtcttggccctcatttaacccattcctgctttagccatttctcttcagaaagaatcagatgcacctttttgcatcacagtttccttatctgaaaaaaaatgaggataatgaactatatggtttattttacttataaagttctatgattaatacaagccaagactagagcctagctgagtctccagatttctgttttgaaaatcaaggggtgtatttttattttaataaactactaagccaatatttatccagacaacttagttaatataacttttttttttacttgcttgttttttaaccaaagtgggtgtttaaaaatttgtctttcaactggcactatgttgtcagtctcaccaggcacagcaatcttcgaggaggtccatcttccaaagccagacttcctctaaaaaaaaactccccaggaaactggcttctgctcacagtaggatatgcatgtccagaggattttttttcttatttacttatgtagcctctgtgtgtgtgagataaagctgcttctcacttccgttgacaattaggaagtggctggcattagtaggcaagtaaggggggaaaagccctgcaccccaaccagaattcaatagttaaaaggaaattgttatattgttttcaaagcatttactttcctctccttgattgtatcaaggaagatgccaattcatcatcatcattgctattcttatgaaacactcaatatgtattaaatatttatcatgcaatctcttttgagcctttcgacaactctatgatgcagtccctactgtaacatttattttgtgaggaaactgaggcaggaaaataagaactttaaacaagctggtgtttgagttcatgggtaaaccctctcattggaaaatgggaaattgttggtagatgatgttgcctgatgatatgtatggcgatttaatttgggctcagatttttagttctttaagacagtattattgccaggaaatacttttctgagaaccccagaaaaccttgcatattggttagatatcataagaataacataacaaagcatcccaaaattcagtggcataaagcaataagcatttatttctggctcacacatctatgggttggctgaggtagctttgttttttttcaattaggttcgatggggcttggctcaggccacaagttccatttaggtctgctgtatgtgtctcaatttttcagggatcagagggtcacctgaggcagattattctcaggatggtggcagaagtgcatggtgggtaagcagagacacgtgaggtctttcaaagctaggctcaaagccagcctaccattgcttccttacaaattcagttggccaaaacaaatcatatggccaagcccaacatcagtaaggaggtgaaatacattcttcctttagcagaactgcaaggtcacatggcagagtacatggatacagagaggtggggggaaatttgggaacaataattcaatctgccatgccttggctgaaaagtagtggcagtaggaagtcagaagatgagagctagaaaagatactctgatggagagtgagaggtgtagtgggaagatccttatggttaggagatctggttttgagtcctaactgtgacacttttttagtatgaccttgaacaagtcattttccttgatatttgagcattaagggtccatgtgatgtcttcatcttatattttcacttacctagataaggatgtagagtaaatgaatgcaatgattagtctatgttcaaacagctaggttgaatcagtaaagactggaactttgagttctttttccattcctcaatcttcattgctttagaagaatagttaatatttgaggaggggccaggtgcggtggctctcgcctgtaatcgcagcactttgggaggccaaggcaggtggatcacgaggtcaggagatcgagaccatcttggccaacatggtgaaatcccgtctctactaaaaatacaaaaattaactgggtgtggtggtgcgtgcctgtaatcccagctactcgggaggctaggtaggagaatcgcttgaacctgggaggtggagattgcagtgagccgagattgcgccattgtactccagcctggcaacagagtgagactccgtttccaaaaaaaaaaaaaaaaaaaaaaaacatttgaggaggggtgttgggagaggtttcagctctcctccttttctcatgaaattaaagctgttttactacaattcttctttccacattaccatgcttatctgttttccatttcttcaaagccctgaacaaggagaagtaggccaaaatcataataggaagaactgaagttcaggcagagtaagtgctttttgcatgtaactgtacttaaatgttatatattgttagggaaactggtaacattgctgtccccaaagatcttttagagaggcatctgttgctatgtgatgtgttaagtggagttattcctgaaagaagcacagtgggctagatatgactcatggcctcttctgtctttatgctattataacatatttatatgtgtttatttgtcagacattcatatcatgctcatatagtgccagatattcttctaagaagtctacaggtactaattcatttaatcctcaaaactatgagacagggagtcttacttatttctgttttacagattaaaataaacgcaaataccaaacacgaacaaggaacaacagcaacaaaaacctaaggcacagggaggtgacataactttggcacagtcaagcactagaaaggagcagagctggtacttgaacccaggttatgtgattccagagtccacgcctttagccacgtggcacataggcatcagaactgagcaggccaactctgctacttactagttctgtgacatggagtgaagtacttcactcctctgagccttgttttcaactctaaaatgtgaacaataattatatcagcctcacagggttattgtgaggattcaatgagatagtgcataaaaccatgcttggcattgaaacattagttctatttccgtgaaatacttctatacattttaaagatgactttataagtcttccttttaacttatagtttatgaactcttacaaggtttataatccttggcttgattgatttatctgtatgactgattccttagcagtctgtaagacaatttggccttgccatttctgtctaacataggaaaagagcaatgaggcaatttcccttggggcggagattaagagccagtgaccccatgtatcttggctgtctgagaagttgctgaactgtgccatctcctttttccacatttatccttaccttaaaaatagtcatgaatctgaattttgtatatagtgttgaaggtgaatctgacattatagtttttagagttctcattcattatgctcgttattttttctcttgacaccccagcaagaatttaggaaacctttgctggagtgcccttgtgaagaaaggccttagtttgttacatgccaaagtaccatgtcctgctgacaagaagcgttctcctcctatacaaagagtgatacagtattcactcagagctcacagccctgcctgttccgcatgctgggatcctcggggactggtgcaagtgggtggaggaggttatataagctcacatctccttccaagtgggaagaggcgagggacaacagctgtcagctccacagctggtcttgccagcccaagtgattccaactttatttgatcagagaagaaggcttctcagtacacagaggggagatttgctgatccagagccaatgttttaaaactttggcaatttgtgctaacttcctctggctaggacagatgcttattggctctggctgcctggacatggtgttctcgaggcattttgtgtcatcctgaattgggcccagccagctgctcatctataggagattctcaaggaatggtgcaaagctcattacccttagacttttggttgggcagttgctcttgcatcagtatccatttcattacattaaactaaaagaataaaataagttctcaaaaggcagatataaaacacagcaatctccataggccatttttttatttttaattttttggggtacatagtaggtatatacatttatggagtacatgagatgttttgatacaggcatgcaatgcataataatcacatcagggtaaatggggtattcatcacctcaagcatttatcctttgtgttacaaacagtccaattatactctttattttaaaatgtataattaagttattattgactatattcactctgtattgctatccgatagtaggtcttattcattcgttctaattttttatactcatttaccatccccacctccccatcatccctccactacctttcccagcctctggtaagcatctttctataccctatgtccatgagttcaattgttttgatttttagatcccacaaataagtgagaacatgtgatgtttgtctttctgtgcctagcttatttcacttaatataatgatctccagttctatccatgttgttgcaagtgactagatctcattcttttttatggctgaataattactccactgtgtacacatactacattttctttatccattcatctgttgatggacatttaggttgcttccaaatcttagctattgtaaacagtgctgcaacaaacattggagtacagatatctctttgatacactgatttcctttctttggggtatgtacccagcagtgggattgctggatcttatagtagttcaatttttagttttgtaaggaacctccaaactgttctccatagtggttgtactaatttacatgcccaccaacagtgtacctcagttcccttttctccacatcctccctagcatttgttattgcctgtcttttggatataagccattttaactgggtgagatgatatctcattatagttttgatttgcattgctttgatcaatgatgttgagcatcttttcatatgcccgtttgccatttgtatgtctttttttttttgagaaatgtctattcaaatcttttgcccatttttggtccagttttcttttctgcttcaataggaaagcactgagttcaatgcatcacaattgctgtgttctccctcctccagcagccagagatgttctctgaaacatgctgctgctgccaggagttggcagggtggtggtgtctgcaattctggactgttttatctatctcctcagtgtcctttcggcgatatgaagttacaaccaggtactttgtactatgagtgcttacatgatttttggttctgatgaaggtatttttttctgtgtagatagttgttaacttggtgtcactgcagtggagggggacaatcggtggagccttctatttcgacatcttgctctgcatctttccacaataattggcaatttattcttttaaaattttgagatgagtggagtgcagtagcgtgatctcagctcattgcaacctcccacctcagccttcagagtagctggaaatacaggcacaccccaccatgcccagctaatttttgtgtgtttttttttttttttgtagagactgggttttgccatgttacccaggctggtctcaaactcctgggctcaagcaatcctcccgccttggcctcccaaagtgctgatattacaggcatgagccactgcgctccacctggcaatttattcttgatttactgtaactctgggaaggacatggctagcacataacttaatgtcaacatttctttttacaactgaaaggaatattgggcttttgggatgcatctcttgtccttggtggactataagggtgttgaaagccagttgtaatggcctgtcctctgtagattcccctcagaactaagtctatgcctgttacaagcttagttactatatttatagctagcacagataagaaatctatgtgatggaatattaaatttatgcctgacaagcaaaactatagtaaagagaaaatttgcctacggccttaaatactttggagacagacaaatttacaaggacagtatgtgaggtcggggttataatatgatcgtgtacacagagagagtacaggaaggactgcaaacaaagataggatatggggatattgaggaagacttagagaagacaccactgagaagatgatacatcttcttgtatggaatcttgaaggacgatttgaaattagccagtgaagtggagtgtgaggtacaaggatgctaagtggagggctcagcttgtacaaagaaagttttcaaagtacgcgttgccatctcatgagggatcatgtatatcctctcaaggtgagtatacttagtcctgtagttgatatggaacgctttgcagcaggggaatgtagtaaattttagatagtttaacccacctcttactggttttttgcattgggtaagatatttaatcttcctgaggtttagtttcttcatttgtaaaacagtactactaaagtttattatacagcaactttgatcattaaatgggggtcaaatatctagactatgcatagtatattagagctactcagaaaataacagattctcttctctttatactcatgtttgatttcctgtattacattatattttaatttagcaagtgtatcttgagcacccattttcgcctatttcaatgctaggccctagggatggagttgaataagataccgtccttgactttatggagctacaagttatgtaaactaactattctaaccacaagaccatggtttcttgtctcctctgtgccactgggcaaccatcgacccactcattttctagccttctgcaaaactcctctttatcctcacctatctttgcctttttatctctcatcccagaaaacatcctggcccttctcctgcccatagatgatctcttcatttgggttttttatcccactccttgtattttcttattttttctccctccatatagcaacacacttaaatccctcttgcattaaaaacagagccccattcttactgtcaaggcctggaaggactacagcataacagttttggctaaatgatgatagtcaacacattgtagcaataggaactcaagagttgacattattttaaaacggaggtatggtacctcaggatggttttttagcagggagcaaggtgcttagttcagtggtggtaggaaggggataatggcaagtgtcaaagttgtccataaccggccaggcacagtggctcacgcctgtaattcccgtactttgagaggccgaggtgggtggatcacctgagggcaggagtttgagaccagcctggccaacatggtgaaaccccgtctctactaaaaagacaaaaattagccaggcctggtggcattgcacctgtaattccagctactcgggaggctgaggcaggagaataacttgaacctgggaggcagaggttgtggtgagcggagattgcaccattgcactccagcctgggtgacaagagtgaaactccaactcaaaaattcataaataaataaataataaataaagattttccataaccaaatatgatccagttatagagggcatgactatcaatggagggtgtgattcacacaaaattcatctggcactcaagtggtatgcaaggtagagactgggaattctgaaccagatagaagtcctgatgtttcaaatgggacacaaagtcagagtcaggctggtagccacattgacatgacagtaaatctagtgtatggggctggagttcttaatctaccctgtctcattgtagacttggtctcagcaactagagccaaggtagacctatatgagcaaattaagtagactccactcttgaaagaagaaacgagtctgctaaatgccttactatttaaataaggaaatctttgagaaagtatgttttatatagaggaaatcatatgaacaaaaagcacagtatgaaaaagtgtggcatatttggggaacatatagtaatctggtgtgattagaatatacatgtttcatacaaggagtgcaagaggtgaaactggagagtagattggcgtgagactgcagggccttgaatacgaggctaaagagtttatacttggtactgagttaagtctactagtactgtcttatacctggtgtctgtgggatctcatttaggggtgtgctgtgtccttaaagcatttccttagtgcctttccttataaaatatatggtggtttcttcacaaggttatctacttctacattgggaatattgagagtcagaaggttaagatttttgtttaaggtaatgtaagtagtaaatggaaaatgcagaatttgaacgtggtttagtgccctttcctagtatataacctagtatattgtcgaggttagaagtaagggctttagagtcaattatgggtttgaatctccatttcttttacttctattagcttgtgcaactttggaacagttcgttttctgaggctcaggctcattcctcttctgtaaaattgggataagaatagtaacattcacaggcttgtatgaggattcaaagaggtaatgcatatcaagtgcttaacataacaacttacaaataatactcaataagtggtaactatttctagtattacattaaagttatattggaaaaatgtgtttttacttgaaaaagttaactcagaatatgtagaataaaaggagttgatccagtattctgatgttatagtcatatttggataggaattcatgcttgttctgcactgaggttgcaaatttgcttcatgtgttcattcactgattcactaaacagatgttaatttggccacactctgtacctgacaccattccttgtacaatgaacaggacagatgaagtctctgcttatgtagaccttacattttagtggtgtgccagagggtgggaggcagatgttaaacaaataattagataaataatttcagattgcaacaaatgcaataaatgctttgaagacaataaaatcggtgattcgatgttacttgtgggggtggagttggtctagggcaactttagaaggagtcataatggacagcctctgaaaatgtgacacttcaggtgtgacctgaacattgaaaagaagccagtcatgagaaaaattggagaaagagtgttctagtcatggcaagcgcacaaaggtcctgaggtaggaacaagcttagtggtttgtctaaggaactaaaagaaggccattgtgtctgaagtgaacactgatgagagagtgttctggcccaggccagatcataggggattttgtaggtcatagtaacaactatggattttatcccaagcacagtgtggagtcctggaagtttttaactgtggggaatgatatgatcaatttatatgtttttgataataataatagcttttgtttattggacagatacagtgataagcacattacatgcatatatttcatcagtcttcacataacccagtaaaatatgatgttatttttgtgattattttagagattaagaaatctgaagcttagtaaggttaattttttaaaggtcacaaaattattgttatttatagaaccaagatttgagtttgagtttatctgatcctaagcctacatggcttttattaagctaaaatatatataacaggccaggcatggtggcccacacctgtaatcccagcactttgggaggccaagacgggcggattactcgaggtcaggagtttgagacctgcctggccaacatggtgaaaccctgtctctaccaaaaatacaaaaattagctgggcgtgatggtgggtgcctgtaatcccagctactcaggaggctgaggcaagagaattgcttgaacctgggaggtggaggttgcagtgagctgagatcgtgccactgcactccagcctgggtgacagaacgagactccaggtcaaaataaatacataaataaaatacatataacaacattggctattttaatcattttaagtgtgtaattcagaaatattgattgtattaaaaatgatatgcaaccatcaccatcaaatatttccaaaacccttttatcaccccaagcagaaactctgtacccggtaaggaatgactccccattttccccagccctggtaaagtctaatttactttctgtcttctctatgaattttcttattctagccaagcttgctggctcatgactgtaatcctagcactttgggaggccgagatgggcagatcatgtgaggtcaggagtttgagacctcagccaacatggtaaaaccccgtctgcactaaaaatacaaaaattagccaggtgtggtggcacatgcctgtagtcctagctacgtgggaggctgaggcaggaaaatcacttgaacccaggaggcaaaggttgcagtgagccaagatcgcaccactgcactccaggctgggcaacacagtaagactccatcttaaaaaaaaaaagaattttcttattctagatatgtcatataaatgaattcatactatatttctctttttgtgtctgacctatttgaattagcataatgttttccaggttcattcatgttgtagcatgtatcagaagttccttcatttttatgggttaataatattccatctagtgtatataccacatattttttgtccatttatcaattgatagacatttgggttttttccaccttttggccattgtaaatactacagggaacattggtcaccaagtatctgcttgagtccctgttatctattattttgggtatatactttggagggaaattgcctggttatatggtaattctgtgtttaaatttttgagaacatgacaaaatatttacctgggtgcctgtaccattttactttcccatcagcagttcacaagagttccaatttcttcacatcctcaagaacacttattttccacatatataattttcatttctaatttttttatagacaggatctcagcctgtcacccaggctggagtgcagtggcatgataatagctcactgcagccttgcattcctgggctcaagagatcctcccgcctcagcttcctgactagctaggaatacaggcatgtgctactgcatccagcttttttttttttttttttttttgtagagatgggggtctcaccatgctggtctcaaactcctggcttcaagcgatccttctgctttagcctcccaaagctctgggattacaggctattttctgtattttttattttagatatcctaataactgtgaagtcatatttcattgtgattttgatttgcatttccaataactaatgatgttgagtatcttttcatgtattcgttggctatttctatatcttgtgatatggccatatgtctattcaagttttgctcatttattttcttattgttgagttttttctttttttgagatggagttttgctcttgttgcccagactggagtgcaatgacgcgatctcggctcactgcaacctccgcctcccaagttcaggtgattctcctgcctcagcctcccaggtagctgggattacaggcattcaccaccacacccagctaattttttgtatttttaatagagacagggtttcaccatgttggccgggctagtcttggactcctgacctcaggtgatctgactgcctcagcctcccaaagtcctgggattacaggtgtgagccaccgtgcccagcctcttattgttgagttttaagagttcattttatgttttgcatactagacctttgtcaaatatatatgcataattgtgtataattttatataaatgtgatcatatagcgttctgttttgtaactttttttaatactcactaatatcatggatacccctgtaggtcaataaatgttctcttacaatttgtaatgactcataatgttccattacataaatgaattataatttagtttgtttttatttctttgttccactttgctattattaataatggtatagcaaacattttcgtgaaacatgaactgaagcagatagaacagcaatttcattggaactttttaacatttgcctttctgaaactgataataattgcccaggaaaaataagtgacaatatcaaaatcttaacaatacaataagtttgagctattttatttacatagaatacacagaactttgtatccaagaaacagggatacatgttcttttgggtacacagacaacattaagaaatataaactatgcatcaggctataaaggaagcctcaaaaattcaaaagattctatatcacatagagtatgttttctaaccataagaaaataaaattaaaaattaatgataaaacattccatatttgggaactaacaaaatggcaaatattctttgggttaaaaaaataaatatattttatgatgaaatgacaatgaagtcagtatatatccacatttgtgggacacagttcattatgtagaaaggaagttcattgctttagatatattgatcaacaaataagaaagattaaaaacaaatgtattgagcatttaaattaaaaaaattgataacaacaacaaaacctacccgaagtgacaaaacagctggacatataagacttaagggcagaagtgaaataaattaaaaaacaactataacaataaaaaatggtagaggtaattaacaaagccaaaaattagttattgaaaggattaacaaggtagactggtaggaaaatgcaaacaaacacagtagagaatatagagtaaaataaatgaaatattacagacacaacagatttgttaaaaagacgaaagaattataacacatttgaaaaaaaagagatgaggttaattcctagaaaaatgtaaatggccaaaagttggcaaaaggaaagagggagactgagtagacggatatatattaaagatattgaaatggaattcatacttcccctccccttcactccctcagaaaaagtggtccccaaaaattttaaccttagaaatgagtcggttcaaatcctttcattactagtgtaaaggagaaaaacatgtgcttattgtaatcaaattagaattgcaggaaaattaagtaaataatatttatatgataacctatagcaaacattatactaaatggagaaactttaaatatgttcatcttacgatggagaacaagagaaagatacccatttgtctactattgtttaacccagtactggagagccccactaatactgttagaatgaaaattggccgggcgcagtggctcatgccgataatcccaacactttgggaggccgaggcgagcagatcacctgaggtcaggagtttgagatctgcctggccaacatggcaaaaacccatctccactaaaaatacaaaaaattagccagacatggtggctggtgcctgtagttccagctacttgggaggctgaggcaggagaattgcttgaacccgggaggcagaggttgcagtgagccgagattgcgccactgcactccagcctgggagtgagactccttctaaagaaaaaaaaaaaaaatagaaaaggaaagaaaattaaataagtgcacaaagatgggaaggaaagatttaaaattggttactatttgaaaaacattacaaaacagcatggtgttatttgcagatgatataattatataactgggaaaatcagcagcatcagtaaactttataaggactaataagaaattcaccagattggcaatgacacgagtaatttgccaaagttaatattatttttaatacgtgcaataagtaaccagtaaatgtgataagtaatattgatacgggaggggggcaggcaagtgctaggaagagaaaggcccggtccctggctagggctccacccctgggcctgtgcccacggacctaggtgaggacaggcatttctgttttcatgccaaaatgttgcattttccaagaccaccctggcccgccatgcccccatcctttgcctataaaaaccccaagaccctagagggcagagacacaagtggttggacatcgagaggaacacacaggcggaagaacacagccgcagacaccagcagataccaggaggacaccggcagacaccaggaggacaccggcagacaccaggaggacaccggcagacaccagcagttgccagcaggtcatctatggcgggaagacgctgagttcagccgagggcggtcagaggagaggcaggagagctcggcggctgagcggcctgactcctggggaaaaccaacttcccactccatcctccttctggctccccatccatctgctgagagctatttccatcattcagtaaaaccttgcactcattctccaatcccatgtatgatctgatttttccggtacaccacggcaagaacccgggatacagaaagccctctctccttgtgataaggcagagggtctaatttagctgattaacacgagctgcctatagacaacaaaactaaaagagcacactgtaacgcacgcccactggggcttaaggagctgtaagcatttgcccctagatgctgccttggggttaaagcccacatgccccacaacctgcccatctgcatgcgccccctagaggtttgagcagaggggcaccgaagaagcgagccacagcccagtctcatgccctgtgaaggggataagggaacttttcccgtttcaatatcattcacattagcaataacaactaaaatatgcagaaattattttcaaaagaaatacacaagatctctattgggaaaaacattaaaatctagtaaaggacatggaagaaaatataaataaattctagacctttcctcttttcaaatggatttcgttaatattatacagatgttaattctcctctaattaatctataaattaaagtttagttgggtttttagcttaatatgcacaaatagctaagttaaccttaaaaaaaaaaagacaaaagaagggagattttctctaccaggcagcacacatattacaaagtcagtggagtgaaaacagtcggatattggtcctcaaacagaaggctagtcaaacagaatagatagctgaagttcaaactcacatattaatttaatataaaataaaaatcgcactccaaattaatggggagtggaaaaattcataggtgattataggaataatgaatctctatatagagaaatataaagctggattcctacgtaacatcacaaacaatgctgaattccaggcggatgaagggcctagaagtgaaaggcaaaactcaaaggttgtttctgtcctgtgtatatacccttttctgataaatatatggaacaaactaggaattcaagggaacttcttcaacctgattgatggcagctgtaaccaaaactagaagttaacatcacacataagggaaagactaaaatcttttcctctatggtaaagaacaaaataaggatgtctacgttcttcactttgattcaacattgcactggaggttctagttagcataattagccaaaattggaaagaagtaaatctatctctatttgcagatgacttcatgttgtatatagaaaatcctaaggaacacacacacacaaacacatacacacacacacagaactaatgaaggagttcaacaacattgtgtaggatacaagatcagtatataaaaataaattttatttctatctactttggaataaaattgtatgtctattgacattaataatgtgaacattaagaaaacaatctgatttaatcaaaatgattaaaatacttaggtataaatttaacaaaagatgtgcaagacttatatgctgaaaactacaaaacatcattgaaagaaattaaagaagccctaaatcaatagaaagacaagctgtgttcatgaattgaaagccttaatattgttaagatggcattactcatcaagttgatctacagattcaatgcaagccctatcagaattccagctggccatttcacacaaattggtaagatgatcctaatatccacatagaaatggaaaggaccagaatagaaaaaaatgtcaaaggcaaatttttaaatttcaaaacttactacaggccgggcgttgtggctcacgcctgtaattccaacactttgggaggctgaggtgggtggattacctgaggtcaggagttcgagaccagcctggtcaacatggtgaaaccccgtgtctactaaaaatacaaaattagctgggtgtagtggcacatgcctgtaatctcagttacttgggagggtgaggcaggagaatctcttgaacccagcaggtggaggttgctgtgagccgagatcgcactgctgcactccagcctgggcaacaagagtgaaactccatctcaaaacaaaacaaaagaaaacttactacaaagccacagtaatcaagatagtgtggtgctgacataaagatagacatatagatcaatagaataaagagtccagaaacaaacatttatggttcactaataatttacaaggatattaaaagcaatcagttgggaaagaatactcttttgaataaatggtgctgggactaccggatatttacttgcaaaagaataaaggaaacatagtacatccatacagccaaataatattcagtcataaaaaggagtggagtaccgatacatgctacaatatggatgacccttggaaacattatgtaagtttaagaagccagtcaccaaaggccataatgcagattccagttaatatgaaagatgtagaataggaaaatccatagagatgaatgtagactgtggctttttgaaggtgggtggaagggggaatggaaaatgattactaatgtgattaagatttctttttggggtgatgaaaatattttggaattagataacagcagtggttgcacagctttgtgaatatgctaaaaaccactgaattgtacactttaaaaggatgagttttatgatatgagaattatatttcagtttttaatttaaaaattgaatttgaaggagaaagtattccacagaatcttatcggtccttggtgaaggcagtaaggttttctggcccatgcttttctcaaataattggtactttaaattgattcaacagctggaggaacagtttgtccttcctatgttttgtgtgaaaatgtctacctcctgtgttttggtatctgagttagggttgggctatggaacttctcgagttgtattcctaagacgtcttgattatttataagccccatgaatgttattccacccatgataatctgggctacatggactgtgatcttggatgttagttcagcttatttgaaccttaatttcctttacaatatctgcttctcagtgttgtaaagtctaaatgagataatagactttaagtgtctatcatagtgcctggcctgatgtaggccttggttaatgaatgttagcttcctccctacacgtttcccttcattaaaaaaaaatagtaaaaagcacatttctttctttcttccctgtccaccccgcctgaaacagagtcttgctctctcacctaggctggaatgcagtggcacaatctcggctcactgtaacctccacctcccaggttcaagcaattctcctgcctcagcctcccaagtagctgggattacaggcgtgcaccaccaagcccagctaattttttttctcttttttttttttttgtatttttagtagagatggggtttcaccatgttggctaggctggtctcgaactcctgacctcaggtgatccgcccgcctcggcctcccaaagtgctggcattacaggcatgagccactgtgcccggccaaaagcacatttcttatatgtcacaggtcactcagctctgccctagcttcctgcccagcaacagattgcttgtagcaataaaccatgggtgatttttttttctttgatccgtgtgtcccctgctgtgcctcttctactacctggcacattgcaggtgctcagtgattttggatttcgcatgagacagcacaagccatttacattgattttccagcatgatgctaagagaatagtagagtgtcagcattagtctgtgacaaaggaacattgttagtgctactttagatgctgtgtttcttccagttgtgctgagtagcagagaacttaattaaatttcatactcgagaagagtaaaggctgagtccttcatctgccacaaatctttacaacccttgctttctagttaaactttccaggattttttttctctgtttttaatatcagctttttggagtgaagtgcttaaataataccaagtaatttattaaaaagagacaatcccaggttcctatttctttggaaatgttttacttattattagctgtctaagtgcattgtagattaaccttttcatgacaaatatttacttccatttgtgttatgtcttcttcctttgtaagaaaatttgaatgagtggttaatctatgtgaaaaatattggagggaagaaaatatatctactgcacaggcccttttaaggtatcattctctaaggagcagcttccatagctttcagctgtaaaaatagggactgccatttctgcaggcagaatggtttggggttatatttcaggaagctgaaactgctgagaccaatacaaagttaattctccgttgcttttttttccttccaggagctagagggattgaccacctgaaacctgacactatctccttcattctcctttctaagcagacagagttacaactacagacatttaatctttgcccttctttcccacctttaggagcggaaaaagaaatttgaaaaggatggtgagaggttttattctttactggatcggcacttacacctgtcttcaaaaaagaaagaatctcagttacaagaggtatgttcacaaagcctgcccctgccttccattgctagctatgccttagaaacagtgtgaattttgtactgcaaggcttttcccataccccgtctcagcagggaacctcatgtgatagtagcacttgtagtcaaaactgtggcctgagactcagaagccctgaatactaagccagctcttccactaactcagggtgtgaccttggataggatacttctttctttgcctcattccattatctgtaagaagaggagtcgagagtccctttcaattgcaagtccaaaatccatgcgaggataaagttaaactagtgttgtatttggtagaaatcaggaacagatcttctacttttttccctgagagattccacaacctttttttttttttttttttttggtgaggggttaggggaatgttctgttttgggactactgcttacctgggacttgcagtgccttcagttcaaataagctaccattcggtgagaccctaccacatgccatgaactgtactggatgcaacatggctacagaaacaatgagacatgattcctgcccttctgcagcttactgttgggctactaaataagaaaacacattactcttatacaaatagattttttttacatactttaatgtgtatatggtgcttttgttgggagtgggaaatgagaatagaagacttatgtttggatgtggggaatttcctttgtggaagaatgttgcccttccaatttgacgtggtcattaaaatataggtaaagtgtttgacaggtgaaaatggataaatggacctttcaaacagagaccaatggcccaaggatggaaggaacataagtagaattctattttaggaatctcaaactggcataggttgtagggtgaattagatcagggagagactagaagcaggataaacagtttaggaaactattgatctaggaaacgatctaggggaaagtgacagagccgtaagagaggcactagggaaggaaaagaaggaataaactgattgagaatttttctaatggaaggaggggtctatatgttcaatgaaagattcagtaataatggagattttaaagattcaagtatgaaaagagatatctgatggaataatatcataggcaggagctgtcatcttgtccatggtcacacagattgtggcagagctggagctcatctcctgataactggtttcatagatatccatcacatcatctgaggtgcttgaaggtaataggtcaagagcctcagtgtggccgagtgcagtggctcatgcctgtaatcccagcattttgggcggccaaggcaggtggatctcttgaggtcaagagtttgcaaccagcctggccaacatggcaaaaccccagctctactaaaaatacaaaattaaccgggcatagtggcacatgtctgtaatctcaattacttaggagactgaggaagaagaatcgcttgaacccgggaggcggaggttgcagtgagctgagatcactccattgcactccagcctgggtgacaagaacgaaactctgtctcaaaaaaaaaaaaaaaagccttagttgtggatggagttagtattgcaaaggagaaggactactttccttccataaactagaattgagtctgggatcttctatcattttccttttgcccacttttgtttttttccttttctatctattctgtgtcgcggtttctatgcagaaaacagtcaacaggcctgagactgctatgcttagaaagacctgtttacaaaattagcccttggaatggcatctgggaacttcactgttaaacagctcccaacattgatttagaagtttcccttaatgggtaagaatggctgactgtgccaagcctggctctgcaaataatgtagcttatgtcgaacacctttttcttctggtactcttgaattttggttgtgctgggcagagtgtgcctgtgtaactagccccgcagtaaaaccctaagctactcattctcttatgagcttccctgactgataacattttctctgtgttgttacaacttgttgaaggaagaattaaatgtgtcttgggtgacaccaccgtgagagatcttttggaagcttgtacctagcttcctctgcattttgccccaggcaccttttctctttgctcagtcggctgtgtacgctttcactgaaataaatcttagctgtgagtactactatgttgagtactttgagtcctgctcaaaaaagatttattaaagaattattaaaattggggtggtcttctggaccctggacacaatccaaactattggagacttttgctaggacaccttctggagtgttctaggtgtttggtgctatatctagatgtccttttattacttattcaataaaaaaatgagcagggcaatcttgagttagtcactttcaaaaaatttagatttcatctttagagaagttttaggtttacagaaaattaaatagtaagtacagagttctcatatgcccttactccctcacacagtttctcatttcctcttttaggatcatcttgcatttgtgtgatacatttgttagaattgaggagccaatgtattaaacattctatgggttttgaaaaacatatgataacatatatccagcattaccatattgtacaggacagtttcgctgccttgaacatccctggactttatccctccctccttctacctctacctctgacaccactgatctttttatggactccatacttttgccttttccaaaatgtcatatagttggtatcatatggtttgtaaccttttttgattggcttcttgtagttagcaagatgcatttaaggtttctccatatcttttcttgacttgataactcacttctttttagggctgaataatatgccattgtctggttgtaccacggttggtttatccatttgcctattgaaggacttcttcgtttcttctgaattttggcagttattaaagctgcgataaaaaattgtgtgcaggcttttagggatatacattttgatgttgtttgagtcaataccaaataatacaactgctatcatatggtaagattttatctagtgtcgtaagaaactgccaaactgtcttccaaattgactgtagcagtttttatttccatgaacaatgaatgatagctccggttgctccacatccttgtcactattctgcgttgtaccattaaaagtaatggcagaaatcacagttccttttgcaccaacctaatatgtacatggaatatctttccatttattttgacctttgatttttttcatcagtgttttgtagttctcctcttaaatatcttgtctttttgtgcctggcttatttgacttaacaaaataactttcagttccatccatgttgttgcaaatgacgggatctcatttttttcattcttttatttctgatgccacttctttgtgtatttactctcttacttatttaatgtggctaaaatattaacaattttattgatttttttcaaagaaccagctttttggttttgttgatttcctgttgttaatttcgttgatatcttcatcttcttttttttattatactttaaattataaggtacatgtgcacaacgtgcaggtttgttacatatgtagacatgtgccatgttggtgtgctgcacccattaactcatcatttacattaggtctatctcctaatgctatcccacccccctccccccaccccacgtcaagctccagtgtgtgatgttccccaccctgtatccaagtattctcattgttcaattcccacctatgagtgaaaacatgtagtatttggttttctgtccttgcgatagtttgctcagaatgatggtttccagcttcatccatgtccctacaaaggacatgaactcatcattttttatagctgcatagtattccatggtgtatgtatgccacattttcttaatccagtctatcattgatggatatttgggttggttccaaatctctgctattgtgaatagtgccacaataagcatatgtgtgcatgtgtctttatagcagcatgatttataatcctttggatatatacccagtaatgggatggctgggtcaaatagtatttctagttctagatccttgaggaatcaccacactgccttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatgaccagtgacgatgagcattttttcctgtgtctgttgactgcataaatgtcttcttttgagaagcatctgttcatattctttgcccactttttgatggggttgtttgattttttcttgtaaatttgtttaagttctttgtagattctggatattcgccctttgtcagatgggtagattgtaaaaattttctctcattctgtaggttgcctgtgcactctgacagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccttcttgaattaatttttgtataaggtgtaaggaagggatccagtttcagctttctacatatggctagccagttttcccagcaccatttattaaaaagggaatcgtttccccattgcttgtttttgtcaggtttctcaaagatcagatggttgtagatgtgtagtattatttctgagggatctattctgttccattggtctatatatctgttttggtaccagtaccatgctgttttggttactgtagccttgtagtatagtttgaaatcaggtagcatgatgcctccagctttgctcttttggcttaggattgtcttggcaatgtgggctcttttttggttccatatgaactttaaagtagttttttccaactctgtgaagaaagtcattggtagcttgatggagatggcattgaatctataaattaccttgagcagtatggccattttcacgatattgattcttcctatccatgtgcatggaatgtacttccatttctttgtgtcctcttttattttgttgagcagtggtttgtagttctccttgaagaggtccttcacatcccttgtaagttggattgctaggtattttcttctctttgaagccattgtgaatgggagttcactcatgatttggctctctgtttgtctgttattggtgtataggaatgcttgtgacttttgcacattgattttgtatcctgagactttgctgaagttgcttatcagtttaaggagatttggggctgagatgatggggttttctaaatattcaatcatgtcatctgcaaacagggacaatttgacttcctcatttcctaattgaataccctttatttctttctcctgcttgattgccctggccagaacttccaacactatgttgaataggagtggtgagagagggcatccctgtcttgtgccagttttcaaagggaatgcttccagtttttgcccattcagtgagatattggctgtgggtttgccataaatagctcttattattttgagatacatcctatcaatacctagtttgtttagagtttttagcatgaatggctgttgaattttgtcataggccttttctgcatctattgagataatcatgtggtttttgtctttggttctgtttatatgctggattacatttattgatttgtgtatgttgaacgagccttgcagcccagggatgaagccaacttgatcgtggtggataagctttttgatgtgctgctggattcagtttgccagtattttattgaggatttttacattgatgttcatcagggatattggtctaaaattctcttttttttttgttgtgtctctgccaggctttggtatcaggatgatgctggcttcataaaatgagttagggaggattccctctttttctatggattggaatagtttcagaaggaatggtaccagctcctccttgtacctctggtagaatttggctgtgaatccatctggtcctggactttttttggttggtaggctattaattattgcctcaatttcagagcctgttattagtctattcagggattcaacttcttcctggtttagtcttgggagggttcatgtgtccaggaatttatcatttcttctagattttctagtttatttgtgtagaggtgtttatggtattctctgatggtagcttatatttctgtgtgaaaggtggtgatatcccctttatcattttttattgcaactatttgattcttctctcttttcttctttattagtcttgctagcagtctatcaattctgctgatcttttcaaaaaaccatctcctggattcattgattttttgaaggtttttttttgtgtctcttatctccttcagttctgctctgatcttagttatttcttcccttctgctagcttttgaatgtgtttgctcttgcttctctagttcttttaattgtgatgttagggtgtcaattttagatctttcctgctttctcttgtgggcatttagtgctataaatttccctctacacactgctctaactgtgtcccagagattctggtatgttttgtcttgttctcgttggtttcaaagaacatctttatttttgccttcatttcgttatatacccagtagtcattcaggagcagattgttcagtttccatgtagttgagcggttttgagtgagtttcttaatcctgagttctagtttgattgcactgtggtctgagagacagtttgttataatttctgttcttttacatgtgctgaggactgctttacttccaactatatggtcaatttttaataagtgcgatgtggtgctgagaacaatgtatattctgttgatttggggtggagagttctgtagatgtctattaggtccgcttggtgcagagctgagttcagttcctggatctccttgttaactttctgtctcgttgatctgtttaatgttgacagtggggtgtcaaagtctcccgttattattttgtgggagtctaggtctctttctcggtctctaaggacttgctttatgaatctgtgtgctcctgtattgggtgcatatatatttaggatagttagctcttcttgttgaattgattcctttaccattatgtaatggccttctttgtctcttttgatctttgttggtttaaaatctgttttatcagagcctaggattgcaacccatgcctttttttgttttccatttgcttggtagatcttcctccatccctttattttgagcctgtgtgtgtctctgcacgtgagatgggtctcctgaatacagcacactgatgggtctcctgaatacagcacaatgatgggacttgactctttatccaactttccagtctgtgtcttttaattggagcatttagcccatttacatttaaggttaatattgttatgtgtgaatttgatcctgtgattatgatgttcgctggttattttgctcgttagttgatgcagtttcttcctagccttgatggtctttacaatttggcatgtctttgcagtggctggtactggttgttcctttccatgtttagtgcttcctttaggagctcttgtaaggcaggactggtagtgacagaatctctcagcatttgcttgtctgtaaagtattttatttcgcctttacttatgaagcttagtttggctagttatgaaattctgggttgaaaattcttttcattaagaaagttgaatattggcccctactctcttctggcttgtagagtttctgccgagaaatcagctgttagtctgatgggcttccctttgtgggtaacctgacctttctctctggctgcccttaacattttttccttcatttcaactttggtgaatctgacaattatgtgtcttggagttgctcttctcaagcagtatctttgtggcattctctgtatttcctgaatgtgaatgttggcctgccttgctagattggggaagttctcctggataatatcctgcagagtgttttccaacttggttccattctcgccgtcactttcaggtacacaaatcaggcgtagatttggtcttttcccatagtcccatatttcttggaggctttgctcgtttctttttattcttttttctctaaacttctcttctcacttcatttcattcatttcatcttccatcactgataccgtttcttccatttgatcgaatcggctactgaagcttgtgcatgtgtcatgtagttctcatgccttggttttcagctgcatcaggtcatttaaggtcttctctatgctgtttattctagttagccattcgtcttatcttttttcaaggtttttagcttctttgcgttgggtttgagcatcctcctttagcttggagaagtttgttattaccgatcatctgaagccttcttctctcaactcatcaaagtcattctccatgcagctttcttccattgctggtgaggagctacgttcctttggaggagaagaggtgctctgatttttagaattttcagcttttctgctctggtttctccccatctttgtggttttatctacctttggtctttgatgatggtgacgcacagatggggttttggtgtggatgtcctttctgtttgttagttttccttctaacagtcaggaccatcagctgcaggtctgttggagtttgctagaggtccactgcagatcctgtttgcctgggtatcaccagcagagtctgcagaacagcaaatattgcagaatggcaaatgttgctgcccgatccgtcctctggaagcttcatctcagaggggcacccagctgtatgagttgtcagttggcccctactgggaggtttctcccagttaggctactcaggggtcagggacccacttaaggaggcagtctgtccgttctcagatctcaaactccgtgctgggagaaccactactctcttgaaagctgtgagacagggacatttaagtctgcagaggtttctgctgccttttgttcagctatgccctgcccccagaggtggagtctacagaggcaggcaggtctccttgagctgtggtgggctccacccaattcgagcttcccagctgctttgtttacctactcaagcctcagtaatggcggacgaccctcccccagcctcgctgctgccttgcagttcgctctcagactgctgtgcttgcagtaagagaggctccgtgagcttgggaccctctgcaccatgcatggtatataatctcctggtgtgccatttgctaagaccgttggaaaagcgcagtattagggtgggagtgtcccgattttccaggtactgtctgtcacagcttcccttggccaggaaagggaattccgcaaccccttgcgcttccagggtgaggcgatgccctgccctgcttcggctgacactctgtgggctgcacccactgtccaacaagccgcagtgagatgaactcagtagctcagttagaaatgcagaaatcacccatcttctgtgtcgctcacactgggagctgtagactggagctgttcctattcagccatcttggaaccttcagtcgatatcttctttaatgtttattttttcttattttctgcttactttggatgtgatttattcttctatttctagtttcctaagaaggaagcttacattattaataagagatctttcttctattctattatatgcatttcattctataaatatttctctaagcactgcttttgttgcccacaaatattaaattgtgttttcatttttatttaattcaaaatgtcttaacatttcttattttattttatttattttttgtagaattgaggtcttaccatgttgcccaggcgagtttcaaactccaggtttcaagtgatcttcccgccttgccctcctaaattgctgagattacaggtgtttgccatgatgcccagccttacttttctttgcgtctttgactcaggtttcatttataaatgtactgtttaatctccaattatttggggcattttcagcttttaaaaattgatttctggtataatttaattgtggtctaattgtatatttcataagatttctattcttttagatttcttcaggtgtattttatgtcccagaatgtggtctatcttggtgatttttctgtgtgactttgagatgaaagtgtattctgctgttgtatcaagtgttacaaagatgtcagttagattcagttgatcaatggtgctgttcaggtcaacaatgtccatacggattttctgctagctggatctgtccattactattagaggagtattgaagtctccaactctaatagtaggtgtgtctctccttgtaattctctcaatttttacctcatgtattttgatgctgtgttgttaggcacattcacattaagaattgttatgtcttcttagagtcttgccatctttattattatattatgatttgatatcataatatttttccttggtagttttctttgttctgaagtatgctttttatgaaattaatatagctactctagcattcttttgattaatgttagcatgatatatctttctttatacctttacttttaatctgtctttgttttctttacattttaattgttatttcaataggtttaggggtataagtgttttttggttacatggatgaattgtatagtggtgaagtctgggcttttagtgtacctgtcacccgaatagtgtacattataccgaacaatgggtaatttttcagccccctctcaccaccctttttctgagtctccaatgtccattataccactctgcatgtctctgcatactcagagcttagctcccactaataaatgggaatgtgaggtatttgatttgagttagttcacttggaataatggcctccagttccagtttctgtaaaagacattattttgttctgtttcatggctgagtagtattccattgtgtgtgagtgtgtgtgtgcacacatatatacctactatattttctttatccactaatcagttgatgggcacttagattgatttcctgtctttgcaattgtgaattgtgtgaagataaacataggagtgcaggtgtcttttctgatgtaatgacttcttttcctttaggtagattctcagtagtgagatcttggatcaaatagtagttctacttttagttatttgagagatctctatactgttttccatagagactgtatgaatttacattcctacccaaagtgaataagcattcccttttaaccacatctgcatcttttgttttttgactttttaataatggcctttctgagtggagtaaggtggtatctcattgtggttttaatttccattttctttttttttctttttatttatttttatttattttttctattatactttaagttttagggtacatgtgcacattgtgcaggttagttacatatgtatacatgtgccatgctggtgcgctgcacccactaactcatcatctagcattaggtatatctgccgatgctatccctcccccctccccccaccccacaacagtccccagagtgtgatactcctcttcctgtgtccatgtgatctcattgttcaattcccacctatgagtgagaatatgaggtgtttgcttttttgttcttgcgatagtttactgagaatgatgatttccaatttcatccatgtccctacaaaggacatgaactcacattttttatggctgcatactattccatagtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcccctccagcacctgttgtttcctgactttttaatgattgccattctaactggtgtgagatggtatctcattgtggttttgatttgcatttctctgatggccagtgatgacgagcattttttcatgtgttttttggctgcataaatgtcttcttttgaggagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgtttgctctgatggtagtttcttttgctgtgcagaagctctttagtttaattagatcccatttgtcaattttgtcttttgttgccattgcttttggtgttttagacatgaagtccttgcccatgcctatgtcctgaatggtaatacctaggttttcttctagggtttttatggttttaggtctaacgtttaagtctttaatccatcttcaattgatttttgtataaggtgtaaggaagggatccagtttcagctttctacatatggctagccagttttcccagcaccatttattaaatagggaatcgttccccatttcttgtttttgtcaggtttgtcaaagatcagatagttgtaggtatgcggcattatttctgagggctctgttctgttccattggtctatctctctgttttggtaccagtaccatgctgttttggttactgtagctttgtagtatagtttgaagtcaggtagcgtgatgcctccagctttgttcttttggcttaggattgacttggcgatgcgggctcttttttggttccatatgaactttaaagtagttttttccaattctgtgaagaaagtcattgggagattgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgaaacagtggggttttctagatatacaatcatgtcgtctgcaaacagggacaatttaacttcctcttttcctaattgaataccctttatttccttctcctgcctaattgccctggccagaacttccaacactatgttgaatagaagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcctctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgccaggctttggtatcagaatgatgctggcctcatgaaatgagttagggaggattccctctttttctattgattggaatagtttcagaaggaatagtaccagttcctccttgtacctctggtagaattcggctgtgaatccatctggtcctggactctttttggttgctaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttacttttctatttcttttaattgtgatgttagggtgacaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttatgtacccagtagtcattcaggagcaagttgttcagtttccatgtagttgagtggttttgagtgagattcgtaatcctgagttctagtttgattgcactgtggtctgagagatagtttgttataatttctgttcttttacatttgctgaggagagctttacttccaactatgtggtcaattttggaataggtgtggtgtggtgctgagaaaaatgtatattctgttgatttggggtggagagttctgtagatgtctattaggtccgcttggtacagagctgagttcaattcctgagtatccttgttgactttctgtctctttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccgttatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatggagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgagaattcttttctttaagaatgttgaatattggcccccactctcttctggcttgtagggtttctgccgaaagatccgctgttagtctgatgggcttccctttgagggtaacccgacctttctctctggttgcccttaacattttttccttcatttcaactttggtgaatctgacaattatgtgtcttggagtcgctcttttcaaggagtatctttgtggcgttctctgtatttcctgaatctgaacgttggcctgccttgctagattggggaatttctcttggataatatcctgcagagtgttttccaacttggttccattctccccatccctttcaggtacaccaatcagacatagatttggtcttttcccatagtcccatatttcttggaggctttgctcatttctttttattcttttttctctaaacttcccttctcacttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcatctgaagccttcttctctcagctcgtcaaagtcattctccatccagctttgttccgttgctggtgaggaactgtgttcctttggaggaggagaggcgctctgctttttagagtttccggtttttctgttctgttttttccccatctttgtggttttatctacttttggtgtttgatgatggtgatgtacagatgggtttttggtgtggatgtcctttctgtttgttagttttccttctaacagagaggaccctcagctgcaggtctgttggagtaccctgccgtgtgaggtgtcagtatgtccctgctggggggtgcctcccagttaggctgcttgggggtcaggggtcagggacccacttgaggaggcagtctgcccgttctcagatctccagctgcatgctgggagaaccactgccctcttcaaagctgtcagacagggacatttaagtctgcagaggttactgctgtctttttgtttgtctgtgccctgcccccagagatgaagcctacagaggcaggcaggcctccttgagctgtggtgggctccacccagttcgagcttcctggctgctttgtttacctatgcaagcctgggcaatggcgggcgcccctcccccagcctcgctgccgccttgcagtttgatctcagactgctgtgctagcaatcagcgagactgcgtgggcgtaggatcctccgagccaggtgcgggatataatctcgtggtgctccgttttttaagcccgtcggaaaagcgcagtattcgggtgggagtgacccgattttccaggtgccatccgtcacccctttctttgactcagaaagggaactcgctgaccccttgcgcttcccaagtgaggcaatgtctcgccctgcttcggctcgcgcacggtgcgcgcacccactgacctccgcccaatgtctggcactccctagtgagatgaacccggtatgtcagatggaaatgcagaagtcacccgtcttctgcgtcgctcacgctgggagctgtagaccggagctgttcctattcggccatcttggctcctccccaatttctattttcttgatgattagtgatgttgagcattttttcatgttattggccatttgtgcatcttcttttgaaaaatgtctgttcatgtcgtttgcccacttttaaatgggatttttttttcttgctgatttgttggagttccttgtagattctggacactagccctttgtcagctgtacagtttgtgaatattttctcccattctgtaagttgcctatttactctgttgattatttatcttgttgtgcagaaagattttagtttaattaagtctcatttatttatttttgtttctgttgcatttgctttaggtgtcttagtaatttttttttattaggccaattcctagaagcatttttctgtgttttagtctagaagttttatggtttcaggtctaacatttttgtgtatcttatttaaaatgatatcttttaggtaacatagttggctcttaatttttgtgcactatgacagtctatcttttaatttttttagatcactgacgtttaaaagggtcatagataatggtgtaatagtatctactatattgtttaccatcttctacttattgtttttgtttttatttttgtctttcagtcttcttttgacttctcttttttaagagaatattttatatgatcttattttctgtcttctcttaccatgtaaattatacttcttctttttcattttttaatggttgccttagagcttgcaatatgcatttgtggttagtttatgtccacttttcaaattccagtaacgtagttatgggttgtacaggatcaacagactatttccaatttctccatttagtcccttataatggtactatcattctttttacttatttgtaagatacaatcaccaaatgtatcattacaattattattatagacaaattcttatctgttaggtccattaagaatttgaaaaataaaatatttaatcttcatttatttcttttctagtgctctttttttctttctttttaggtctatatttccgacatatcatttttcttctactggagatcttttgtcctttcttgcaagacaagtttagtggtgacaaagtgctttaatttttgtttgtttgaggaagtctttattttaccatcacttttgaaggataatttcacagtttacacattgttaagtagttaactttttttctttcaacaccttcaaatattttatagcactcttttctttctgcatggtttcttaagagaagtctgatataactctttatccttgccctgctgtatagtaagttgtttgtttttctctctagcttctttcaagattttctcttgtattttattttctgcagctttgaatatcatatacctacatggggattgtttggtatttatcctgattggtatttattagtatttattatattattgtatttattggtatttatcctgagctttctggatgtgggtttgatacctgtcttttattttggaaaattctcagtcattattgcttgaagtatttcttctgtttctgtctctttttcttctcctattggtactctgaaaatacgtatattaacatcttttgtaattgttcaccagttcctgaatattctactccatgtttgtcattctttttttctctttgcatttcagtttcccacattttttttgacatgtatttaagcttactggttctttcctcactcttgttcaatctactggtgaaccctttaaaagtagtcttcatttctgctacagtgtttttgatttctagtgttttctctgtatactctcttgcagttttcatctgcctgctactattacccatctgttcttaggtgctgtctgttttttatattagagcccttatcatattaattataattattttaaatttagttttatgtttcttttttgtttgtttctgagatggagtctcgctctgtcacccaggctggagtgcagtggcacgatctcggctcactgcagtcttcacctcccaggttcaagtgagcctcgtgcctcagcttctggagtagctgggactacaggagtacagcaccacacttggctagtttttgtatttttagtagagatagggtttctccatgttggccaagctggtcttgaactcctgacctcaggtgatctacccacctcggcctcccaaagtgctgggattacaggtgtgagctaccgcacttggcctacagtcttatatttctacaatgtctgccttacctacatttgattctgatgctccttttttctcttcagactgtgtttattgccttttaatatgccttgtagttcattgttgaaagctagcggtgatgttcagatgaaaggaactgagtgaaacaggtctttaatgtgaggttttgtgttgaactggctaggagctaggctgtgcttagtttgctgtagctgtcattgtctgactctaaaattttctctggcatcattgtttatgtgctcagattttaccatttcttgttaaataagacttgagacttgcagttctttctgttgtaatcccctcagtattggccatagtagcatgcttctgttcttgggctttggcccttgttaatttcttattctctgtattcatgtctctgtagtgtttgagggagcagattttcctctgacttcagttctctgttgaatataataaaatgtgtggattttacacttgttcagcttttttctttttgtcagggtggatgtaatgacttcaagctttttatgtgttggaccagaaactggaatcctgtatcagtcacttttttatctcttggctttaggttctctatttctaaaataaaaggtaacatcactagttggtggctaaatgctcatctagctctagcattctgttcaatccttaagtactgactttcatgaatgaatatcccaatatgtaatgtttgttttccttcttctacaggcagacctacaggtggacaaggagaggcacaattttttcgagtcctctcttgattatgtttatcaaatccaggaagttcaggagtccaagaagttcaatattgtggagcctgtaagttttctctgttgatgaatggtctaaaaatatttatcaaatgcctggtaaatgtacaaactttgatcataaaaacagaatcccaaagaacgtgaaggataatcagtggaaatgtctagaacgtagtctaacttacgtttttcttgttctttagtatactttttttctctctttccccccaacccttttctctctttttctatggctattttctttctctttcctttttttcctttctctttcctccccccttccggaatttctctacaactcttcctgttactttgtttccctcccttccttcttcttgcgctttcagaagcttctgaaagtctttctcatataccagatactatgctagggactcatgtctcttgcagtcagtgacttctcattctactacttttacttctgtcttgtgtagttttttcccatttcacgttttttcattccatttacttcgttttgtgtagatttttccatttccatatatttgtttgagacagggtctcactgtcacccaaactggagtgcagtggtgctatctacaacctctgtctcctgggctcaagtgatcctcccacctcagcctcctgagtaactgggactacaggtgcatgcctccataccgagctaatattttgtatgtttttgtagagataaggtttcaccatgttgcccaggctggtctccaactcccgggcccaagtgatccccctgccttggcttcccaaagtgccaggattacaggcatgagctaccatacccagcccgtgtatttgatttttaatggggttgaaaatttacaccaatatatgttgtgtatcatttatatgtctttttctgcaaccctgtgaaacatttctaattttaaagttggtttagactcctttgatcttttagcattatgacagtcttcattaaagttaggtagaaaatcttgctttattcatttatctatttactttcattcattcaagaaatatttattgagcacctattgtttgtggttgctgaggatatatagaggaaagatgcagttcatttacatactgttcaaatgatgaatgtctttatatgagatctgaacaagctcagggttaataaatttgttaatagttctttttttctgaagctgagtcaagggtaaatgttcaacctgatatgaaaacagtgatgtgtagactggtttgtgtttgactgcgtttagcgctatactgggtaaacaccatggagttttttgttgttgttgtttgtttgtttgttttttgtttttttgagacagtctcactctgtcccaggctagagtgcagtgatgcaatcttggctcactgcaacctccgcctcccgggttcaagccattctcctgcctcagcctcccaagtagctgggattacaggcgtgcgccaccacggccagctaatttttgtatttttagtagagatgggatttcaccatgttggtcaggctggtctcaaactcctgacctcacgatctgcccgcctcggcctcccaaagtgcagggattacaggcataagccaccacacccagccacaccatggagttttttggtgagttcatgtttcttttatttagtttattagaagatgctggtgataaagttatttttacatgttttccctaggtcttggcctttcttcatagtctgttcatttctaacagcctgactgtggagctcacacaggatttcctcccatacaaacaacagctccaactcagtttacagaatgtgagtttgcatgtggatttttctcaccggtctttccattccgattgaatttcagccctagcgaccttgattcttggaattctaggttactgcatcctagccaatttgttagaatatactggtgtggatcacaaatatttagtatatcagactgttcttgctcttccactttcacatctttcctgtttttgaggctgactgctgttcaaacccacccttccacacaccaacaccttcatctatgcaatatttattaagtattgctaatttgctgcatctctctcagatcaggacatagctataggcttatttgagcccaggccttaagctacttccctgctcagtcaaaacactctcactgtagactttattaccacaaacactcattttatcttctctttcttttctcagtacttattagtagagtcacataaattacttttaaaggttttctctaccttctttgtcatgctggttcttacagatgggcatgtaggcatagtgttcccatccttttcacatatattcctttacatgttcctttattcaacccacattaaacaaatgtttatggaaaaaatgaacataagctctgtgccaggcatgtgaaaggcactggacatgccatgaagatgcatgcaagtttttctgtcttgaaggaacatacagtttcttgtaggagacaaataaacagagataaattataatccattatgataagtgctataatagaatcaaggccaaaggtttttaaaaagttcagagcatttggctacctggtagagtcagagaaggcattactgagttggtgactttagaatgggtgttaaattgcatgaaatatatagatgtagttttagatgaaaaatgctggtaagttatagtgaaaataagccccccttggttgtttaggaggattgggatttacagttgttgttattattttttctttctatatactctccttgcagaaaggaactaggggctctcacattctccagaatttcctgatttacaacatcttcctactacaaccaagttaatcccatgaatcttcctctatatattacttgatatgtacaaatgtaacaataagcctttgaatgtgtacatatgggtgacttatttacaggataaacatgagccaactagatgggcagcacagatcacctttctcactaacatcatgtcataattttaagactgggtactaaaaacttatctgtagtgattttcatacccacatttcaacacatgtcttaccattgtgttttagttgtgtagatttaaatagatttattctcatcattaggttttggtatttgtgagtatgaaaacatagctactgttggcccttctcccaagagagcaccctctcgtatattttatgttcttggccagaatttgattcagtatcaactaggctgtaactttgagacacaatttggaagttgctatgagaatgctacctttgggaaccttgtctgccatctcccttgttgtaaagcagggtatcagtcatgttcagaattctaagattgcttatttattagggccttatgtgattcgtattagtaaaaagcctcccagttgttattttatgagtatattgctcgttatatttttgtttcctatgcagtctttaggaccgttagactctataaacttgttttccattcactatgccattcaccatttctttttttgctttgtggttgcacatgctgtaagcagggaaaactttgtactgagtctctgaccaagaaatactttttcatgataatgatgatgataataatgattttcatgatgatgtcttgacagacaagaaatcatttctccagtacccgggaagagatggaagaacttaagaaaaggatgaaagaagctccccagacatgcaaacttccaggacagccaactattgaaggctatctctatacacaagagaaatgtgtgtggggacataggggtatccattgggtttcaataagccaggaactactgccacttgtcggctgtgaattttgggcacccttactgttcatagacccctgatagctaaaattcccttggaacgcaggcagggaatactgaaaacaaaaaaaaaaaaaggagaaactgagaggaagttaaagatttgtcttacaaaggctgtgtagtgataagacctaaggttttctctgagattcaaaatgggtattatttgttctttaatccttctgattattcttttggaaaaaagggaagtagaggaaaggaagtagaaaaataatatttcttatacttattatgtaccagacatggtgctaagttcatttaaaacactgcctcatttaatctttgcaaccaatttatacccatacacataaggccactaaggctcagagacgtcaccatttgaaagtcacccaactaacaagtgtcaggactaaaattaaattcaggtctatgaaatgccaaagcccatgatcctactatagtaccctatgtcttcgtctgcattagggtcatatgtttgctcttttcttttctttttttaagacaggatcttgctctgttgtccaggttggagtgcaatggcaccatcatagctcactacagcctcatactcctgggctcaagcagccctcctacctcagcctcctgagtggctgcacctaaaggcacctaccactacacttggctaagttttgaattttttgtagagacaaggtctcactatgttgctcaggctcatggatgctcttatagcacttagtgaacatcatgattccagtgggaaagacagtatctgtttttcattggtgactaagtaaagtgggttaacttgtttagtcactgaatgttgcagagcattcaatctttcctaattcctcagtaacattatgcacacctgtatgtgtgatttgattttatttgccctttgaactatgacccaatactccccaaacctgttattcagtttttgcccagagttattatatctggggaataaacagaggacacacacccagaggctgccagtagcaaaaatcactgtaattcaaaaagcatgacactacggtagtgaaattatcacacttttctttgcatagagcagtttacttgtgatgattttcaaagatgtgttctcccacttgtcaggttcatctcttcaactgtgtgtcgcacaatttctcgatctcagtgctgttgacatttcaggctggataatttttagttctgggaagtggtcctgtgtattatagtatatttagaagcatccctggcctcctcactttgtgctcatagtaatctccaggtgtgacaacctaaaatgtctctaatgtattgccacatgtcccctgggaggccaaattacccctagttgagaaccactgctgtatgctgtgtgatccttctgtgcttcagtattctgatttgtcatatgggcataacattgctactcagttgaatgtatgcttaatgagcactgtttctgccagatactgtgcaatgcattggggacacccttgaaaaactgaatcaaccatgatttctttcaccaagaagtgtaaagtgatgggagagatagacaagtatatcaataattataatgaaatgtggtgataactgtatttggggcatatatctaaaggcttcacaaagaaagtgatatttgaactagaacttgaatgatgagtgggagtttgataggtaaagaaaaggaggaatggccgggcacagtggctcatgcctgtaatcccagcactttgggaggctgagacggcagatcactggaggtcaggagtttgagaccagcctggccaacatggtgaaaccccgtctctactaaaaatacaaaaattagctggatgtggtgatgcttgcctgtaatcctagctacttgggaggctgaggcaggggaatgacttgaacctgggaggtggagattttactcagccgagatggtgccattacactccagcctgggtgacagagtgagactctgtctcaaaaatgaataaaagaaagaaagaaagaatgaaagaaagaaaagaaaagaaagaaaggaaagaaaaaggaaagaaagaaaggaaagaaaggaaagaaagaaagagagagaaagaaagaaggaaaaggaggaagggaattccaggtatataccactgcatgagtaaaggcagggttgtggatagacatagttgatttgtagggcccttgtttgccaagaatagtcctgctttacccctgttgtcctgatgtaattattaataatactgcctcattcagtcttaaataagtcttggatttggactagaaattatatggctacctctttatgtgggaactaaaagtaattcattgagacaggaacatagaggtgaggtgccaaaagaaaaagctagaaaggtaagttttgatcatgttatcaagggcattgtaggcaggctaaggagtgtggagatagtgggaaagccgtggatggtttttaatgaggggaatgataaaaatagagatatattttaaaaataatctaggaaaagagtggagaatgaattggagtggagtgatcagagatggggacaatagggaaatcagagaaggccaatgaaataattaattggtgagatagtaaatttttgttttttaaaaatatgtttcataaaatataaatacaaaataagacactgggcccagcgctgtggctcatgcctgtaatcccagcactttgggaggctgaggcatgcagatcacgaggtcaggagatcaagaccatcctggctaacatggtgaaaccccatctctactaaaaaaaatacaaaaagttagccgggcgtggtggtgggtgcctgtagtcccagctacttgggaggctgaggcaggagaatggtgtgaactggggaggtggagcttgcagtgagctgagattgcgccactgcactccagcctgggtgacagaacgagactctgtcaaaaaaaaaaaaaaaattaaaacaaaaacaacactgatagggttcttaactaattcggtgttaaaaaggaatggagaggaggagacagttaaaagagagatgtgtagagtcatgtacaggttagaaggggcataacccaatgaccaatgacatggaacagttatagagacagcaaagtaaatgacaatagtctccagcttctgggatatatggtgatacaatttatagggaacatggcagggagagtaggttttgagcaagccagaagcagctgtgggaagcagttggtgaaggttagaatctccctgtgtgcagtaggtaggtggctatggaaggagggcggtcagggcaagggcagggctggatctgaagtttgactctgaagagcaatgtgtaaatagcttccatcttagggttgacttcctatacagctaaaatagttattctgtctgctcacttttacttgtccttgtaggggctttaggaatatcctgggtgaaatactattgccagtatgagaaagagaccaaaacactgaccatgacgcctatggagcagaagccaggtgctaagcaggtcagttcttgtttgcaccatatttttggaaatggatctatgactgtttctcagaaaagaatatatgttgacctagtatcaaatcatcaagttcatcactgttacgtgaggccatgactttatatgtacaccttggcctaagtttgagtcagatagcactgagttgagtgaaaaatttctctgttgattagagcaagccttttgaaagtgccggtagtctttcaaaccagttatttttacaagtgccagtcacattgtacagtcaactatgtaaaaatatggatgaattacttttaagaatgctctactcttggattctttaaaatagcaagttttaaaaatatgaattgaattccaaaattccttttttacaggagtgtgtttatggcccacagttggaataaccgatactcacattctatgtactactcaaatatctttaagcagttaatctctctttttctgccctccaaaccttctcttcacatcactgaaacactgacacagactaaactttaaccaccacttgaaacaaaactacgtttacattaaccttgagaaagacaccctgaatcctttatacgaaaacaacaacaacaacacaacagcacaacaacacaacaacacactcacacacactcacacacacagatacacacatgggggttccttaagataaaagctgatctttagacagattgtttatattctaaaagtagttcaatgtgcctctttcccctttaactggctctcagacagggtcttagtgcatgatttttaagcatttgcactctttacaaattgtttgttggaagtgcttcaagggttatttgttagcactgaaagtagtacatgaagacccaatttaggtagggaggaatttggagaaaaattgggacagtttctctcccttgctgatccttttcatggaagatctctcttgtgtggcttgctcatgttgaattagagaggatggaaatgtgctttcaggctactgaaatttttttggagtgagagtggtcttttaaccacaagatttagctccctgctttaatgtgctttggtgatgggatggacttgtaaaagatgttgtatcaaacagagtttctggaatcctcggctatgctttattattattgttattattattattattatttgcgatggagcttcactcttgtcgcccaggctggagtgcaatggcacaatctcggctcacagcaacctccacctcccgggttcaagcgattctcctgcctcagcctcttgagcagctggtattacaggtgtgcaccaccacacccagctaatttttgtatttttagtagagatggagtttcaccatgttggctaggctgatctcgaattcccgacctcaggtgatcctcccgccttggcctcccaaattgctgggattacacgtgtgagccacggtgccagttactgtgcttttatcatgggccagttactcattcaaaaccctcctcagtttccagtccgccagttgccaaagcacctttcagtgtggttccaataaattcatcctgtgttttagcactgatttgttccaagtcagtcagaacttagctgattaatctgactaggaagtgcttataagcaacactggcctgcagtctctttcttttatttttctacacacattacttttcaaataccggagaggaaagctccttttgtaggcagtaatttcatttaggcactttctctgaggctgctcagaggtgcttattgcaaactccaagacagagtcagcagataccactttcatatcctcctgacagatgccagcaagccctccttttagtttttctttccctcttctcttttcattgagtagctgcttgcaaaactgcaatggtggtggcctgagcatttttgatgtggtattccttatggaatggaaagaagaacttagttactcacaaggcagagggaggtggtgggggttacttggatttccccaaattggagttggaagtgatttcttcctgtcagttctctgtttcacttcttaatactagtttgtattttacaattataaattttacaaataaatgataccataataataagaacactacaaaagccactatttcttgaatacctgctgtgtgccggacactgagctagacccttctgtcatattcatgctcctcatttaccctcctagcagctatgtgaagtcagtgcccccaatttgtgtaggaagtgagaccaagttgaagatgcaggaattggccatctttctgactatggcacttactatagcgttggtcccactactttagcctgtcagctctcatctgtgttttcatggtcaattttctgatcatcttctcaaatgataatttattagatcttcatcccttccctgttaggaatttgtggtcagaagaaggagtactgcattctgaatcttcagacctgtgtttaaattttagctctgtgatctggtagcttttgaccttgagtaaattgcctaatgttactcagtcttagtttcctcatcagaaaagtggtaaggatgataaagtagttcataaacattcattgagcactaagtatttgcaagatactggaggtataaagatgaataaaacactgttcatgtctttgaagacttcctagtcaagtggtgaaattaaacataaaaacaggacattttaatattacgtgcaaagcacatagtgggcaatgtgttggtttgaagaaggatttttgaggaagtggaagctgaactgcagtttgtagaataagtaagagtttagtcaggcaaagcagatagacaaggtcattttgggtggagcgattaatataggcaaagtcatgcaatcatgaaatagcatgatatgtatgtgaaataagagtacttttgcattgtaggggcattaaacaggtgagcagtcactggagatgagattggaatggtgggcagggcctaggtccctgagctgcaatgtcattgaagctgaggacattgagaatttaaagagatagagtgagtctgtgactttgctcataactctcattttgaaagactaatgtgtgacatcccacatttaggggtaggaaggcatactgaaggattaatttagagttgagttgttacagtgcaggagcaaggaaagattggcctgcaagtggctgagtatgctgatgagcaagaagtattgggtaatgagccacgtgggccagtttgtatgtcatagtatctaggcacctgggcagtgttacctaacttgagataccacagtgggttttgttattcccatttaatagattgtgaagttaagacttagagatggaatatgatttatttatttatttatttttgagacagaatctcactttgtcacccaggctggagtgcagtggcacgatcttggcgcactgcagcctctgcctcccggtttcaagcgattctcctgcctcagcctcccaagtagctgggattacaggcgcccaccactgtgcctaatttttgtatttttagtagagacggggttttgccatgttgaccaggctggtctccaactcctgacctcaggtgatccacctgccttggcctcccaaagtgctgggattacaggcatgacctgctgtgttttggccagggtcacatagctggtaaatggcataactgagacaagaccctaggtcttaaactttctagtgtgttgctatttccactataccaatttggatgactttgggtatgctgctttacttctttaagtgtcacttctctataatggttgttaacaataaaagtggcttaaaaatacctagcataggctggacacagtggctcacgcctgtaatcccagcactttgggaggctgaggtgggtgggtcacgaggtcaggagttcgagaccaccctgaccaacatggtgaaatcccgtctctactaaaaatacaaaaattagccgggcatggtgcgcacctgtaatcccagctactcaggaggctgaggcaggagaatcgcttgaacccgggaggcggaggttgcagtgagctgatatcgcactactgtattctagtctgagtgacagagcaagactacgtctcaaaaaaaaaaaaatgtagcgtaatatatggcacatagtaagtgataaatgttacttctctttcctgtatcacatggtctctgttgagataagagagggaatctgaacaaggtgagactagaattttagtctgtggacacagtgggttttaattcccttaattacctacaggactaaagtgggccacactgtccttgctgcacatatgaaatatcaaatgctaccatgactaatacacacatttgctatttcctctacttttgcgctacctttggagcgattacatttgtgatttctgtcatcctaaagagtgtagagttgggagacagaaatgtttttctccctccttcatctgccactttaatggaagcttctttgctcagctaccctctgactttctaagggaggttttagacagccacttaccccgtcacaatttccctccccagaggcctcatgaaaattttattctgtacacttaatgccattcagtcagcccatttctcctacactccccttacatgatatgtattgagcttcctattaagtcttccgtcttgggaaagagtgctggatgactctgaacaatttctcctggtctcagccattgattcttggagcggggagaaaccatctgccatcttgctgcaaatactgtttgaagggacaagattctcagtgagtctacacattgctcctgctgccttgaccagacgccttccaagtgacactgaagacactgtaggaagcagaaacagcttctgtgtctttttttaaaaattgcctgttaattcttgtttcatatcaggggcccttggacttaacactgaagtactgtgtgagaaggaagacggagtctatcgacaagaggttctgttttgacatagaaactaatgaaaggtaagctgtgccgctgtgaattggcaatgtccccacgtgccagatgcttagcctgggtaggtcttttattttcctccgtcatcccacgttgatgacaatgagtaagtctattcaggactttgttgtgagtctattcaagccagctcttctggctgcccttcccagggatccctgctagacctggcccagtgctgcttttctctgtgcaagcttctatcagctttgcctcacttgctctgggaagaaaaagtctctcctgggatttaatttgctatcagatgtgcaaaaggtcaacatttggtgatcttgcaagaaggaaaggataacaaagctcattctttgttaaatctcctaatatcacataaaagaacaaatgaattggcacacatttttgagggagggaagatggggtggagggtcgtggtgttattagaaagtcatttccccccatttggtgcaaaaatgatgcagaccttccctactttacagatactcaatgaactggaaatagtgtgattatcacctttcagatcttacagctaaggcttgcacattttggacttcgttgtgtttgtttctccccagtgccctctttttttacttgaacctgagcagttttatcagaggagaattttaaccattaaaatttcaaatgaatgcatttggcattattgtggagaaagacatgctttatagttgggtggttgtaccaaaataaacagaataaatctgtttctagattttatctcaaccttttatttctagatgttagatacttagtaatagaatagaattttgcaaaatgatcagattgctagaaaggaacttgaagggtgaattacaatatcatgtgaacaaaactagcagtgactgggatcataacaatcagactaaatgatgagggcatttttaaaaaaattggggaataaaggacttagcttgtttccttatttcaaaattgagagattattatttgaccctcacaatttcgatttgtgaatttatatcatttctttgttaaaaatggatgatcccaattgaggtggctctgaaagtacgtattgttgccagtaaccatgagactgtcactcattttcctgatagcctcagttccagtaggaaggggaaaattattgttggctgtggcttcccttttttgcaaataatatccccaactcaagcagttgcaaacagtttgtccccgtggttaggggctaggatgaatttatgtttcttgtacctggtgctatgcatggctcatgataagtactaaatttgatgtttatttttaagtgtttttttcttatcctagaatgctgaagaattttcgacactagaacccagggattaaagttttgatgcatctacacttttagttatcatatactgtgcactttacaaaacattccctcatttaatctacaccccccccattttaccagtgaggaaactgagacccacatatatttaactgacttgcccaactaaagtcacataggaaatggtgaggctgagctcaaaccctggtctgtaggtctccaaagcccatgctggtttctttttgtttgttttgagatggtgtctctctctcttgcccaggctggagtgcagtgttgcacaacctctacctcctgggctcaaacgagtctcctgcctcagcctcctgagtagctgggactacaggcgtgtgccaccatgtccagctaatttttgtatttttaatagaaatggggtttcaccatgttggccaggcttgacttgaactcctggcctcaagacatccacctgcctcggcctcccagagtgctgggattataggcgtgagccactatgcctggctccatgctgtttttaattttttatattgtctattataagcagaagaaacaagctgcaaagtagagcgttaaatataataatgaacaggtgctgaggcccctctctgcatgtggagtcttttgagtgacatgacatctgcttttctggctagtcagtctgatataaggaacagagtcaggcttcctagcaggcatcaggcagctgtactcacattccctggagcacagagcaaagggctcttggagccactttttctatgtcaggaagagaggataagattttttatttttttaacttttaattttttagagagagggtcttactctgttgcccaggttggtttgcagtggcacaggttcaagtgatcctcttgcgtgagcctcctgagtagctgggactgacaggtgtgcaccaccatatctggctaattttttattttttatagctatgggaccttgctatgttgcccaggctggtcttcaactcctggcttgcagtgattctcctgtgccagcctcccaaagtgctcatattacaggtgtgagtcactgcacctggttctaaatttaggctcttagcagtatttaaaatgacaggctcatagcaaggcagagcttgaaatgttttaataacagcaacaacaataattgtaataataataaaaacaattgctaacatttgccaagtacctcctttgtgacaggcactgttatcagccatttaagcgtataatttcctttagtcgtcaccacagtcacatgagggaggtgatgttatttgaattttggtttgtgaatctgtatcatttttgtgttaacaatggatgaccccattcaagatggctgtggaagtatatattgttgccagtaaccacaagactgtcattaagaggtgctttaatgaagtaagagaaggtaggacaggaaccccatgattccagcaggtagaacaggattcctgtgatatcagtaatggaaaggacctcccagctcctgtgttccagaaccctttcagataaagaaactgaggtctagaaaggcctagttacttatccagggtggctgaactctcttggcattgcttttatcattctatgactctaggagaggtctcatcttatcacagaatttgtggaaggaacaatgttttcctaatggctcagcaagccaggagaatgcaaggagactttataccttgcataaagtatggttaatctcaaaattccagatgagtcacaaagatctaaaaagaccataaagagcataacagcttgggatatctctgggtagttagtagtgtcttagtccatttgtgatgttatgacaaaatacctgagactcagtaatgtataaacaacagaaattcatttgtcacatttctagaagctggaagtccaagcagtttcagtgtctggtgagggcctggtctctgtttccaagatggcatcttgttgcagtgccctccagagagcaccaacaccgtgtcctcatatgtcagaagagatggaagggaatgaacctactctttcaagtttttgtaaaagggccctaatcccattcatgaggttctacccttatgactaactcacctcctaaaggtcccatttcttaatatcatcacattggtagttaactttcaacctatgaattttggggaatattcagaccacagcaggtagcctgcaaataaatagaataaaacagggttcgaagccgtgtgccaggcagaagaggccttatattgtagtaatgaagaatatggctgctggaccagactttctggatttaattcctgtctctagtagttccctgctatatgaccttggataattactctgtgcctcagtttccccttctgtgaaatagagatgattactgtaactgccttattatatatattaactgagttaatatacatagtttacttggaacaaaatttgtcacctagtaagcattcagtaaatattagttgtttttattagtcataaaattgcttattagccaaaacgcctcctccctgtgtcttagccagtactcatgttgttgaatttattgcaactcaaaatgtttcttggacatcgcaggtgctggaagaagcaaagccattttactgagagataatgtgcctctgatgttcatgctcattcctagagctcagacaaagtggctggcttccaacagagtaaggcagtgagagcctttgtttggttcaagcacaatggggccaatttaagtgtgcattatggaggcgtcttgacagttaccttcctatttcttgcaggatctgggcacaaggccaccaagataccacccccgcctccatggttcccaaagttactgttctgtaaattgcctattgttttcttgagtaaaagagattttgaaaaattagtattctgtaagcctatgcttgttcagtgtgacaaactccagggcagagagggaccctagatcacaagactccattctctcagttgaattttctgctttatacttaccatttttttccccctcaggccaggaaccatcactctgcaggccctttcagaagctaacagaaggctatggatggaagccatggatgggaaagaacctgtaagttacctgacactggggaaacctccccagcatatgccagtgtatgagtgccctctagtggtatcagtgggtctcagacaattaaatggtaatggattgtttagtctcagttttagagctgtaaggaattgtttccacatctcttagcaggtaaggcaactggagttccagaaaggttgagggacttttctgagaccaccctcagagaagacaccaaaaccgggcttagaatgcagatctctcagctccctgctctagtgttagactatgtagctatgcccatgagcttttcttcagaaagaatgaagccatttttcaggttataaaatcaatatgtgttaattaattaatatgtgttaatatgaaaaataattgccatagttataaataagcacttattaaacatttattcagaatgatttttctgcctcacccttataccaccaactcagcttattctctttgagggtacagctggtagcggagatggcattgccatcctgtatcacaagatgtaccgttccatttagaacacggttatgcaggaggacaagcaatcccttgaaagggttactgattatcatcaagcgaccaatagaaacagttggaaataattgaaaaacattctggtttcttagtggcatattaaataatatcagcttcctggtgttggaattccaaaagcttggatataggtactagttctgccattaaatggctatgtgactctgggcaaatcatttcacctctctgagattcagttttcttctcctcagtaaaagggctttaataatttctttctacctatctcacagggttgcttagaaaaaacagatggaagtcatcttgtaaaccacaatgtgctagccgatctgaatgatgggatacaaaactcctaagatccagcagtgttcagatacagtcttatttctttgctgtattcaagtgaaaaactggctaggagggaaaatgcattctaggtttttctttctatgtgtcctcagtatcctggagaatttagaggggtaactagatcccagattgcacttatagtaaactggaaggtagcaggagagacttggtattctgaagactgccatccagaaaatattccagcactgtcttccttctgtcaccttccagaaacctgctgctgaactctttcatgcttgtgacatttctgtaggcagatgctgggaagctcagcaaggcatttatctttcaattccctctcccaagtttgctctccctttaggttttcaagaatcaaaggatgcagatggctttctgtggagaatgatgtgagcacatgggcccactgaatgtggatccataccaacttgatcatggcagatttttccacaaatcccttgtttagaaaagtagcagaaaaggctggctggcacaaaaatatctcccactgaaatatctgtgggcatacacacatatgcagaacttattttaaggagaggctgttcaaacagactcttaacagatggcatatagagggctcatttcctgcaacctcacattactaatgttgttgctcctttactaaacactccagttcactagtcttacaaatctcatccatgcctttgcctaaactgtcaaagaagatcagggcttgaaggaatgtctactccaaccctgatcactttactgatataaattttgagatctggagaatggaaagggcatgcccaaaatttcctaagaggtagaggtagagccaggactagacttcaagagtcaacagtcttctttctggtctctcacatagctatcacagcacatactccaagacaacacagacaaatcttggtgtattcatggatctctttcagatggacatttgcctttccacagagaagtattcatcaaccagtctttgagggtgggagattggtgttaggaacatttaaattttataatgcccattagacaggtacatagccatgaggaaaacactttcctggtctcttgctttatcataaaaatgccccaggtgttacataagtaaatatctaagatggattagctaaaactgtagctatggtgaactgtgtgaaattcagtgtaattttcagggattgttcaagtattttctttctttctttcttccttccttccttccttccttccttccttccttccttccttccttccttccttccttccttccttcctttctttctctctctctctttctttctttcttttttttttgacagagtctcgctctgttgcccaggttggagtgcagtggtgtgatctcagctcactgcagcctccacctcctgggttcaagagattctcctgactcaacctcccaaacagctgggattacaggtgcacgccaccatgcctggctaatttttggatttttgtagagatggggtttcatgatgtttgccaggctggtcttaaactcctgacctcaagtgatctgcctgccttggcctcccaaattgctgggattacaggcatgagccaccacgcctggcctgttcaagtattttctagcaatcttggcaaagcaattatgtttagcccacttggctatctttttaacatcctggagtttctaatcatttttaatgcctatctggggaaagatatttaatattatgttctctgttttcctatattgattgacaatagccatggatctttctgtttatcttcttttgtagatctaccacagccctataacaaaacagcaagaaagtgagtcacttaagtttttggtctactagcattataaactgccagctgtccgattcatagtaaataccatcattaatgatgtgtactactaacgcaagtctgaatatggatgcctttgtgtgaaataaaattcagccatatattttttaaatgtgtctggtaattgaactaaggtagacacttggtgttagcttacatcgtgggtagagaaacatatccttcctgttctggaagcatgatagaaattgtatttttaggctaacatttcacatatgactttgctcatgctgaaagcagacaattcaaagggctaaatataagtattttgtgttataagagttaaaatgttaaacctcccctgaaaaaatgactctttccatttaagggtgactagaaatgagcaactaaaaacccttagctctctcaatgcagtccctttgcatggtcattaaatgtttaataggtgacacctgttgcagcaggatctaactcttttcctttgcttgaaacagtggagctaaatgaagtgggcttcaagtttgtcaggaagtgcatcaatattattgagaccaaaggtaagatctgaaccatagtcttggcattgtctgaatctcgtcactctgattttatcctgggcaatttctctgaagtagcgttttaggaatgaagactgtttataaagcttgtgtagtagatgcaagctagaaaatttcagaaaattctaaactagtggtatgcaagcatatttggataatttggattcctgcttttaaagagcttataagtttataaagtattctcaaacagtacctggcactccttaagcagtgtcatgatggttctatcctaaatgatcaagagttcaatttctgccacagtacatactggtatgaaaattgatggggcagagccaaactcagggagatgtggaatcagcattcttcctggttgccgatactccctggtttccttctgaggatatttagactgtgggcaagtgtggtatgtgaatcaagtctctttgttctttgaaatgtttttttagtctttcttggtgcaggaaatggccttttgtttcacagctgccttactccagccctctcgtgatttatatcactgcttagaagcaacttgagggttgatccttcctcctttttcaattgaatgaacttctttctaagatggcagcaccattctcagctttctgctgccgcccaaactaagcatatgcttctatttactatagagtttgttttcttctcttcagattaatgagggtttggtacactccaaatgaaaggatggataatttggagagatgctgtaggactattcccctgttacagggaaggctggagaacttggagtatgtagtgtgaccccttcctatctgaattgactctagtgtaccaaggggagatgacaactctagctatacaagtgaaattaacctgattttttcctccactagggatcaagacagaagggttgtaccgcactgtgggcagcaatattcaggttcagaagctgctgaatgccttttttggtaacaattttactttgataattcttattgggagtactttatgtgttacaaagaaatgtgactggaagagaaaggagacactgctaaaatgtggtagaatagttgaaaaaagtattttctaaagtaaaacatacacatacttgcccaccctgggcagagtcaatcgtaccttgaaaatggctgttatctctccttcctcgtatcccattcactccagaaaccctcagcaatacaacttctttccctacatctcaactggaactgtgtggccaggcttagtcggtatcttcttaccaaatccagtgaatacttttgagtttgtgtcttacttgatctccttgttgaccactttctcttttttgaaactttctccttacatgacttcgtgacttccataacacatcagcactcttctgattcttctcacatctttttttttttttttttgagacagggtctagctctgtcgcctaggctggagtgcagtggcatgatcatggctcactgcatcctcaacctgagcctcctgggtagctgggactataggcgtgtgccactacaccaggctgatttttaatttttttgtagtgatggggtctcactatattgcctaggctggtcttgaacttctggccttcaatcatcctcttgcctttgcctcccaaagtgctgggattacaggcatgagccacaatgcctgacctcttctaacatcttataggattccttttcaataacttgctgaacctttatctttctgttttttacaccttgactgtgtgtttcctacagttctatctttgttcttggtttacttctttttttttaatatgtttttctattgattgatttttttttattctggttatggctcacatttttgtttcttaaaaaacatttcttgtaatctttattggttgctggatgttgtgacttactgaatgtcttgattttgttgatttcttttaaagaggactgaattttgttttgtgggcagttatttgtggatcaatttgatttatttgagtcttctttttaagctttgttgggccagatataaagtatccacccccaggtaaggttgttgagctctttttccacatagctcactcttctctggtactgtgccttgctagttatagctgcttcaaccttcctaaactttgatccttatctcttcagctgagcaagacttccatgctcagcttgagttcccactccatctgctgcaatctaaaaagtgcttttaagaagcaagctgtggagaaggtagcagttatcttgtttgtatccctcttctcagagtcatagtcctgttttgtctgttgctcaataactacatgcaggagtttcctatatactgtccagttttctagttgttacagcaggaaggcaagtctgataccagttagtccaccatggctggcagtggtattctctctttatgctttttactagcacctctatgctgacaactcacaaaatctctgttccagacatcatctgatgagttctaaatgcaaatattcacttgcccactgcacttgtgcttctcagtcatattaaggtcatggcacatatcagaatgatcatctttatatagcatgctcgggtaaatggacatcactgaggcaagaagccctaaaggctgagggagtcaatattggagtctctgcacaagctctctttacatagatggttcacaggtatctacctgcatttctctccctgcaaacctacccttcttcctttcgtgggtggcagtgaagcatcttgtaagctgagttttcacagtgtcagagaacaaattgagtgtggaaaactgcagtttggataaaatacatattttttggtccttactgtgatgcatagctaatctctcacaagcctgcaggtctgacaaccaaccctactcacatttgaggatgttacagcactcagtcatagcaggtgtggtttttgaattccagattacatcattagtacctcatcatctgttttcattaatcaccttacattcttgacttttaaaaatttggattgcttattcctggtcaatttgcaacccatctcattagctaaggacactttttcatatgtaaatcagctgacatcgtggtccagcatattgaatctctgaaaaattattgaactcagatatttattcagataactattgaactattgaaaattctgtttccagtatcactcttatatctgttgtataataagctaaaaaatgccatgccaggcatcccactgattctcttatgggctttaataggactgaagtggctccttcaaatcacacacggcagtagaatttgattcaagtattaaggaaagtggtagagttggtgtatttcatttattcaaaaccatcctccaaatattaactctcataggaatatctaaaatatagaccaggaagttctagatataaatattgatagatgcaatataaaactgttaacttccttatttgtatatgaaagtggcaaccccgatccctgccccaaatgtatgaaactccagatgtggtgatgatcctcattcatttattcattgagcaaatatttgtgtgcctacccgggcatcaatcattgtgtttagggcagtggattgaaaagtgaacatattccctgtgttttccacctttgtggggcttacattctactgggaaactgtctctcagttacctttcaatgtctagttatgtggggagaccttccttctaagtttatttcatgtgatgtcctctggcgtgtctcactgggatcctcaaagctgtcttgcttcttttcaccctttcctgatctagtctcataccactaggggcttgttgccttggctgcatgtggacccatcatgatttatcctggagggtgaacatccattgccttttggttacgtaacatctctccctctttttttttttcttatgtctcatgctctgtgctagtcaaaaggatacttcttgttatttttttttacctaaacaaccctcagacttctttccctatgacatctcctataacttgtaactgtaggctttcttctatcgtttactaaagccttttcttcttcccctagacaaaagtttgtctttttgggaaataaaatatatcacagagtataaagtcaaaggcaatacattcataatcaatagttattttcaatcacgctgttggttggttggtcacattccttgcctacaccagatttttgtatgatgctttatgttaataggttttatgtgaggattagaatcttcactggtgctggatccattgtaagccaccttggcacagagaagccaatctgattatctcagggacaacttggaacctcgtgtaagagttctgtttcagaaggggaacatcacacactggggcctgttgtggggttgggggaggtgggagggatagcattaggagatatacctaatgtaaatgatgagttaatgggtgcagcacaccaagatggcacatgtatacatatgtaacaaacctgcacgttgtgcacatgtaccctagaacttaaagtataaaaaaaaaattaaaaaaaagtttaaatcataaaaaaagagttctgtttctctttcctttatcaagctataactatcttattaatgaaaatgccccccattgtcattatagtcttaataatcatgttgtgctccagagactcttaagtatttcacaatggagcagatgggtgagatggggcatggacagcaatgagactggttgtatcagcaggggctcttgatagagttgagcctggttggcagccataaacaggaaagtgttgttctcacaatccccttaccatgccagaggcctatggatctaaacagaagaggacctgctgtaacgagtgaagtaacaagtcacttgtaagatgttatttatgttattttcatttcctgtttagatatttaaatttcttatttcatcattatggcattagaataagatacgtggacttctcagaaactaagtggaatacctaatatatatagacagataatagagtaggaatatgcatacagtcatttttccattttcataattaatgtgaattattcagcatctggagacttaactttagcattaaattcacatatattcggacaaatagataataaatacattaatcagaaatactttcaagttatgtgacctctttgtttgaatgagaaattcagagtcccctagcaaataaaacaaaaatataccacactccacttcaggagttgcagaacttgaactctatatgttaatctttaaagcaactgtatatgttaaccgtttttctgatactgtcgtatgatgtgatctttagctttccatacatatcaagatactttattcataaagccagatccttgtatatgtgtgtatatgtatacatgtatgtcataaatagattttatataggttcattaatcattactatacttactactttaaatacattgattattctcaaatcatgcttgctttgaaatagtaccactagagtttgaagtaatttatcaatggatatttactgttaccctttccaaattatttcctatttgcatttgactatgaaactgagttcaaaaacttttagaaataaagtttgtgatatgaatatttgttccttttctattattttctcaatatgtgaataattgatagcaaattcatctttagttctcacctgacataatgccatttcctagcattcttgtaagtatgtaaacagtaggataggaatttttctcttaaaggtattttaacttagcaaaaataatttcagttgttgacatatgaatctagcaatgctgttatcccacctgcttcctgctgcagggtttctgacttggggagagtctttcagctatgtcaccatgaatgaagatccaggggattgtttgtattagtttcctagtgctgctgtagtaaattatcacaaatttaatggcttaaaacaatacatatttggctgggcacggtggctcacacctgtaatccccgcactttgggaggccaaggcgggcggatcacgaggtcaggagatcgagaccatcctggctaacatggtgaaaccccatctctactaaaaatacaaaaaattagccgggtgtggtggcgggcacctgtagtcccagctaatcgggaggctgaggcaggagaatggcgtgaacctgggaggcagagcttgcagtgagctgagatggcaccactgcactccagcctgggcgacagagcaagactccacctcaaacaagcaaacaaacaaacaaacaaacaaaaaaccaatacgaatttatcctcttatagttctggaggtcagtagcctaaaatcattcttctggagctaaaatcaaggtgtcagcaaggctactttttttttttttttggagaagacagtctgttcccttaccttttcagcttctagaactttccttgtctcatggtccactttaacaacaccaggcagagtccctctcatgctgccatcactctggttctttctcttctgccttcctcttctgctttaaaggacccttgtgattacattcattccacccagatcatcagaataatcttcctatctcaaggtcatctgattagtgaccttaaacctatctgtaaccttaattctcctttggcatgtgacttaacatattcccaggttcctgatattagtatgtggacacctttgggaaccagaaatctgcctactacatacactattccattcagagttttaggacactccctctgatgctgttaagtggaccccgaggtcattcttgattcttcctttttggaatctgtggtaagacctttaggcagtggttatcttattgacttatgactcattgtgacgttctcacttacttcctcaaaaggagcagaaataaattcctttcattggcatatgacatctgttagggagtgaatgtttgtacttcctcccccatttatatgttgaaagtgactccccagtattggtattggttttggaggtggggcctttgtggagtaatttgggttgaataagatcataaggatggggccttcatgaatgggataaatacccttataagaaggtgccagagggctagcttactctctttacaccatatgaagatgtaacctggaaaaggtccctcatcagaacccaaccatactggcacccttatcttagactttcagcttctagagctgtgacaaataaatttctgttgtttataagccactcagtctctggtaatttgttatagtagcctgaaatgactaagataccatgttttccaagatgtctcagctctttgccagccagagtatcatttacacttttctctggagaaacttgttctgtactcagtctgttcactttttttcctatggcacttctttttgccactagcttttttttttttttactgtaatattgtcaaacatgctgtatcccagagccagtttcaggtgatctgcctgaaatggattgtggacccagagcaaccaatttaccctcttgatttctgttggtaatactaggatccccagagcccccattttgagccaggttaggcagatgaactatgccctgagcatctcttatgtcctgcagtgttcattctttcattcattcaacatagtaatcttgagtacctcctaagtgccagatattgtatcaagtggtagggatgtaacagtgaagaatggggaaagaaatcaccagcctcctgcaacttagtgtctagcagcagctatagttcatagatacagtcacatatttttctcccaaaataaactctggaatatcccagatttgggattctgttgatcctcactggcagcataaggacatgaagcagtataggcaactggaaaagagaaaccatagtcttccccttggaaaaaagcagcctatttcttaaaccaagatctttcaccatcttaatgtaaagcatataaggagaatatattaactttgggagactgtaacagttttcctttttctgatgtgtaatgtataccttatttcatctgcttgaactccattggctttcaattttttccaggtcttattgtttatcttctgccttgcctcatgatcccctttctccttttctttagccttgtcttacagctctctctctcattcactgattcacacaacatttattcactgcatacgctagtgtttagggctactgcttacctccctttctctttttttttctcttattcttcacatatctcctttgcctcctattctgacatgcttatactatgactagcaacccgctttcataaaatcttttctatgagcatacattggaacccttctagatacaagtagccagacaaggtgatcataaatgaaagactagtcttccctatatcaaatgtagctgtcatctgggaaaactgcatttacaaaatgcccaggtgggtagtacatgctctgacatttctctgtccatgtttctttactagatgcctggatctctaggaatctggtattcagcatagtggatgacacgtaggaaatatttgtggaattaatgaatactttttgtgatgcatgtctcttcctagagaatgtttgtttttctcaaaaacatgagccattccatacatggttgtattttgttatgctactgcacagagtttctgttgtatgtagtttcacaaaatatagcttttgttaatctctgcagatagtattaggaccaccaagttatctgaactgacatgtaattaatatttgcaaataacgataataagcagcaaatcagtaggattttcccatgggaagccatatttctcaaagatttctacatcctagtcagaggtgattcttcatttaaactgtgtagatgataatgggcaaagggaaattgtagcttcttttctctgttggagggcatgttttatttcttcttgttgttgccttcatcttttccccagtgcttcctgtgttgaccagatgatcacatccagctttaaaaccattcatggggatagtggctcaagccggtaatcccagcactttgggagaccgagacgggcagatcacttgaggtcaggagttcaagaccagcctggccaacatggtgaaaccccatctctactaaaaatacaaaattagccaggcatggtggtgggcgcctgtaatcccagctactctggaggctgaggcaggagaatcgcttgaacctgggaggcggaggttgcagtgagccaagatcatgccattgcactccagcctgggcaacaacagtaagactctctcaaaacaaaacaaaacaaatcaaaacaaaaacatttgtatctgaatacagtgttgatccatcttcccaccccttccttttttttttttttcttttgagacggagtctcgctctgtcacccaggccggagtgcagtgacgtgatctcagctcaccacagcctccgcctcctgggtttaagcgattctcctgcctcagcctcccaagcagctgggattacaagcatgtgccaccacacctggctaatttttgtatttttagtagagacagggtttcaccatgttggccaggctggtctcgaactcttgacctcaggtgatctgccagcctcggcctcccaaagtgctgggattacaggcatgagccacagcgcccggccccattcctctttttgactcattgccttttattttttttattactattatactttaagttttagggtacatgtgcacaacgtgcaggtttgttacatatgtatacatgtgccatgttggtgtgctgcacccattaacttgtcatttagcattaggtatatcttctgatgctatccctcccccctccgactcattgccttttaaagcatgctgtggtctccctctagtggagaaattgccatttcagaaagaaaaaaattcacagcctagagtcaggttatatttgttatgcctttatatttgaacaccttgtaaattgctgcttatcagtcaattttctgtttaggtgttgtagagtaaaaaacaatttttcttcaactctcgtaagttcttagtcagaacatacccttgtaacaaaagacaagattagtaggagaaaacaagctaattaatacgtatatttcatgcatacatgggggatacccaggaaatgagtaattctcaaagaggtagctttaaatttcaggttatagatcaccttcaacaaagaatagtaattttttaattgtattttttttaaagatgtgacaagacaaagtaaaaggactttgaatctctagtggcagcaacatctgggaagccaaataaatgagagatgacagctagttagtaaggcttgtttatataaattcctctgctaccatttctaggccaataagtgtctaaagttgtctttagtggttaacctttttaacctttgttctccctggtagaaaggggtgttgggttgggataccttcgtctttgtaaatctatgttctgcttttaggcaaatagagggagggcagagagctttcctgtacctgctgcttcttaattttcttcaggtcaacaattctttgtattttggggtggcatattatgaccttccatagtattgtatcttctgaagccaaacctcatcttactcaaaacagttaatcacctcctcttctctaccagttatgtacttagtgtaatttatattattgtagatttcttgctgttatgtagttacttctgggtatatctgttctgcttcacacttcagcatcttgagtagaatttcttaatcttgattgacaatcctatccagaatttccagaatgtttagtttaatggagtgttattatgggcctttgtattttccatgtccctctgaaattcctggaaatgtctgaaatttggaacagatactgttgtcagcaagttacctgaatggatatgtaaaaagcaggggtggcagagcttcttgggcagagcctctgttttttctttttctttttatcttttgacagagtctcactctgttgcccaggctggagtgcagtgacacaatcttggctcattgcaacctctgactcccgggttcaagcgatccttgtgcctcaacctccagagtagctgggactacaggcacccgccaccaggcctggataatttttgtattttttggtagaaacagggttttaccatgctggccaggctggtctggaactcctaacctcaagtgatccgcccatcttggcctcccaaagtgctgggattacaggcgtgagccactgcgcccggccagaccctctgttttcaacaacttcagtatttccatggagttccctaggcccattcattatcttttcacagcctcagcttggtgctcttatctctgggtaccttttagacattaacaacccatacctcttagatttctgaaaaggccaaaggaagatcttgtagttccacttctttgtttcttatgagtctttcttctccctccttccctcccttcctcccttcccctctctctttctctctgtctctctctcattatcctcttactcttcagagtcttcctgtcctgagaggcctttattccccagcagttcattatccaaggaccatgcatgttcctgagaggaacatgggtaggaccccctcagtgggtattggttgtttcaactaccccctagtggagaaactaccatcataggaaaaaaaaaaaaaaaaaaaaaaaactacagagcttctatgtcagtcccaagattttatcaaattgtaattatttgtacactcccagtctgttcctcactccggtgcctaaggtgtagccattgttctatgtccatatgtacccaccagtcgtccgggagatcctaccactatcaagccaactgttgagtttgatagttaatttgccttctgcagagatgaaatacttgctttaatggctttggccatctagcctctggccagagttctagacataggatttgtgaacaccatggacttgaactcaggatttagatgtaagtggaaagtgacactaagataaagatggaatagggttgccaaatttatttattatgtatttatttattgatggagtcttgctctgttgcccaggctggagtgcagtggcgcaatcttagctcactgcaacctctgcctcccaggttcaagcaattctcctgcctcaacctcccaagtagctgtgattatgggcacctggccccatgcccggctaattttttttaaatttttagtagagacagtgtttcaccatgttggccgggctggtctcaaagtcctgacctcaagtgatccacctgcctcggcctcttaaagtgctcggattacaggcgtgaaccaccattcctggcctagggatgccaaatttagcaggtgaaaaacctagggttgccagatttagcaggtgaaaaacgaaatacagaatgctcagttaaaattcaaattcagataaacagatttaggacacacttacactaagaaaaaaatagccattgtttataagcaattcatatttaactggaaattctgaattttatctggcaattttaatctggttccagattttgcaggatcttatcagtcatgtgaaggattttagtccttagtatgtataatagcaatgagaaacggcagagggattttaaacagggaatttgtatcttgtcaaataatgattcgaacaggccaccaaaatagtcttctgatcaaacaaattcaggcttgttacttacagcactaaggaaggccactaccattgcaatattgtcttaataacctttcagaaggggaaaatcagatgtggagggattcatatttataaggtttttggagtctggtttgtggcaggtctttcattgttggggcctgaatgattgagattggacaaacttcatgatataattttatgtcaaaattatatcaaagtttgtgatatatttttttcaatagtttttatgtaaaactttgaagagtatcagtcatttgataaacccatttgagagatgttctgagaagtggctgtttactcagatgaggactgcttgataagcattgttcagaaaaattgatttccaggaagtttctgaaacaaagctattcacaacttcctcttactggaagaaatttcctggaatagtagttgaagttaatgcaaagtattaaatagaaacgtcatattaatgtgggtggtaaactgtatgcctgcctttggttccggttctctttagcctctgctggttattcttcagtcttagatgagcttcacaaactgtatgttcatggcacacttagtttcagtctaagtaatttgccagggtatctgtagtccaagagatgtacctaacgtctccatttattaagtaattaagttgaaccaacttagtaagtttgcacattcacacaacttagtagccatatcattcttattgaaagtatttttatcttgtcattaaatgaccctataatctttttaatgctgaatatgtttcagaaacattaatattaaaaataatgattttaataaaaaagatacctgctcatcctaaaaaattttaagcattaaaatgtgttcagaaagcgtagtgaaaattcaccccaaatcctactcaccaggaatgcttattttttaacttggtggcctttattctaagtatatttctatgagtatacacataaactattttagaaaatttagatcataattgatgaagaaagaattatccatgatacttggatatagtaaggtagacattttttcaacagagactactgcattggggttttatagtaggaagagagattgagctcaactccaaatacaaggaaatttatatccaaggagcaggatgggtgttatggcttgaatatcccctcccaaactgaagcgtatctgccactataatgttatcaagaggtggagcctttaagaggtgattaagtcatgagggctgtattttcatgagaatgggttagttactgtgagactgggctcctgataaaacaataagtctggcctaattttcactctgtcttgaccaccaacttgcccagctgtcatgggatgatgaacataaagaccctcaccagatgacaatgtcatgctcttggatttcttagcctccaaaatcatgagccaataaactggttcataaattacccagtctgtggtattgttatagcagcagaaaattgactaagacagtgggaagcagtggatggagaaatgctaagaggaaacatcaggagtaaggagagattgtgagtaaactgacttgataggatacttgctcaaagccggatacagtgatcagatacctagagtaggagattttcactaaactgactcagcaggattcttactgaaaccagactatgtgggccaaagacaggacccaaggttgggacctaatcagaaagagaattcagaggaatctgactcaagtttgctcaaggagagaatctttttcataatataaatgttttatattctcagcagtgtcagagaactggacaaagatatacattattgcctctctcagagaataatattctgtaaggactaataaaagaaacatagaactaaggtagaatcataaaaattggaaaggaggaggcaatatccatatgttagagaggctatacttgttagaaaaatcaagagcttcacctaaaaaattcctgagaaggagaatttagtgagatagttgattgaaatttctttcctatatacaacaataaattgtataataaaatggaagaaaaattccctttgaagaaattaaccaaacataaaatacctaggtctaaactgagcaggaaatgtgtaacatctatatggagaaaagcttggaatgctaaaagggaactagagagaaggcttgaatatatacaaacacagagccactttttgaattgggatatccagtgtggtaaatatgtcagtttcttactgtataaatataatgcagtcacgatgaaaaatatctggaaattaatttgtttggaactaaacaatctgcttctgatgtttatatgtatgtatcaccttgagccgagagtcaggaaatatttgaaatagaagaaccatacctagaagtaagatatataagaaagttgcaattgacaaaaacaatttggaatttgtacatgcttagacagtgaaaacagtatagtgaattcaaaagtagacctgggctgggcgcagtggctcacacctgtaatcccagcactttgggaggccgaggtgggtggatcacctgaggtcaggagtttgagaccagcctgatcaacatggtgaagctctgtctctattaaaaatacaaaaattaactggatgtggtggtgcgcacctgtaatctcagctactagggaggctgaggcacaagaattgcttgaacccaggaggcggagcttgcagtgatccaaggtcacgccactgcacttcagcccaggtggtagagagagattacgtctcaaaaaaaccacaaaagtagattcaaatatatgtggcaatttagcgtatgataaaggtagaatttcagatcatttggaatgaagtgtttaattcagtttatagtgttgataactggccatacatttggggaggtatacatttcaccttataaaaccctttgcacaatttgaattttgaactcttcaacaaagagctagtttaaaaaataaattaaagggttgatatgattaggaaatttttaaatgtatatttgtctgtctctgtcaattcaccatgttcacagactaggcaaaggaataaaaatgctgccataggaaaacaaaacctacctaatatagtgtgtaatggggtattttgacatggatatatcagagatcaataaaattctcccaaatgtaagtattaatgttaaaatctccaaacttttctaattgagataatacaaaataacatatacactgccagtcaattggcataacattcctcttaaaatataggtctattctatgagcagctgatatggtttgtatctgtgtccctgcccaaatctcatgttgaatcgtaatctccaatgttggaggtggggcctagtaggagatgattagatcatgggggtgaatttctcgtgaatggtttagcctcatccacttggtgctgttccagtgataatgagtcagttcttgtgacatctggctgttaaaagtgtgtagcacctccccactctctctcttcctcccattctggccacatgaagtgtcaactcccccttcatcttctaccatgatgtaagcttcctgaggcctccccagaaaccgagcagatgttagcaccatgcttcctgtatagcctgcggaaccgtgagccaattaaacctcttttttttaattaaattatgcaatctcaggtatttctttataataatgcaagaataatacagcaactgaccagattatctagctgtgactgtatattcttaaaatttcatatagggttaatcaagcccccatttagggagtatttttgttacttttatttttaattgtggtaaaatatacatgacaaaatttaccatcttaactatttttaagtttattgttcattaatgttcattgtattcacattattttgcaacaaatatgcagagctcttttaattttgggaaactgaaactctgtacaacattaacaactttccatcctcctctctccctagttcttggaaaccaacattctatttcctgtctctatgtgtttgactactctaagtgcctcatataaatgaaatcaaactgtatttgtctttgcgtgactggcttatttcacttggtgtaatatcctctagattcatccatgttgtagaatgttttagaatttccttcattttaaaggccgaataatattccactgtgtgtgtctatgtatgtatgcatatatatatatatatatgtatatataaaaacaatatgtattgttcattcattcttctgtggatagacacttgggctgcttctaccttttgtccactatgaacaatactgctgtaaacatggatatacaaatatcccttcaagaagctgcttttacttctttaacccatttatgcctagtgttccattattggaatgctaagcatgtaggagttatttatatcttactactcaaggtcatcatcaaggtctgattgcaaaaattcaaaaaaattgcaactgccagcataaatgggtttaagtatatgtcgagaaagtagaattgctgggttatatagtaattctgtttctagttttttaggaaccaccatactatgttgcatagtggctttaccatttcacattgccaccagcagtgcacaagggttccagtttttccacatcctcaccaacactttgaattttccttatttatttatttttgatatgtagccattctaatgggtgtgaggtggtatctcattgtggttttgatttgcattttccatgtgacaatgttgaatatcttttcatgtgctcacgggctatttatttcttttaaggaatgtctattcaaattctttgctcattttagaatcagtttgtttattttttgttgagatttaggaggtctttatatattttcagtattaacccctcatctctaacacacacacgatttacagatattttctcccatttgatgcacagaagtctttaattttgttgtagcccaatttatctattttttccttttctttcttgtgcatttcgtggcatattcaaaaaatttttgctaaataaaatgtcatacagttttcccctatgttttcttctaaaagtttcaagcttttgctttcatttgggtctttgatccatttacagttaatttttgatatggtataaggtcaggatccaacttaattcttttgtatgtagatatccagtttctccagcatcatttgtttcaaagactgtcctttacacattagatggtcttggtatctttgttgaaaattattgcaccatatatgttagggattctttctgtgctctctgttctattccaccggactgcaggtctgtctttatgccagtaccacattgttttgagtacgattgctttgtcaaagacaagatgttccagaccattagggaatgtctttatttagactgttgcaatagggagaaccttcattattgaggaatatttcccaggagaaggagatttaaggctttttagaggcagattacaagagagtcatcatgaggcttacatgagtcatgaggtaggatggagatgtgtcctatatgcaaagacagggtagacttttgaagttacttgtttctgaggacacaaaaagatcggggaggtgtggtatttctaaaccattgatgcttccttggagcacagggttcaagtgaagttcatcatggtcactacagtttagtaaactttttttgtctggactttgaatagacaatgatttttttttcctttttcgaagatttaaataggaaaaaaaattcttgtttggtttaagtagttacatttcttttccagcaactctacaatttatttttcccaccacacatattataaatataaccaattatgtactcaaatttctctctgcctttcaaaataatactttgtgactcagaagacattttaaaaaatatacttaaaggaacataattattaggtatgcagtataaatttgctcctaaaactttttccatttttatagttgaaacaatcttacacataatgatgcttatatctactctctgtagggaagaatttgtaattctttcacacaattctgaatattttacaggttttgggggactttttttcttttttttttgagacagagtctcgctctgtcgctaggctggagtgcaatggtgcgacctcggctcactgcaacctccgcctcccaggttccagcaattctcctgcctcagcctcctgagtagctgagattacaggcacccatcaccacgcccagctaatttttgtatttttagtagagatagggtttcatcatgttggccaggctggtcttgaactcctgacctcaggtgattcacctgccttgacctcccaaagtgctgggattacaggtgtgagccactgtgcccggccatttttttggattttaaactaaccattccaggctgggctgagcgattcatacctgtaatcccagcactttaggaggctgaggtgggtggattgcttgagcccaggagttcaagaccagtttgggcaatgtagggagaccctgtctctacaaaatataaaaaaattagctgagtgtggtggcttgggcttatagtcccaactgcctgggaggctgaggtgggaggattgcttatgcacgggaggtcgaggctgcagtaagctgcgattgcaccactgcactccagcctgggtgatagagtgagactctgtctcaaaaaaaaaaaaaaaaaaaagaataagttaataaactaaacattcctgggaagactggccttaaattctcatcctaaatattagagttttaattttttcctacttttgaattattgaaacttcttttttactatcaagaagggctgactgtattttcctattgaaaacatatttgctaactctgcagtcatattcttttgttacagccctctcatttaaatttttcttgaattttgcctcttgttataaagggtggctttgtgttgatctttttcaggtttgtggttttctttcagagcaaagtaaggcagcttatttcttttgggcatttttgccccattttttaattgaagtacaattaatacacagtgaaatgtaaagatcttaactgtgcattttaagggaaacttcaagacatttgttcattgattcacaaaagtgcagaaatctcagcgatttttcaaaaaatgaactaacccatgtaaccggcactcagatcattcttggtaccccaaaagtccttttttgacacttcccatcacaatcccaccaaaggttaacctttatcaagacttttaacaggatagattagtttttttatatagaaataaaattacactctatataaatagtatatgctctcctgttttggcttctttcacttaacattaagtgaaattcattaagtgagattcatccatgccatggtggttatagtgttgttatagttcactcattctcaatgctgtacaatattctgagtcattaatgtaccatatttgttcattttgtgttgatggatattagggttgtatttttttttttctaatttggtcttgcagtctgtctctggaaagtagctataaactttattccccaacaggttccaagggatttggttgtggatgtttacaatgtgcctttcacaggatacttctttatcctggcagatggtatgatgcctaattgtctgaggtgtgaacaagtgtctttctcaccagaaattattttatactggcagatgcttgtggctattatcagacctgtgtcccgtttattcctgtcaagatagccactgtgtaggagaggcttaactgggagaaaagttaagtctgaatgtatcagtctggggagatataggtgtgtcagttgggtaatactatacagaggagacagcacaacaaaaacagatgaaataatgtagacagtttattattcacaggttgatgggaaaacaggggtaccgacaggggctgttggaaatactgtagaggaaatgtgctcaaccagcaggtggagagataatgagttgaggcctttattgggtccagtatgttaccaaagcaggttacctctgatgagttctcattagtgggtgtagagcaagcaggcatgagttatactggatgaacgtctcgatggggaggttgtcaccgtggcatatctgcacagtccatgcatggtgtaagggatcaatgggccaagtcaattaggttatatctatgtgttccatagggaggtggtcatcaggaggcaattgtctaagatacatatctggagggaacacattaaggaattgggaggagacagagaactggaaactgtcaaggataatatggagcctggctcggtgtgagaaagttaaacttatattcagaacggataccgagacagcataaaattgtaagaattcactatgagtgttgtttccacttggggttactgcaaatataactgctatgagcattcttgtacctgtctttaggtgaacatatgtattcaattcttttgcagatatatctaggattgagattgctggatcaaggtgtatatgtatatttgggtttctaaaaagctttctttgggtaatttttttttacctattataaaatcactgatttgaagtgtgcaattcagtaatttttaccaactttaatgagtgttatacccatatgataaatctgtcatagaagatttttatgcccccaataagatccctcagctacatttacagttatatcctgtcttatcccagctccaagccaaagtaatcttcctatctttctatctccacaaatttgccttttctggacatttcataaaaatggaattatgatccatacctatgtggtatcttgtgttcaccttctttcacttagcataattttcagaaatcatccatgatatacccatgcatcaggaattcattcctttttattgccaaataatattctacagcttgtctttcccttcatgagttgctgagcatttgggttatttgtagttttgtctcatttgaataataaatcatcatgaatacttttgttcaagtctttgtatgaacatatatttttacttctcttgggtatgtacctgggaataaaatttctggcttgtatattaaatttatgtttagctttgtgagaaactgaaaaactgttccaaaatgactgcactattttacattcccgccagtaatgcatgaggagagggttcctgtttctacacatcctcaccaacgttcattattttctgtcttatatttattatagctatttacgagggtctgaaatgataatgtgttgtggttataatttgcatttcctttatgactaatggtcttggacatttttaatgtactcattagccagatatatatatcttcttttatgaaatgtctgttcatatcttttgtccactttttgattggactgtttattttctgttttttcttttcttttttttttatttttgagatagagttttgctcttgctgcccaggctggagtgcagtggtgtgatcttggctcactgcagcctccacctcccgggttcaagtgattctcctgcctcagcctcccaagtagctgagatcacaggcatgcaccaccagccctggctaagttttgtatttttagtagagacagggtttcaccatgttggccaggctagtcttgaattcttgacctcaagtgatctgcccgcctcagcctcccaaagtgctgggattacaggcgttagccaccgggcccagccatatcttcttactgtagacttctaaagattctttctaaattctggtttgaagttctttatcagataagtgttttccaaatattgtctcacagtctgtaactgaccttttcattttctctttctttctttttttaaaaatcaatatatatgttttcatttttttaaattttttttaaaattattaatttttgtgtgtacatagtaggtatatatatttatgagttacatgagatcttttcatacaggcatgcaatgcataataatcacatcatgggaaatagggtatccatcacctcaagcatttatcctttgtgttataaacagtccagttatattttttagttattttaaaatgtataattagattattactaactataatcaccctgttgtgctagcaaatactaagtctgttcattctttctaaccatatttttgtacctattaaccatctccactcccctgcttcttcccagactcttgtaaccatccttcaattctttttattttattttattattattatactttaagttttagggtacatgtgcacaatgtgcagtttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcagttcccacctatgagtgagaatatgcggtgtttggtttttttgttcttgcgatagtttactgagaatgatgatttccaatttcatacatgtccctacaaaggacatgaactcacattttttatggctgcatagtattccacggtgtatatgtgccacatttccttaatccagtctatcattgttggacatttgggttggttccaagtctttgctattgtgaataatgccgcaataaacatacgtgtgcatgtgtctttatagcagcataatttacagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcgtgtccttcgcccactttttgatagggttgtttgtttttttcttgtaaatttgtttgagttcattgtagattctggatattagccctttgtcagatgagtaggttgtgaaaattttctcccattttgtaggttgcctgttcgctctgatggtagtttcttttgctgtgcagaagctctttagtttaattagatcccatttgtcaattttgtcttttgttgccattgcttttggtgttttagacatgaagtccttgcccatgcctatgtcctgaacggtaatgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaacggggaatcctttccccattgcttgtttttgtgaggtttgtcaaagatcagatagttgtagatatgtggcgttatttctgagggctctgttctgttccattggtctatatctctgttttggtaccagtaccatgctgttttggttactgtagccttgtagtatagtttgaagtcatgtagcgtgatgcctccagctttgttcttttggcttaggattgacttggcaatgcgggctcttttttggttccatatgaactttaaagtagttttttccaattctgtgaagaaagtcattggtagcttgatggggatggcattaaatctataaattaccttgggcagtatggccattttcacaatattgattcttcctacccatgagcatggaatgttcttccatttctttgtatcctattttatttcattgagcagtggtttgtagttctccttgaagagttccttcacgtcccttgtaagttggattcctaggtattttattctctttgaagcaattgtgaatgggaattcactcatgatttggctctctgtttgtctgttattggtgtataagaatgcttgtgatttttgcaagaaggaatggtaccagttcctccttgtacctctggtagaatttggctgtgaatccatctggtcctgcactctttttggttggtaaactattgattattgccacaatttcagagcctgttattggtctattcagagagtcaacttcttcctggtttagtcttgggtgggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagtggtctatcaattttgttgatcctttcaaaaaaccagctcctggattcgttaattttttgaagggttttctgtgtctctatttccttcagttctgctctgattttagttatttcttgccttctgctagcttttgaatgtgtttgctcttgcttttctagttcttttaattgtgatgttaaggtgtcaattttagatctttcctgctttctcttgtgggcatttagtgctataaatttacctctacacagtgctttgaatgtgtcccagagattctggtatgttgtgtctttgttctcgttggtttcaaagaacatctttatttctgccttcatttcattatgtacccagtagtcattcaggagtaggttgttcagtttccacgtagttgagtggttttgagtgagttttttaatcctgagttctagtttgattgcaccgtggtctgagagacagtttgttataatttctgatcttttacatttgctgaggagagctttatttccaactatgtgttcaattttggaataagggtggtgtggtgctgaaaaaaatgtatattctgttgatttggggtggagagttctgtagatgtctattaggtccgtttggtgcagagctgagttcaattcctgggtatccttgttaacgttctgtctcgttgatctgtctaatgttgacagtggggtggcatccttctattctttatgtccatgatttcagttgttttgagttttagatctcataaataacttgagaacatatgatgtttgtctttttgtgcctggcttattttccttaacgtaatgatctccagttccatccaggttgcagctaatgacagaatctcattctgaatcatactccattgtgtataagtactacattttctttatccattcatctgttgatggatacttaagttgcttccaggatcttggctattgtgaacagtgctgcaacaaacatggatgggcagatatctcttcagtatacagatttcctttcttttgggtgtatatatatatataacacacacacatatacacatatgtgtatatatacatatatacatgtgtatgcatacatatgtatacatgcatatatgtatgcatatatatgcatgcatgcgcgcatgtatacagatatgtatacatgtgtatatgtatacagatatacatatgtacatatatatacctgtacatacatatatacacatatacacacacacacacatatatatacacacatatatatccaacaatttgattgctggattatatggtaactcaattttgagattttttgtggaacctccaagttgttatctatggtggttgtactaatttacattcctaccaagagtgtacaaaggtttcctttttctccacatccttgccagcatttgttacttcctgtcttttacataaaagccattttaatgagataagatgatatctccttgtagttttgatttgcgtttatatgatgatcagtgacattaagcgccttttcatatacccatttgtcttcttttgagaaatgtctgttcattattagactttttttctacacagtagtttgagctccttatataccctgactattaatcccttgtcaaatgcatagtttgcagatattttctcccattctgtaggttgtctctttgctttgttgattgtttcctttgctgtgcagaagctttttaactttatgtgatcccatttgtccatttttgctttggttgcctgtgcttgtggaatgttactcaagaaatatttgcccagtccagtgtcctggagaatgtccccaatgttttcttttagtagttttatagtttgaggtcttagatttaagtctgtaatacattttaatttgatttaggcaagagatagggttctagtttcattcttctgcatatggatatccagttttcctagcaccatttgttggagagactgtcctttccccaatgtatgttcttgaaacctttatcaataatgagttcactgtagatgtatggatttgtttccaggttctcaattctgttccactgacctgtgtgtccgtttttacaccagcaccttgctattttggttactatagctgtgtagtataatttgaagtcaggtatatgattcttccagttttgttcttttagattaggtcttttttctgttcattttctcatttagttcttctttatttttaatttttttgagatggagttttgcttttgttgcccaggctggagtgcagtggtgcaattttggctcactgcaacctctgcctcccaggttcaagcgattcttctgcctcagcctcccgagttgctgggattacaggcgcccgccaccacgcccagctaatttctgtatttttattagagatggggtttcaccatgttggccaagatggtcttgaactcctgacctcaggttatccacccgcctcagcctcccaaagtgctgggattacaggcgtgagccaccgtgcctggccaatggcttatttttaggtgtgaaagttttgaattttgacaagacataatttattatttctttctagtattcactacacccttggtttcatatctaatgaatctttgcctaacccaacatctgaaagatttttaccaatatgttttcttgtaaaaatttaaatcttctaaccccttcatgtaggtgtttgatgcattttgagttaatgtgtgtatatggcatgcattgtggatctaaatgcatctttttgcagttgttcatgtgattatataaaacacaattcctcgagtaggcttcccttctccagtgaattgctttggcacctttgctagaattcaatgaacttataaatgtagtttttgaattttatcatactgatttatatgtctttccttatgcctggtttacaccatcttcataactaactctatataggcatacttcactttagtacacttagctttattctggcatacctcatttcatggcattttgcagatattgtgtttttaaacaattatttatataaattgaagcactgtggcgatgtactgagcaagtttcttggtgccattttttcaacagcatgtgcccacttcttatctctatgtcacatttttgtaaatcttggaatatttcaaactttacaatttttattatatctgttatggtgatctgtgatcattgatctttgatgttactattgtaattgctttagggtgccacaaaccacgctatataagatggtaaacttaatctgtaaatgttgtgctgtgctctgccaatcagtagttccttatctctgtgcctctccttgggcctccctgttccctgagatacagcaatattgcagttatggcaacgaataactctaccatcatctcttagggtccaagtgagtcacacatctctcactttaaatgaaatgctaaaaatgattaagcttaatgaggaaggcatgtcgaaagctgagataggccaaaaactaagtctcttgtgcaaaatagtcaagttgtgaatgcaaatgagaaatccttgtaggaactgttttttgctaaaaagttaaaagtgctactccagtgaagacacaaatgataagaaagaacaacagccttatagttgacatggggaaagtttgagtggtctggatagaaggtcaaaccagccacaacattcccttaaaccaaagtttaataaagagcagtactctaactcttcaattctttgaagcttcagaatggtgaggaagcctcagaagaaaaatttgaagctagcataggttgttggttcatgaagtttaaggaaagaagctgtctctataacataaaagggcaaagtgaagcagcaagtgctaatgtagatgcatgttgtctagaaggtgtagttagaaggtgtagctaagatcattgacaaaggcggctacagtaaaatacaacttttctatgtagatgaaacagctttctagtgaaagtcctatgtaggacttccatagctagagaggaggagaagtcaatgcctggcttcaaagggcagactgactcttttgttagtggctaatgcaacttgtgatgtaaagttaaagccagtgctcattgaccattctgcaaatcctagaccccttaggaattatgctaaagccactctgcctgtgctctataaatggaacagcaatgtctggatgaaaacacatctgtttacagcacgatttactgaatattttaagcccactcttgaaacctctgctactcagaaaaaaagattcctatcaaaacattactgctcatatgcaatgcacctagtcacccaagagctctgatggagatatataaggagattaacgttgttttcctgcctcctaaaacaacatccattctgtgtagctcatggatcaaagagtaattttgcctttaagtcttattaagaaatacattttgtaaggccatagctgccataaacagtgattcctctaatggatatgggcagagtatattgaaaacctggaaagggttcaccattgtagatgccattaagaacatttgtgattcatgggaacatgagcagttcaatgaattctattacactatgagtgcttttggctagattatctagctttttgaccttggacacattatttaatgtagagcctgatctccatctataaaatgggaatcacagtagtacccacctcatatgaccgttgtgaggattagatgacattttatatggaaaatgtctgcagtaaaccgtccataaatggaaggagttttttaaaaaatgttgttggtataatcaccattatgatctttatgattctatgttttaatttcattttataatttatcctgtgattttttttacctcagcatcaccctttataggatataaccacatttcttctcaatacctataccaacagcactaatcattaaagaaatgcaagccaaaaccacaatgagatacacgtcacacttatttgaatggctgttattaaatagacaaaagataacaagtgtttttgagagtgtggagaaacaggaaaccttctatacagttggtaggaaggtagattagtacagccactgtggaaaatagtatgaacatttctaaagaaattaaaaatagaatgaccatatgactcagcaatccctcttctggttatatacccaaaggaaatgaaatcagcacctcataatcatgtctgcattccgtttttgttgcattgttattcacattagtcaatatatggaaataaccagtgtctgttgacaaatgaatggataaattgtggtatatacacacacacacacacacacacacacacacagaatggattttcattcagccttaaaaaagaaagagatgtgccatttgcgacaacatggatgaacatcataatgatattagcccaaaagagaaagaaaaatactgcatggtctcatttatatgtggaatttaaacaacaaaaaaaaattcagtggtttttgtgtaaattagtacaatagaagatccaaggtagagtactttaaattagcaagatatttctaactgtgcattttaagaaccatttttatttttcttcagtttggaactacaacctttagatatcaaaatgccctttgtaacttaatttttattcttttttatgagagaggtgcatgtttttcaagtacatttatctgttaacaaaaatagttggagttcgcgaaagcctattatttaggcaaagtcttcctttgcaaagattcagactaaagtactagcaggttttaaataatacatgatttattatattttcttgtttttgaactgagacataaaatatcctttaacttaaaaatatgttttattatttaataataaaagaagttgtttcttcaagctaaatgcctggtaaatacattttattatgtgatcagcttgtccgtattctaaaataatagtttatgacttacatgagcctattttttcacttgattaagtaacataattagctgatttacaatataaaacatattcctaaaacccttttcagctttgaaatttcaaatgccactgtttccatataatgacatgtgaatttacattttagaaagcataatttaaaattatatacctctatatttttaaggttcttggcaatttaagtagaataatttccatagagagacaattcttccctcctactctgtatgtactctaatgttgtctacttctttcttctgttcctgcagtgttacttacgttttttatactatccagaggcttaggctgtttgcctttgatgacatggatatatattgctcagtcatacgctttcaaaaaataatctcttcatttagtttttttattattttattactattaatttataataaaatttggtttatatgaaggatcttaaataacatatataaggtataatcaataatataatgagtctataagaactcagcataaaaaacagaacattttcaatagcttgaaagcctcctgcataccccttcacataaccctcccagatcatattgctttcctgttctgatacagataaccagtatctggaatttagtatttaacattcctttacttgtttttctttttataggtttactatatgttttagtttgtgctaagtgaaatggccactactcaaccatttttggtctataattataggaattttatatggttcagctgagtacacacatacacatgcacactcccaaacacactggcctgttgttgaacattatataagtgatgttacagtgtagtattcccactactttctttttttactcaacattatcacctagagattcattcatgttgctgtgcaaagctctatttaataaatttgtgctgccatatagtattccgttatatgaatattccccaattactttataaattttcttgtttatggacgtttattgctgctttcaggtttttggtgttttgacttttataagtaatgctgccatacttcttttttcacatatcccaacaagtgtctctaggtaggtatataaagtagtgaaattgcagagacctagggcatatacatattcaatttttataaacaatactaattttccaaagtaattgaccaaaagtatacttttaccatcagtgtaaagattgttcctttgtactaaatctttatcatttttttattttctgttttttaatatttgctcctctggtggatattatgtggtatttaattgacctttgactttgcatggtatctaattgaggttctaattaaggttctaattattaatgaagtaatgaagtggaatatttttaaatacatttattatccattcatttttcctccattttgaatgacctgctcatgtcgtattctggttttggtattagggtaatatcggcttcatagaatgaattgggaagtgttctttcctttcaattgttggaagtttgtgaaggattcatattaattcttgaagtttttggtagacttcaccaaattaataatttttaattagtaatttaatctctttactcattgcaggcctattcagattttctatatctttttgagtctattttcttagctggcatctttttaggaatttgtccatattatctaggttatctaattgagtgtcatacagttggtatatctttttgatcttctgtaaggttggtagtaatgttctctttttcgttcctgattttactaatttgagtcttctcttttttttctcccggtcactgtagccaaagatttgtcaattttgttgaactgtcatatgtttttcatatttcgttaattatgtttattttttgattctctatttcattaattttattatttcctttattcttcttgctgttaggtttactttgctattttcccagggccttaaggtaagaagttaggtgattgatttgagatatttcttcttttgtaatataggcatttacagctttaaatttccctgaaacacactgcttttacctgtatcacagaagtattggtatgttttcatctctattcatctgaaaatattttctaattttcattgtaatattatttgatgtgttggttttttaggagtatattgtttaatgttcacatttgtgaattttcaaaatttctttgttattgatttctaatttattccatgtgctcagagaacatactttgtattattcctgtcctttaaaattattaatgcttgttttatgacctggcttatggtatattctggaatatgttcaatgtgtatttgaggagaatgtgtgttctgctttttttgaatggcatgttctatagataatctgttatgtatacttagtttataggcctattaatgtcttctatttcctattcatcttctgcctagttgttctattcatcatttaaagtggggtattgaagtgtgcaactattattgtggaattatttatttttcccttcaattctgtcagttttgctttaatgtactttggtactctgttgttagttgtatgtgtgtttatactttatatgtcttctggatggattgaccttattattattattaaatattcctctttgtttctactaatattttttggtttgaagtccatttttttctatattggcattgccactccagctttcttatgcttgctatttgtataatatatgtctcccttttacatttaacataattatatgtttaaatctaacatgtgtttgctatagaaagcatacaactggatcttgtttttttttttaattttccagtctgaaaatatgtgccttttgattaatttgtataatcaattaatagttaatgtcattattggcatgggtgcacttatgtctgtctctttgttttctatatgcataatcttttctgttcctctgttcctctcactggtttcgtttgtattaaatggaaattttttgttgtaacattttaatcctttaatggtattttcttattttactcgttttcttaattgttgctctaggacttaacaatttatgtgagaacttaccagaatttctttcagatgttaaattttcctgagctgtagctatttcttctcccttttttggtgctgttattacacatatgacgtctaaatacgttatgtaactccaacaatacattattacaattattacttttgatagtttttttgtcttttactgaacctgagagaggaatggagagcaagtatataattttaaaaacttgttgattaaacttctcatttactatttctaatgttcttcatttcttggtatcatacccagctgttatccctgagtaattgttgaccgattgctacattgactttgacagtttcctgggacataatctgctccacagtgatacatttatttttggacccctttgcaggaatagtctttgaggccagtgtttcatgcttgctccagccataggtgggcttttctcagctatgtgtttgtttctcacttgtaaactggctggcctatgatttaaagagctcattaaactactaacctcctcataattgcttaccacaaaaatctacactgttttcagggactcccttaggctcaaacttccttacactctgttttaaataaaaatcagttcccttctagagagccttggacctgttttttaatagcctgcctctccccgtgggcagaacatatgcactaaagctttgggaggtaggggtggggacagtgtcatccttctctcagaatggcatccatgctctaggaagaggacattgggtaaaaacagtaacccgtggtcttcttggcttccccctccctgcatggaacctctgccttgtgaattagctggagcagggctgattggggcctagtattctcagattacttttcctagggtagagcttccgtcctgtgactggtcacttgattgaggaaaggagctccagacctctataacatgattgcctccatagagcttttgtaacctagagctgagggtaggatgaaaaattccaatcacctgctagagggaaaagtgcatgcccttggtttttggctgccccagccataagcaaaactttatcctgctaagccatccaggggaagggggagggagcaggttgtggctcagatgccacagactcttgctcttcttactgagatttcatagattttactaaaaatgtttctccatttgccgtataccatcaggacagattctagagactctaaatggttatttttcaaacaaataattttccccagttgtggttgttttgctgggagctcctcatgttgccattgcacatgtatctcttctaacgtggagaaacatttgacatacaaaaagtatactgtaataataacagtctaaccaaactttccagacaacagcaggattttcctccaacatctgtgtttgatacacagttgcttatattttgtttgtactcttgtatatgtcactgccctgcagccacagtacctacctgtgtttgaaaacaggtccagcctatacctgcctttggcctttgcactagctagtttctctttctacactgcttttgcgcaaggctctttctccattttcttcagatctcaacataaacttcaccttattgcagaaactttcccatatcactggatagaaaatagcacctctttggcaggcacctgtagtcccagtcccagctacttgggaggctgaggcaggagaatggcgtgaacccgggaggtggagcttgcagtgagcccagattgtgccgctgcactccagcctgggcaacagagcgagactccgtctcaaagaaaaaaaagaaaaaaaagaaaagaaaatagcacctctttatctctcttgatccctcatatttcattttaccaatacttaatgtattttgtcatatattttaattatttgtttatcctttctttgccatcgttagtacttaagctccataggggtatgaattttgtctgttttgtgttttgtggtatgcctagtatgtagatcagtgccatgcacaaagtagactttttattttattttattttgttatttatttaaatttccagttttattttagatacagggggtgcgtgggcaggtttgttacatgcatatgttacacccaggtagtgagcatagtatctgtagctagtttttcaacccacgccctcctctttcttcccccgtctaatagtcttcagtgtctattgggcccatgtttatgtccaggtgtgctcaatgttttgcttccacttataaatgagaacatgtggtgtttggttttctgttcccgcattagttcgcttaaaattatggcctccagctgcatccatgttgctgcaaaggacatgattttgttctttttatggctgcatagtattccatggtgtatatgtactacagtttctttatccaacatactattggatggtatacttttaataaatatttttagagtgaataaatgagttacagtatggcaattttatctatccccagaggagcactgtccaatacaactttctattatgatggaaatgttctctgtctgagttatccaatgtggtagatgctagttacatgtggtcactgaggatttgaaagatagctagtgcaactgaggaaatatattttaaattttatttaatataaattcagattaaattaggccaagtgtgcatatggttactttacagcacaactccaaaaagtcgtccgccttaccatggcatcttttcaaggcataatttttaccttttattcctattcatggagttacttctagcattgctggtattgtcatcatttttactacatactatgtgcactgtaagcatcttgggtctttatagaaactccctttggttatacttgctgtcaataaacaagagttcaattatcgggatttgtctacaaatgaaattacatccttaattttgcttgattttggaaataagcatctagttgtctcttcatttcttctttcatatgtgatacattttgtaaattttttcaagtcatattgtttttgcaataaaatggcatgaagtactgatgcataacaacatgaatgaaccttgaaaacattatactaaatggaagaaggcagtgataggagatcaaatgttgtttgagtgcatttatatgaaatttccataataggccaatctacagagaaagaaagtcgattagtggttgcccaggctggtggggaataggggaaatggggactcactgctgaagggtttgggctttctttctgcatgatgaaaatgttctataattaattatggttatagttgtacaatttgtgaatatactaaaagcctctgaatttcatatttcagtatgtttgtgtgtgtatgcatgtcttatatttttatatttattttatcttttttctttttttatcttttttttttcaaattacccagaatctgagatgtgtttttttttttttacctcttccttcagagattctgattcatcagaactaagatgataatctgcattttaaacaagcaatccaagtgattctgatttaggttgccaaaagatttttttctttaagaaacaatgctttaggcaaggatgttattaatctttctttaagaaatttctgataaagtagggaaatgcatatctttcccctaattatatatgaatatcctggcctccctgataccatggttatattttgaactgaaatttgtagttattgatgatgctgacacattttctctgtatttggcatgccattgctattttagacatataaggacactcaattgctgtatggtactcagatggctttatcttatcagttgaaatttcttcttattctttgtatttttctttaaaaaatagatttggtacttgccataccataacctctgttattacaactgttttaccattactttgaaacctattgtagagaaacaagaactctttctctacattatcccagtcttcacattttgtaagctgcttatcaggttgggttttctagtaagatatcagaagcacagcctacacagggcagagtatgtccaacatgtggtggtgggcaatctgtgtcttaatcatctggaatgtttgttaaatatcctgggatctgagaatcaaaatttctgaagaggtagtgtattagtctgtttttacactgctgtaaagatactacccgagactgggtaatttgtaaagaaaaaggtttaattgactcacagatccacatggctagggtggcctcaggaaattcacagtcatggcggaaggcaaaggggaagcaaggaccttcttcacatggtggcaggagagcagcatgggggaaactgccccctgatccaatcacctcccaccaggtctgtctctagacatgtggggagtatggggattacaattcaagatgagatttgggtggggacacaaaggctaatcatatcaggtagcttgagtatacaggttactatcatgtccactgaagtctgagagcaactgacgtaaatttttcattttcctttttttgtgtgccaaaactgtagatgagagaaccactgatttatgtagtgatctgtgcctttatgttctctaatacacaacttcagaacagttttaaaattcattctgattcttccttaacttggtcattatatttgcttttcttgggatgggtagaattttgcagtttcacttgaaactgatttttgcctctctacttgatcttgcttgtctaataaaaactgtgctttgcaccctctagcatgctttttgtcacctggctctactcccgatttctacactacttaacttggtcagcatagacttcacctttaatagacttaaaaaaaatctctgctactccgtttatgtgtgtgtgtgtgtgtgtgtgtgtgtgtgtgtgtggtgtgtactattgttctgctaatgttcttttatgctttggtccttcttataaatccataaaaccatagggataacagtattacaattttaaatacctgtaacctctgacctttcacagaaaatatgaaatacatagacgtattgacctgaccatttctaaattgctatggcttctaaccttttccagcaatctgaaaagttgtgggaatttatattctatttgtaaagaaaggactaagaactgtgacttcaaaataagaatcatagtagaccagttataaaatgcactatctaaaaaggtatgcttcacatttatgatcccggtatttgcattctgtgtcaaacattaaatatgagagaattattccaagagagatgaggaagaatcgatataattttagctggcagaatttattaacatatttgcttatcagtcctcacaaattatgagctgtccttaggtgatatatttatttggattctgctgtgttgttttggtggcaacaccatgcctgaataggtgaaaggggctctggaatctagatacttgccttaaaaccttgtccctgccatctgctagttatgctgctagtctagttggctctcctgtctgagcctctctttctccacaggtgaaaggggaaaataatagtgcccatgtcatagagttatagtgaggaacatctgaaataattcacagaaagcacttagtgcaatgtttggcatatggtaagcactctgtaaatattagctgctattattttcatgattgttaataaaattgctgccaatgttgttctttgtctacagcagtgtttcttaacctttttagacataaggtccttctcttataacgaacatttggtaactcctcctttaatattatggaatgaaaatcaaagatctataacctgtatacatataattttgaaaaatgttaatattattctttaatggtaatagaaacaaaatagtagtccagggctacagtgtatgaccactatatcataaatccccaagacctgtctcaggttcataaatttactagaaggaatcacggggtctcagcatatacttgtattagtggctgagggttattataatggcataagtgagaacatatagccaaatcataagggaaaaagacacaggtggcatgtgcaggaatccttgtgcaagcttccttacgctctctcccttcaacaaggggtcacacaaagcacattcttaccccagtaacaaaaagaaagcaacacatgcaatgtttctgtctagggaaggccattagacactcaatgttcagggttttccttgggggctggtcacactctctgcctcatacttaccacaattacagataaaagaaggtattcagtcatattatttgaagtgcttgagagggtatctggtggtctaactgcttcttctacagaatttcagtcatttctcctattttcagctctaccaaaactcaccacttacataagtaatcctgattggtatggctttctgaggtttggtgccacaagacagcttatttactattggtgtcaaaatatttaagttggtttgagatttttctggtacaacaagctattaataatttgcccatttgctttctttctttcttttttcttttttttttttttttgacatggagtctcgctctgtcacccaggctggagtgcagtggcgtgatctcggctcactgcaacctccgcctcccgggttcaagtgattttcctgcctcagcctctcaaatagctgggactacaggtacccgccaccacacccagctggtttttgtatttttagtagagatggggtttcaccatgttggccagtctggtcttgaattcctgacctcacgtgatccacctgccttggcctcccaaagtgctgggattacagatgtgagcctccacagccggcctgtgtatttactttctaatttacaacattctgttaacagctattgtctgccctatagcctcccctactctctatacatgtacattcttcaataagtcaacatgagcatgtttacttgctgaccgtaaggagctagcagattagaagtggatggagatattaagagggaatcaatagggtaaggtcaggccaagtggggtggctaacacctgtaatcccagcactttgggaggccaagacaggtggatcacttgagtccaggagttccataccagcctggacaacatagtgagaccttgtgtctacaaataatacaaaaattagctgggcatggtggcatgtgcctgtggtccagctacttgggagtctgaggtgggaggatcacctgagcctggggaggtcgaggctgcagtgggctgtgattttgccactgcactccagtctcggggctacactctgtctcaaaaaaaaaaaagaataaaaaaataggataaggttctgaggacaatgaagaaagggtctgagatgtggagcacttattgagagatgagcctttgataggaggatggcctcctctttcattgtaacaggaggttaagaggagaggttttagtaaacacaagaaactttgtcaatttgggaaagaaaagagaaggacgtgtttgtatggtggtttctgccttctctatgaagtgtatggtaaggctacctgctgagaggggtgatatggtttggatgtttgttgccacctagatctcatgttgaattgtaatctacaatgttggaggtggggcctcatgggaggtgattggatcatggagatggtttctcatgagtgggttagcatcatcccctcagtgccattcttgtgatagtgagtgagtaagtcctcgcaagatctggttgtttttaaagtgtgtagcaccccctgaccccacccctgtttcttctgctctggccatgtagacacgcctgcttccccttcaccttccaccatgattataagtttcctgaggcctccccagaagcagatgctgccatgctttctgtacagcctgtggaaccctgagccaattaaacctcttttctttataaattacctagtctgaggtagttctttatagcagttcgagagcagactaatacaaggaagtaaagatgtgagggatttcaggtcttgggaaattggaggaagtttgaaataaccgtttcaagggagggaaggagtacattgacctgagaacacagacttgctagaaggtgttaaatgcccaggggagattgttgattgtgagtatatggtgacaccagtcttacctgttgtgtgacttttttagcagcatctagctgcccctgtgcaggacttgtcaatgctgggttcacctcatccaggggtggactaaaaactgttgataaaatcataacaggttgaatgttactgcctatgaagtttaaggtctttccttgctcagcatcattttattttcatgatggtttgttggaggatgggtctcgatatgtctttcagcctcaattgactcatacctactaagactggaaaggcatgctctccagccagctgacctcttgaatatacgatgacaaactattatctgctgcctgtttttgtaaaataaaagttttactgaaacatagccacacccattcttttacttgttgtctatggctgcttttctcctacaatggtagaggtaaataattgtgataaaaactatatggcgggcaaaatctaaagtgtatatgtggccctttacagaaaaagtttgccaacctctggcctctaggcagctgtctgaatcctgaagccactgttacactgtgtgctgtttactgacattttttcccttaggtggtgtcatagtcctgcatttttggcttcttaatctagttccttacttaaatatgattcaagtactttcttttcttccactaaataaattttacatacacacagagagatagagagacatgtatatttcaataagttctgccaatgtgaattaataaataagaagtgttataataataatggacatagaattccaatttcagactcattttttaatcacaaaattctattactgacaaatatgtaggtactcttccgtacaaatttttctgagttacttaatttctcctggcctcacctctttgggaggtaatttagatgaaatggcttaaaaaagttatagtttcacaactattcctcaaagtcctagaatctttttactttgctgactctacttgcttaattatatttgctaatccatttcattagtcaacacttggcaagcccaagtgtactcatctgtctattaccttttcatctactttagtcttaagtaaacaaatgccagttcatgttctcagatactcagatgtaggtttaattgttaatatcttattcattattgtacaagcttttgctgttgaattttaatattaaaataatgataggttagatttgtgctcacaacttattattatgttccattttttcccactcaaccgtacattatgtaccctttcttcaagattactgtacagaatgattcttacatatttcagtgtgacattctttttttattgaggtggaattcatatattaactattttcaagtaaaagttcagtggcatatcatacccttacagtgttgtgcagctgccacctctatctaatgctaaaacttttccctcaccctaaaaggaaactccatttctcttaagcatttgctcctcattcctgtttttctcctactctggtaaccacccgtcttatttctttttttgtaaatttccctgttctggatatctcacccatatctagatgattctgtgtggtgtgtaatatgtgatattttatgttaggcctctttcactgagcataatgtttatgagttttgtccatattgtagcatgttcagtttttcatgctttgtcatagttaataatattcccttgtttatatataccatgttttgtttatccattaatccattgatgaacatttgagctgtttccgccttttagttcttgtgaatagtgctggtatgaacatcaatgtccatgtacttgtttgagtgtctgttttaaattttttttttttggtatataactaggagtagaattacaggatcatatgacaatttcatatttaagttttcgaggaaccatgaaactgtttttcatagcagctgaaccattctacattcccaacagcaatgtatgaggatcccagtttttccatatcctcaccagcacttctaattttctagtgttttgattatagccatccttgtgtgtgtaaagcagtatctatttgtggttttgatttgcatttccctacagattaatgtcaagcatctcttcatgtgcttttggccatttgtatatcttctttgctgatatgttcttgttcatcttatttttccttcacaactggagaagacagggtatatataaatgatactaattatgagaaaaatcatagtcatggaaaatcttgagacttcaggtcagtagcttcatatctaccatggaggttaatttaatgcttgttagctaaaactttggtaaaacttctcataaattggtttgcttcatattcattagagccttccactcaaagatgtgataattgttattttgactatttgcaagggatttggaaaggtcagtgtatgtggtgatttttcatttggttggttgaattatgaaagctgcaggagcaaggagtcatttattggaatgagtcttgcagagtccttaaaatacatatctcagatatggctttgttattcttcataatgacatttctgaatttgggaattctgacaaagtatctgcaggaccacattatggctttcatgggcaataggtacttttgttttgtgggccatgaaaaattttgctacataaaagatattaaaatatctttcagaaatactaaaaatttccatgaaaatattataattctattttctgtctacattgctatagagatgaatattttacaggctgtcttgtattcatattttcttctgattttaaaagaaattaaaacattacagaacctctaacagtatcctgggcccaaggcattatgcttgctttgtgcagtgggatgtgggccctggatatctgaagatatctatcatgattttgtttagccctttgtgatttttattatcattgatgtgtgagttcttaacagttactgtgattacttcctaataataatgtgctctttacggctactttgaaatgtccatttcatataactcagatcataataaacttgccctttttcctcattttcattatgggctcagccgtctcagcttgttcaattttatttgcattttcctcctcatattctgctagttaccatttgagctctcagctgctggaaagcccttcccagagcaggtctttggggataacaggtttcactaaattggtttcagaaggtgaagtttagtgttcatttggtctccactggcagccctgaggagatatgataacacaggctggaaaagaaaaattccaatttcataaagagcattctgtacagtgttggcataaacaaccctgatactagcaaggagaacagactagctttgggatagtatacaagtttattgctaactcttcttttttatggtgttatcatattatcgtatcctttaacatcctttgtggtttttttcttgttccatgttcacttttccaaatctcattgcctgtcatcatcttccttccatcactggcattttttattaatgatctgctttctcctttcccataagccagtcttagtgtcttctagcaatgtcatttaaaatcccacttcctcattcaagccacagtccatagcactaagcctttcttcttcctttctcataactggaaataacagatctctcaggaaaccttcatttcccttactgagagatggtgctcaagtcaaaagcataggagctcacatagaaagcaaattctttagagatccttgattacaggaaaacaggccacaggtcatgttaaaccattaatttttggagctagccatgaagcttaatcaaattgatgttaaaacgattcttttaaggcattgactatccacgcattgattcttaggctctatttcatcatcataacttcctttacatttttatgataacaggaatagcaacattattatcatcattcatagtaacaaatgtttatatagtgtttagtgagtaccaaagtctaagctttttgcatttatgaacttatttaattctcataactcttataaactgggtgctattttttacctcatgtcattgaaatcaaataatttgccctaagtcactcagcaagtaagtggggatttatcatctcctgttcatcttgtaagctgttttctatttcaggaagcttaagaaatctcagttttattctgtgaaggctaattcatattattagcacatcaggaaaacctgttacaaacaaatattcagcagagacatagaaatcaagaactgtgttcctcatatcaagtgtatgatcaaggcaaactgggaactgcttttatatgactctctcccaatcacactgaattctatgattccttatcccatttccttcactaaggttatccttggggttgattcctgccaacttggggatctccttgaatgacatcctttctaattcctactgttagagtagatctagttagggaggacatttatgaagaaagacctctcccacaacaccttgaaaccgttgtagcttacttatcctgagtggacaggcatgggcttggagggtgaaggggtcttgcagttctaacatgttactcatgttctttcagtcatcttcttaaatatactttgtagaactatgaggccttatggagatcttaggagaagtactaatgaacatagaatttctgtttttaatcatacagtattccaattttcagttgccatatgtacatatatgtacacagacttgtgtgtggatgcatgcctgcttgtgaacatgtttgcctttgtgtacacacacagacacacgcctttgtgtacacacacagacacacacaaacacacacacctgcaaagatagtttgaggtaaccataatctttctgtggtaagcatctgaggtctttgtaaagaggagtgtactttccatttatggcatggcaaatacattaatcccaagaactctcaatatcaaggcccttttatggaaagtttcaagaagctttcctaggcccctctgctgacctaattatcggggtaatctgttttatcaccgtcaggtggagccaggatacttttaaatttgggataagggtcagatgtattaatccatatcccagagtatacaaattaactcttggccagctttatataaaataaagtacaaagtcaggttctcagataaggttggtatgttgtttggtctttctttttattctattcctgataaagattcacttgttgtaatccagttatctcactaattaactaatatttatattattaacacaacaaaaggaaaactggtggatatcacaggcctccacaggacaggcaagtgaatgaatcacttaagctggttaaggactgtagtgatctgtagagcatatactctgcctaaagagggcagccatgtcttaaaaatttccacacactagccttactagaatgtggactttatgctgccagagcttctgatttttcaagaaacgtttggaatccagatatttgtatgaaaactaatttttcaatgctagcagttaattctaatttttaaaatacgatgccatataatgaataaactattataggagttgacaatttttttctgtaaagggtcagttagtaaatagtttggactttgaggtctgtatggtctctgtttcaagttctcagttctgcagttgtaatatggaagcagctgtagacaataagctaatgaaaatggtgtgttccagtaatatttacaaaaacaggtaaaggcctattttggcccagtggtggtaagtttgccaacctctgaactaaaataagatgtatcaaacatgtgtaagtatcgaaacataatttgactaaacaaagtgagctgtagaaggattcaaacattttattaccatttggattaaatgtaaaaacctgctaaaaaatgcatttatgggtatgtgcatgtatttgaatgataaagattgaatttatgatagtggttgtctctggagagggaaggatgtgggtccagagaggaattgattacagtatttaatttctttataaaaaggatctgatggaaatacagcatgatattaaaatatgattagtacatgggtgtttgcttccccccacctttttgtctttatatttgaaatactttacgaataaaaaacattagtatgcaaggcaatcaaaacatgtctgcagacttaatttgactcagatgccatcattttgaacaacctctgctgttcatgcgtgcaagcattctaaggatatcagctttgtagaaaatgatgagtctttatgtcaacaagttggaatctactacccatatatttggaggttttcaatgcaataacagtttgtgataggtgatatgaatgataaccaagatgtaagctggttttcatcaacctatatcatttcttttatttctgtttacaaaatcaggcataacttcttgacaatgtacatatattataattactttttaatgaccttgttatctagcattcctcatagtatctttctgttccctctgaggtttctcagagttttatacagtgtcagcttgttcttattagatctaattatttcataatccaatttaccatttctactcatcatcgaagactttcctcagtactgtcctagaaaacctgcaaagcattgtacatttctaataatatgatcttccacaattattgtttttcctgtgccaagatcaaggatggcatacttttctgttgatctcaaactcatttagttacgagtcatgaaatgatccatatattgagctttattgaagggcagaggttttgttttgtttacttctgtatccttagcaccttgaaacagggcttggcacagaatagctactcaataaatttgtgttgagttaataaataaatgaatgccattattcttttcagaggatataattttacatggtttctggtggaatgtggtgttattccaaaggcagctttagacattgcagtggcagaaggaaactttcagaattctgagtttatgatttattaacttggagtttcaccctgtgttccctaagtttttacttcttacattaatataatttgatttctaagttcctgatgttttctttttactttttttcataaacgttaatgtctaaattccaactatggttccttttctcaactgaaacttatttgtgtgactatgcaaaccttctttatacttaatgcttattatctgtgctattgttttttcagtgttgttcttagtccttcactttctatcactgctaccctttatggtacaacatggcctagtcagttgagttaccaaaagattaaaaaggaaatcgtggtcgataatcccagcactcggggaggctaacgtgagaggattgcttgagcccaggagtttgagaccagactgggcaacatggcaaaacccggtctctaccaaaaaaataaaaaaattaaaaaaaataaccaggtgtggtggcattctcctgtacttgggaggctcccagctatttgggaggctgaggtgggaggattgcttaagcacaggaggtcaaggcttcagtgagctgtgatcatgccactgctctccaaactggttgacagaatgagaccccatctcaaaaaaagaaaagaaaagaaaattgtagctcttcctgaacaagtcctgaaatgtctttcccatatgcattgaggatcttcaagataacctcccagtttggtaatttgttaaaaggactcataggactcagcatatattgttactcagggctgtgatttattacagtcaaaggatacaacacaaaattagcaacgggaaaaggcacatagagcgatgttcagaggaaaccagacacaagcttccaggagttctctagtggagtcactcaggatgtacaaaattcctccagtattgcttgtgacagcacatatgaagtgttgtctaccgggggatattattaaattattaattggcacaggtttattgggggctagttatgaaggcaacctctgtccagcacatatgaaaatgctagacccccagaaggaatgcaggtattcagcataaaccacattgtacaggcattctaggcatagtgagtcatgttgtcagttctagtagtcactgtctcctcacttagccccattaacagctgtggatgggcctttgtcatcaccaaggtacccgtttcccaaagatgaagaaatttgatttcattttgttgtctcttggtgtcaaaaacataaaaacatttttcctctcctggacatcttcaactctaatgcctttaccaccaagcatagtttcaaacttctagggagcttctctctgtaactaattggaaaatttcttttctgacctcctaaccctgtatggaggttgttggttttatatttagtaaattattaaacagcaacatgttttttaaaacatttgtactgaggcctgacattgggtagtttctccctgcagtcaggttacttgtcagagatggggcatgactccaaagagaattaatgtatgtttttgttatctgaagtgcccttgggggttccagaatcctcctgaagagcccatgtttctttagcaaaagaggtttttcaagtctgaatccaggatacaggaactcaaatgaaaagcttgttctataggagtcttaaaatagaagataagaggctacaaataatgaaatcaaatttgtagaaactgagaaatttcaatcagatgtaacaaaaagatccttgctggagaatatataccagtagtagtacctaactctcatccaagttttttaagctatgtaatttccatttgaccacttattctttatagattgaatttgatcgtagattataatttaaataaaataaagcatagccacaattcgagtgctgactgcaacctatcctagcaaacctttcacacacataccatgtctgagatattctcaatattgttgcaaataatccctaatcacctgtgtcaacatcccagaggttaagtcaaacaaaagcagagaatagggaaatgtataacataatagattttatttgaggagtcctatttagagtgattgccagatccatatttttcacataatttcattccttaataactggtacttcgtcacaaattatcaagcagacgttgataagttatctgaagatttgatttcataagcttccacaataatgatgctgtttactaacagaatatccatcctatcccaacataaagcccgctgggaaaaaagtcattctttttaactagtaattacatgcttgtccctatctcactatacagtaatattttatttttagtctgtctccactacactgtatgttctttaagactttgaattattctttgtcttttacatttatataacacctatgtgagcatgctcgtaattttccagggtcatacagactgaaatattgctgcttttgtcctttgttaattccatctaaaacatggactaggcactcttaggtttcagtcatctgagtagatgtttaatcaacattcgagaaactatgtgggagaattaacggcaggtgatgatggtgggacttgaagcctgtttgccaggggccccggttgtgaacatcattttcagtactgtccagacacaggggcaactccctgtcatttgtgactctttccgtcttggctcttgcctctcttctttctttctttctttctttctttctttctttctttctttctttctttctttctttaattaacatcaccatcttttctgctattaaactgtcaccatcttgatcttctctccctcttttggcctttactttcccggccagagtgtacttctggtttcttttggagcatccaatctccataaatctcagcctttgacctctctgtctctctgtttctctctctttcactttctctctcttttgaaatagaatttacattttattaaaaccaaacaatccttgcaactctaaaaattgtatttttatggcaccttatgacttcattgttatttatcaaacttcaggtaatagctgattcaaaaagacttgaactataacttaaatattttgtgatttatgaaacttcttaaaacaacttaaagtttatatcttgtggccaaggtactatagacctagttgggaagggcctgcctaagtgaacataaacatcacatttcattgattctaagatacacttttccacattttaacatctcttaaattgggattcatcttatacttcatagtatctcacagtataattggtgaatctttttccttagtattataaaaatgataatgatgggacttataattaaaggcaacttagatttttactttttacttaagtagctgaggcttaagaaagtttacaaagtctgactggtaaccttcacacacagaagttttgtttgcatgtagtccttctcttctttcctgcccttgagatgggatttgttcccttgacctttaccccctttgtgggcaggaactggagtggctcatttcacccagcctgcagtctgtggatggccaagtgttaacagcccagtaaagggtcagagtgacaggctcctgcacctgccctttttgacactcaagttcttgtttggtgtccaggaagaatcaggtcacacaaaccatttgaagggtagtgtatgcagaggatttattgggcgataaaagtggctttcagcaggatggggaattggaaaggggatggtgtgggaagaaggtgatctttccctgaagcctcattgtctgaagttagctgcatctatcagtagtcttcgatgctcagccacatgtatccctgaggctcagcagcttgcatccccaaccacttgcatcagctgcttgtgttgctcttttttttttccctgccagctgatctagtttttatgggcactggatagggggcggggtaggacaaaaaggcaattatttgggtggaaaaatggggtcagctgttttcacttagggccaaggttccaggcttgagggtgaggtttagccgggagcccagcccttcaggggtcagctgttttcacttatggccaaggttccaggcttgagggtggggtttagccaggagcccagccattctgtatcaccctcaccaggttgcttcatgctgacctgcaagtggttctgcttatgctggcctctcatgagtctttcagttaaatctttattggatatgtactgtgtgctaagaattgtggtaactactggagagaaagatgagcaaaatcgtacatggtctttgcttttctgattatagactcttctaaaatagtgttaaccattagcattataaaatggcccaatcataggccagatcattctgttgttcctgtggtgtctagatttcttaatgtttccatgttacataaggaaggagccattctgggtgatcatttaggactctgtatccagtgaccctgtatgggtagagtaacagtttgggttgactacttgaaggtggtttacctccttcatgccttcatcatttacttctcagaggttttcttcatactgcctgtatccaatacgttgcatctgtttttgtcaaacttttcaatgaattatgtatagcaagtctaaatggagttgccttagggtttagtttccctctttactcagtgattatttgatacagctccagggaagattccactgggaatgtgtgtcagctggcacttgctcaagcctacagtgaagctgttatttcatttcttatgtttagttattcttaagaggttggtgtctgggttagagttttcttagtcccctacctgttttcttagcattcgctgctggaatctataaccaactccccaatggactgcaggtagccaacatgcactctcttggtagggccttgcccgcattgaactttgcatttgtttagtaaatttaattaattttgtatagattataaatgtacttagcacaaaatttaaaaagtacaaaaggtaaacaataaaaagaaagtctactttttacacctggctcccagccaccccattgccatcccaggaagcaaccatagttaccagtttctctagctccagtattttttaaaaataactttttattatgtaaaatcaaaaatgtatatggaagaggataatataaagaacctcctggtatccatcatgttgctccaacaattatcaaaaaataaccaatcttgtttaactctactcccacccactttcttggattattttgaagtggatttcatactaaaatcatatgatgtttcagacatcataactaaaagatagtgcctcttttaaaaaacatatagccataataccattttcacactaaaaagcaaaaataattccttaatatcattgcatttaaaatttttcaatgatgtattttcttttcttttacagtttggttgtttgaatcaggatccaaacaaggtccacacattgcattttgttaagtctcgagcctcttttaatctatagctcccctcacttttttttcatttatttgtggaaataactgagttgtttattctgtagaattattccgcgttcttctgattctgttaccaaatatagtctggtgactgttttttctatacattggtattttgatctagacgcttaatcagttgtaggtttaattttttggcaaaaatactttagaggtggtattcagttttaattttacagattaagccaggtaagttcctggttatttttcatttgtttgttttgttttgtttacaacatggtttttaagtacacgggctctatagtcagactatctgggtttgtattccagctccacaacttagtagctgtatgaccttgggcaagtcctatcaaactcactgcatttctccttatttgtagattgtggatcatagtagcatgtaattcatagtactgttgtgaggaataaccaaatccaatgtgtgtagagcattttgaacagtgtctgtctttgagtaggtattcagtgtacattaactattgtggtactatatttttatttctccattgtcttgtacggtatagccagggctgctgtattgttctacgccagggttcactgtttatcttgtaggcttttgaatgatactttttatggtgctgtacaatgagtagtccgtgtggccatatgtagcagcccatatagtcatacaatacatgaacttgtgttgttcagctcttttatgtttttcatagcactactattttataaacaggatttagtgtctatctggatttcttattcgcaaactcatatatcacattgcctttttgtttctgtacccctcttccttgaaatatacatgtgtttgtgcccatagatacacaccacatgcattttcaaagtcaaagctaaatagtattcctcttacaacctctcttccaactgagtgatgtgaagattatgtagtttatgctggtttccacttaacacatctatggagagttgaggctatcagccagctaccaacaaaaaggaagtgaatcgattagcagcatgcctggggactgtgtagacatgcccacaaacctcatgttgttatatgatctgtccttgggatctggccaaggttcttggtattttaatcaatatgagatagatatttccagaattaggaccccatggggtgacccatgataatctggacatcatttttgtcaagtttaatagtttctctgtgaaaaaaaataatattgtgtgtgtgtctcctccttagatctgacatagaaggcattcatggaaaagtatacctttctatgctgcacttgagaggtggtaggcctgtgcacaggggagaagagattaggtcattaataaaatggtactcatatcctttctaatttaataagtcaatataacttctacagatgtgacactagggaattaaataatacagaatcccgatttttaaagttttctaatgcacaactatttcactcatatgtacacatatacatacatacatgcccaactagccaaacaatatataattatagtaatcctttacaagatgtccgttctagtcttaatcaaaccagtagcaggtttagctcatggagtagtttagatggaatgtgcttaggaaggtctgacttcaaagagcctttagtcagagcccaagcaactttctcagctctctctgatgatttcatttttctcttggctaatatattttatccatcaatgtcaggttgggccagaaatacttgatttcgagatagaagtcattgttttttcaggttttcagaaaaataattacatttattattgtgtattatatatggggatagagacaggtacacatttgttaatctgtatcttccaaggtccccatattgttgactagagttggcagatgggtcacaagcccaacacgtctttacccaggctttttcaggtaaagaaatgcaagttcagattgctctttatatatgtgtttccaaagcagacatataaaatgctcctcataaatcaaccccttgtatttcctttcctatgatttaactcatgtttttgttgatacaggcacatttaatattataaccattcattgtataaaagattgctgttatgttttgctgatacagtgtaaattggcagagttggtcctggcaaatgcagaagtcactgtaacatcttggcccatcctgcctcatattgtatcagtcttcccatatgcacttcctcatattcataatacatatagtattcaagaactttatgtacagcaaaaatatttttacacatatttacttgtccatctaatttcttattcaaaatactataaccaacaaattcgtcactgtggtttaatcacaacacagaaacataccactgatactatatgccatggtttataataagcactttgtaaatttttgcttatttaaacctcacatcatgtttatgagttaggtgttattattattccattttacagatgaagaaagtaatgcacaaaatttaagtaaatttcagaaagtagaccctgaatttgaatttagatattttgacactaggccaagcgcggtggctcacgcctgtaatcccagcactttgggaggctgaggcgggcggatcacgaggtcaggagatcgagaccatcctggctaacacagtgaaaccccgtctctactaaaaatacaaaaaattagccaggcgtggtggtgggcacctgtagtcccagctactcgggaggctgaggcaggagaatggcatgaacttgggaggcggagcttgcagtgagccgagatcacgccactgcactccagcctgggtgacagtgcgagactccatctcaaaaacaaaaaaaaaaaaaaaaaaaaaaaagaaaagatattttgatactagtatctgtgctcttaaacactgccatttttactactaaaattgtgacttgttacacttgcctttgtttctttgttatacacacacacacacatatatttaataactttatatttaataatatttaatttgattaaaatttgaattaccatatgtagccagtagtggccctattggacagcacagattccagcacaacacgtaacttagggatgacactcaatacatatttgcttaaggaaggaatgactctcagatttatttttccagctcagatctttcccttgaccttcagacttatgtatgtaatttcttatttggcaccttcactgaatttctattagacattttcaaaccatctattagacagttccaaagacatttccaaatagttcatgtccaaaatgaactattgatctttctctccaagcatactccatccataagcttctccatttcagtttcttctactctctcagactaaaaacttttgtcatgtatgatttttgacagctaatctaccaacaaattctgtagggtcttatttcaaattatatacataatctgaccacttctagtcatctccaccagttttactaaaatttaagccacagccatttttgttccatgttattgaaatagaccttttatatgtctcttttctctgctgtcccagttacgctcttactgttgtctacacagcagctagactgttcttctgtattcaggccaagtcagagcagaccattcctctgtttaaaactcaccagtggtttctcatttcattcaaagtaaaagcaaaggtccttccaataacccaaaaggcctatataatagctcccgctcccctgtccaataccctattctctctcttggtctcatcatttttaatactctcccttctttattccactttactttcactggcttccttattgtttatttttttaagaaggcaaggtaaacaaatagcttaagtatttttatttgtttgcaactaagcttgttaacactatataatgaaaatgtgcaaagaataatgttgcagttttcggttagatttaagtcaaagatattcattaataaggaatcttcgaacgtgaatattccagaaatttctctaagccatctgatcagaacaactgtctctgagtattaccttactttgtaaggtattggcatgcatttgaattaaactcagattttttcaaaataagtcctgattaaaaaaactattctatattcaaactaaaagaatataaatagaacttttcctttccagaaacaataaaggaaacaaggcattttgtaaaatatggtcctgagcaagttgcagtaaaaaaataaatgtatacttctacctgctcaaaacagaggctactttcttttcctcagtcttggaaacaaggtgaagaacagcctaaatgtgacttcgggcaggcggttgccaaaacagctcaagcagttgaccatggacacctcaaatgaatttgggagaacctcaccaaaggatccaaattctatttttaataactgatacaaaggtgaagtggctcttcccaagtagcagtgctgccagggcctggccctggcccaggcccaggcccagctctgagcttacctgctatgctcccaagcaaaccatgatccttctgctccagggcagaccttttccctttagaggttcagtgtccagggagctctatgattgtgtgaatgaggtgagcgccgactccatgtgagtattttaaggcttggagtcaaagtatttttctaacacgcttaggcagagtccatgtgtcaatggcccatctccagtttgttctaatttctcaccacacatttgtagatatttctcaccacacatttgtagatctaggaccacagacctttgctgtattatcataatcacagctaatgtccatcctaacttatgattcatattctatgcctggaaacagtccctgtatttaacaataaaacctacacataaaaacaatccactgttgcaacttatatggtcacaaaacgtaaatgatcttctgtagaacaagcaattttttttttgttttttgtttttatttatttatttattctttgagacagagtctcactctgtcacccaggctggagtacaatggcgcgatcttggctcactgcaacctctgcctccctggttcaagtgattctcctgcctcagcctcctgagtagctggaactacaggtgcctgccaccatgcccagccaatttttgtatttttagtagagacgggatttcaccatattggctaggctggtctcaaacttctgacctcaggtgatccaagcacgtccgcctctcaaagtgctgggattacaagcgtgagccacagcgcccggccaagcaaatgtttttaaccataattgtcatgaatcaagctcagccagaatccccaagatcaaaaaaaaattgcactatacaaataataacttgaaatatacatacacacgctctcatacacacttcttacagaactgtgcttggggaagctccatttgttgagtgccactgaaggcatattttgctaaactgcttctccaagtattttgttttggaaaatctatcacagtagggcacagctgtttactggatgagcagaaaaagggagatatgcttgtggcaaccaaaaagttttaaggtctttcaagttgtataaaatggacctacagaaacgtttaagtgttctcaggatgcaaaattgaagctgaaatgtgttgtcaaaccagttgcaaaaagtgtacagcaggcatctcttgaggttaaacctggtacccagatacataacaaagcttcaggacacatggcttgttggccttgtcccataccgttgcataatctgatcatgtgtgaatttcacaaaagattcattcatattgttctgctagtttggtattgaggatttgctcatactcctcctgaatcttgtcttcatagtctaagacacactcacgtattattccgatttgtcagagggtaaatgtgggctggtccttcttcatccatgaggaacctggagagctaggtgctatgagtgctgaggagtgaggttgactttctgaagcacaagcttcactctgattaagaacaatttctaaatgtctccacctctgataacgactgtattctagttttatgttctgaaaaattttctccggaattgtaaggcgccgcttgctgccgagtggggcggactgctgcagagttggcggtagggtctgcgtctgaagcggcggcggcttggcgtccgggggcctgaggcccggagtggggctgggcagaggggtgcagcacggctgcttcggggaagcagggactcagcagctttgtaccgaagtccatgggccgcttcagcgtcgcctggttcgccaggtcgctgacgggccagggaccgggagcggactcgggtaagtgcggcccaagctccggctcctcagtggggctcgccagccaagccctattgtttctttttctttttttctttttttttttttttttgacacttagtatctcaacattttattattatttttttttaattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggtttgttgttcttgcgatagtttactgacaatgatggtttccaatttcatccatgtccctgcaaaggacatgaactcatcattttttatggctgcatagtattccatggtgtatatgtgccacattttcttaatccagtctatcattgttggacatttgggttggttccaagtctttgctgttgtgaataatgccgcaataaacatacgtgtgcatgtgtctttatagcagcatgatttatagtcatttgggtatatacccagtaatgggatggctgggtcaaatggtatttctagttctagatcacgtatttcaaaataataagagctatctatgacaaacccacagccaatatcagactgaatgggcaaaaactgaattttcctctaatcgcctcattaaatgtatcccacagattttgatatgtagtgttttcatgatcatgttttaaagacattctgtgattttaatttgtatttctttctttaaagaattatttaagagaaagcttataattttccatgcggaatggacttaaaaagtgatttctagctttatcgtagtattattattagacaatgtttataacatgtcaactttatggaacttactgatgttttctttgtaacctaatatatgatcactttttgtgagtatttcatgtgcaactgagaagtatagtctctattaccgggacataaaatatgatatatatctgtaagattgttatttaagtcttctacatctttacttactgtttatccacttgatttgttgtttaatgaaaatgatgtgttaaagtttctttttagtgtgcttttatatacatcgcctgtatttttgctttataaaggtggtgtctgtattactttatgcacagatattcataattgccatatctttatttggagaatggcttttagcatttaaagtgttctttgtggctgggcacagtggcttatgcctgtaatcccggcactttgggaggccgaggtgggcggatcacttgaggccaggagttcaagaatagcctggcctacatggtgaaaccccgtctccactaaaaatacaaaaattagtggggtgtggtgggcacctgtagtcccagctactcgggaggctgaggcacgagaatcgcttgaacctgggaggcggaggttgcagtgagccgagattgcaccactgcactccagcctaggccacagagcaaaacgccctctcaataaataaataaataaataaataaataaataaataaataaataaaagtgttctttgtttaatttaatgctttttggcttgaaatctattttgtctgatattgattccatttgcctggtagacttttgaccattcctaaattttcctcttttgcttcacattcctttaaactcccagacttcacagggtatctctcccttattttttgccatcttctctcttacaaatgatacctttcaaagtctgccttttgacaactgcatagaaagctcttccccaaggctcgaatctaccagtttgtcattatttttacgctttgtgtggactttgtctttctggttgtgatttagattactcttaggctactagccccttcttttctcattaactctcctgtttcagcattgtccttgctccctggaaagacttgaagagggaatatgagtgatatcttgctgagatttctttttttttctacttacaatttaatagttaagtcttttattatgtgggtgttttctttctttttgttatgtgaagggcatggctttatgtacttttatgttgttctggtggctctatattgttttgtggaggatatgtttggaaattttgatttacatagtcaccattgtcttaacataatattttccatatggttaaaaatactttgtaaatattttaatggctatatactatgatacaaaaatataccaaatttttccaataatttccctctttagtatgttagttttttccttttatgtgatgacgtatttgtgcataagttaattccactacatactttgggtagatttgccaaaatataatttttgcctcaaggttataaatattattaataatcttgacatagtttgaatacagggagaatcaattggcatatggatttatattaagctgctaactagggtagcctccatccttttttcaggtagcaccttcctcttttacatatatatcatgagcctggcctgaaatagctagtaggtaccagtgtggctgtttctggtgtttacagccagcatctctgttgagtgatagaactttgtgccaatattagttattaagtatttggagatcttccacctccacagattataacatttgttattctgtggttggattttctttacttaggacacacacttgtgttatattcagcaataacaaaagaaccaatggcctttctttcagctgtcctttagtctggcatccctggattttataattgaagaagaggggtgatatttaagagcccaaaatacaactggcaagaccttaacttggagaaactaatcaatcctcacattagtcattactgcttttgtggcttatgtcagagcatgatgggcttatttctgctcacgctttctgttagtcacttgtttttcctctcacttgatctgttttatcaacttcagttaatcaaagctgggcttcctattcatgcaactagatttttctcagtaatattatattatctaccatttcctgaattaattgagacactctgacatgatctgtgtactttaggtaagccattgtaactttctatagttgttttgtttggtttgcctctgaatgtaaaaatagcattgtgtgagaacacatttgagagtggtggttagggtctttaccaatatattttctatgattatttttactttcaatcttattattcatcacattacatggtagatggcttagcaatatttagacagtaattccacaaaccactttcatcctagaatcacctttgagacattattatttttttaaatgcaaactgccaggcctcatcatggacccaatgaattaatctcttgcattgggatccagagatctgcattttaaacatctgcccaagtgactctcatgcagtttggtacctgactgtagacttatttttgagatgcaaagtttaatgcataccctaccaaatcatgaccccagtgcacctcttaagtggtcatctctgtgctagtttttagagcttgtcacccttgctgtatatacatggcatgctccagggtgcatttaaagcgttattttctacatatgtttagaagtcattccttaacccaataacctattaaaatccacttatgttttatttgtattatttagtggttttattttacattttatctcctccatgcacttgaaattgaatatgttgtttggttgtgaaatagagatctaacttatttttttcccaaatagttaattgtccatgttccattttttgaacaattctgctttttttccaccaatttaaaatgccgcttttattgtacattaagttcttacatttatacgatggtcttatcgtgagctttcattttttccactgacctaactattcttatactactatgaccatgccacataatcattttccttttgagtagcacaaaccttccataattattctgtttaaaaaatgtttcactcattttgctagtttattattccatgtaaactttagaattattttatcacattccagaaaattagcttgttggcattttgattacaattatactaaatctattaattaattggaatgaagttgacaacatgcaatatttagtctttctatccaggatcacaaaattttgtttttcatttacggaagtctttttgtgtgtgtaatacttttatttatattaattctgagacttaaataaatcactctcctctctctctctcccacacacatacagtgcaactgtttttttctattacaattttgaagtgtctgttactaatatataggatgcttatgatttttatatcttcattcactgaccaggaattttaacaggcttccttgttaatgttaaaaacattatcaataggtctaagcatggtggctcatgcttgtattcccagcactttgtgaagccaatgcgagaggatcgcctgagcccaggagttctagaccagcctgggcaacataatgagaccccatctctacaaaaattaaaaatacaaaaattgctgggcatggtggtgcgggcctatagtcctatctactcgggaggcagaggagggaagagcccttgagcccaggagtttgaggctgaagtgagccatgaccacaccattacactgcagcctgagtgacagagtgagaccctttctggaaaaaaaaaaaaagtatcagtaatttctcttgcatttttcagttagacagttatatgataggtaaataatgattattctatctcctttccaataggtttaacttttctgtttttgtttctttttaaaattacattgagaacccagttcctcaccacctttgctgttcattaaactcggtgaagagttttttaaaaagtatcaggactcacctgaatcagagattctggtttacctgatgtagggggaatgtgggtattgtcatttttaaaagcttctcagatgtttctagaagctgtgtttgagaatcattgttctagacactctgaccaaatgataagtagtactagtgatagcagacatccttttctggcttctgatcataagcttctagtattgcaccattaatggtgatatgagctgatcatttgagattgactcagtggtgtgttggaggcagctggtacctgctcaaaaggtgtaactgtacacatattttcccaacttcacattcattgacattatgttgatcacttcaaatcagccatggttgattcacatggaaattgacaaatgctaaaatcagcgctccccaccttctctgtcaacctgttcattatttgccagcacatcacagtagatctttattagcttaaagaagtattcttttttaaaaaaaagaaaaaaataagaagtattcttttattattaggctatgaataatttttgtccttcattatcatttgcatttcattgcaaccaccttttaatcacattgtcaccttatatcagccacgttctaaaaccttgtgtttctcactgtaaatgcttttttccagagggattcctgtattctgattcttcagagagttttccttctattaaactacattgacttttcctaaacctaataactctttttatggaggaaactttttttcttcttcatcttccctcctcctacccttcctgtcctctgatactcaccagtctactctctatcttcatgagatctacagacctaagaacctttttagtttgttcttttggttggtttatagacaagcaagagtcaaatttgagtttgtaagatatcagtgtgagttcttgcataaaaattccagatacaaatgagtaaaaaagtttaaaattcttctaataatcactgctgtggtgagccacggattcagaaggtagggtgtttgggtggaaaagagtggttcacagtgaccaacctagaggaaaagatggactgcatgttcttcaggcaatcctctatgaatactgtcttgtcacaaagatgtatgtaagaattacagactatggccgggcacagtggctcatgcctgtaatcccagcactttgggaggccaaggctggtggatcccttgaggtcaggagttcaagaccattctggccaatatggtgaaaccctgcctctactaaaaatacaaaaattagccaggtgtggtggcacgcacctgtaatcccagctactcaggaggctgaggcacgagaatcgcttgaacctggtaggcagaggttgcagtgagccgagattgcgccactgcactccagcctgggcaacagagtgagactctgtctcaaaaaaaaaaaattgaattgcagactataaatctggaattgccattctctgagaagtaattataatgtacaaatcaccatctagtcagataaatgtagaccaatatgctatacaatcaagctgaaattggagttgacagtgtcttgtgaatattagggatcctaaacagacacatggctaaattggtgtttattttcactgagaatggaacaggccttgggcagggccatgctttttctatacccagatttttgagggtttttatcctgaagggatattgaattttgtcaaatgctttttcagtaacaattgaaattatagtatggtttttgtccttcgttttattggtatgatgtactgtattgatttatttgtgtatgttgaaccatccttgcatccctgagataaatcccacttggtcatgatgaaggatttttaaaatttgttgaatttggcttgctagtattttgttgagggtatatatgtgtgtgtgtgtgtgtgtatgtatatatatatatatatatatatatattgatcagcggttatggccaatagctttttgtttgtttgttagtttgtttttttgatgtgttttggtctggttttggtatcagggtaatattggccctcgtagagtgagtttggaagtactccctcccccctctattttttcagaatagtttgaataggtttagtattagctcttctttaaatgtttggtagaattcagcagtaaagctattgggtcccagacttttctttgctgttagactttttattatgcctttgatcttgttccttgttattggtcggttcaggttttggatttattcctggttcaatcttggtaggttgtgtgtgtctaggaatttatcaatttcttctagttttccaatttattggcatatagttcctcatagtagccactaattaccctttgaatttctgcagtatcagttgtaatgtctcctttctcatctctgattttatttattgggatattctctctttttatcttaatctggctaaaggtttgtcaattttatgtatcttttcagaaaaccaactttttgttttattgatctttttgtattattatcatgtcaaattcattttatttctgctctgatcttaattatttcttctactaattttggatttggtttgctcttgcttttctagttctttaagatacatcattaggttatttatttgaagtttttctttttgatgtaggcattatagctataaccttccatcttagtactgcttttactgtatcccatacgttttagtatattacatttccattatcatttgctttaagaaaatgttcagttttcttcttaattttaccattggcccactgatcattcaggaggatattaatttccatgtgtttgtatagttttcaaaattcctcttcttattgatttctagcttttttttccattgtggtcagagaagatacttgatattatttcagtttttttgaatgttttaagacttgctttatgggtgggtgcagttgctcacgcctgtaatcctagcactttgggaggccgaagtgggcagatcgcttgagtccaggagttcaagaccagcctgggtaacatagtgaaaccctgtctctactaaaagtacaaaaagttatccaggtgtggtggcacacgcttgtagttccagctactagtgggggctgagatgggagggctgcttgaacctatgaggctgagactgcagtgagccactgcattccagcctgggtggtggagtgagaccttgtctcaaaaaaaaaagacttgttttgtgacctaacatatggtctgtccttgagaatgatccatgtgctgaggtgaagaatgtgtattctgtagccattggatgaaatgttctgtaaatatctactagatccatttggtccatagtgcagattaagtcgaatgcttctttgttgattttctgtctgggagatctgtttaatgctgaaagtaggggtgttgaagtgtttagctattatcctattgaaatctacctctccttttagctctaataatatttatatgtttgggtgctccagcattgggtgtattatatttaaaattgttatttcctcttgctaaattgacccctttatcgttatggggtcataatgatcttctgaagatttaaagtagtgaagggaaaaaaaaaacttttattctagaatagtatgtctagtggaaatgtccttcaaacatgaaagagaaataaagactttcctgacaaacaaaagctgagggatttcatcaatacgagatctgtcctacaagacagatgatcttctttgtctcttacagtttttgtcttgaagtctattttttctaatataggtatagctactctgttcttttttggtttccattggcatggagtatcttttttccacccttttattttcagtctatgtgtgtctttacaggataaatgtgttttttgtaggcaagagtcatttgatctatttttttttatccattcagctactgtatgtcttttgattagagagttttgtctatttatattcaatgttattattgataagtaatgatttactccgtcccattttattatttgttttctgattgttttgtggtcttgtcttccttcttttcttcctgtctttttagtgaagtagattttctctagtggtatgattttaatttcttcctttttattttttgtgtatccattgtatcttttttgatttgaggttattaagaggtttgcaaattctctcttataacccattattgtaaactgatgacaacttataactgatagcataaacaaacaaacaaggaaaaaaggaaactaataaaaactttacaccataattttttctgcccacttttcagttttttgttgtttccatttatgtcttgttgtactctctatgtctttaaagttgttggagttattatttttgattgattcattgtttagtctttctacttaagagtggtttacacattacagttacggtgttataatattctgtgtttttctgtgtacttactattaccagtgagttttatatcttcagatgatttcttagtgctcattactgttcttctctttctgaatgaagtactctctttagcgtctcttgtaagatagatctgctattgatgaaatctctcagcttttgtttgtcttggaaagtctttatttttccttcatgtttgaaggacattttcaccagatatactattctagggtaagagtttttcttcttcagcactttatgtcatgccactctctcttggcctgtaaggtttccactgaaaagtctgctgtcagacatattcgagctcctttttatgttacttgtctcttttccccttgctgcttttaggatcctttttttatccttgatcttgaggaatctgattattaaatgcctttagatattcttgtttgggttaaatgtctctggtgttctataaccgtcttgtacttcaaagttgatatcgctgatactatcccactgaataagcttgctacccctgtctctttctctacctcctctttaaggccagtaactcttatatatgcccttttgagactattttatagatcctgtagtcatgcttcgttgtttttcattcttttctcttttgtctcctctaaatgtgtattttcgaatagcctgtcttcaagctcatcaattcttctgcttgatcaattatgttattataagactctgatgcattcttctgcatgtcacttacattttttaactccagaatttctgcttgatttttaaaattatttcaatgtctttgttaaatgtatgtgatagaattctgaattccttttctatattatattgaatttatttgagttttctcaaaatagctattttgatttctctgtcttatatgtcacatacctctgtttctccaagattagtctctgatgccttatttagttcattttggaaggtcatattttcttgaatggtcctgatgcttgtgaatgttcatctgtttctgggcatctaagagttaagtagtgtagtctttttagtctgggcttgtttgtacttgtccttcttgggaaggctttccagatatttgaaaggacttgagtgttttcatccaatccatatctgcattagagagcatcccatacccagtaattctgtggttcttgcagatttgtagcggtaccaccttgatggtgttgaataagatctggaagacttctctggattactaggcagagactcttgttttctttccttactttctccttttacttttaaagtccacttttacttttccctctacttttctgaagcagaaggagtctctccccacagctaccacagctgggaacgtgttgagtcatacctgaagcccacaaagtttcgtctaaggcccaatgagtactatctgggttttgcttctggttatttagggtccaaaggttctttagtcagcatgtgatgggtcctgccaggactgggttcttccattcaaggcagtgggttcccttttggccccaggtgtgtgtagaaatgtctgggagctagagtctggaaaaggggccttaggactctgatgagtgctctaggctactgtggctgagctaatatacaagatgcaagacaaagtcctctttactcttgccccctcttttcctcaagcagaaggaaggggtatcttttggagccttgagctgtgctgtgtggggtggtgcaaggactcccatagccaccatggctggtgtctcagtaggttgcatgcctcccaaattcactggctctgagcccagttcaacactaggactaatataagagttgcagtccttgtggcttagagtgcccttcaagtttatttagggatccagagcactttagcctgcagtgtcaaggcttagaactaggatgtgtgattcccctctagctagggctggtttaaatgctccctgtgtgggttgtccttagctgagttcagcctgattttgctttcttccatgtgacagggtagcacggagttcaatgcagtgtctcacaattgctgcactctctctttctgaagtgcacacattccagtgtctctttttttggagaaatgtttgctcatattttcttacccattttttacttgggttatttgttttcttgttatttagttgtttgagttacttctatattttggatatcagccccttatcagatttatggtttgccaatgtttttacccaatccgtgggttgtcccctcactgtgttaattgtttccatttctttgcagaagctttttagtttggtgcaattccatttgtctacgttagcatttgttgcttgtgtctttagagtctgatccaagaaatcattgcccagacaaatgtcatggagcttttcacctatgttttcttctagtagttttatggtttctggtcttacatttaagtctttattcattttgtgttgatttttgtatacagtgtaagatagagtccaatttccttccgtatgaggatatccagtttttccagcaccatttactgaatagagtatcctttccctgttgagtgttcttgacacctttgtcaaaaaatcaattaactctaagtacttgggtttacgtctggactttctgttctgtactattggttgattggtctgtttttatgccagtaccatgctgtttatatgtgattataataacttcataatatattttgaagtcagagaatgtgataccttcatgttttttccttttgctaaagattgctttgactattcagggtcttttgtcatttcatatgaattttatgattatcttctatttctgtgaaaaatgacattggaattttgataggaattgcattgaacccagagaaagctttgggaagtatggacattttaacaagattagttctcctaatccatgaacatggactattttttcatttatttgtgtcttcagtttgttttatcagtgttttatagtttttagtatagcagttattcacttccttgactaaatttattcctaagttttttctttatttaatactattgtaaatgggattgtttttgaaatttttttcaaatagttcattgttagtctgtagaaatgcgactgatagaggctaaacattactctgatgttcttgtttttgcctcctctgttatttttggtttggcctaaagacttaaatatcatctgagaagcacagttcttttagtcatatttccgtggttacatatgagcccagttgatacggtggtaaggtgtcatgggtggggaggtcttctataagattatgtctctgtcttttagtgagctgtgcccctggcctgtgacttacttaagttcttctcaggaattttttttccccctcttgggagagatgggaaggcaaattgggtctggaattcggtatttcccttcacctcgttcgcttaggttctgataaaactccaggaggttttgatctggtaaaaatagtttctcttgagggaagaccttgttaagaagaagagaagggtctgtgaatatttttaaatgactacttatctttcccccctgctggaagcatgaggggatttttcaccatcaaaacttgataggactcttgtaggtaaaactcacaaaagtttgggagccccttttggactgggccctattggagtttttacctctcaaatccgagcatattaagcctccagcaatttgtaaattacagattaggttatcctatcccagtgctggttcgcaaggagttttctactcctggccttctgttactgtaagatttggttctctctatctatctcctcacttctggggacagccatttaccctatgaccccagttatctgatgaatctaagaagagttgattttgtttgttcagttttttcttgttgtgtgaattggatagattactttcttatttcttatatggcagaccagaatgcagtcatgtttttgaaatatcaaagatttgcttcttctaaagttttgatctcttaaaaactacttagggtaatatactttgtttttcttttaaaagagggaaaatgtaagatttttttgatgattaacttttgttttttgtttacttttctcaaatagatcctaaatgcccaggagatgttgattttcataatagtgactgggacattaagacaatcaccagctccttgaaattctacctcaggtatgcctgatttgaattgggagtttgcttttcatagctggtgaaatttctctgggtgttgagcggagttaacgtggtctcagttccaggagtttggatagaattgcttaagaaaaaacatgtgaagaggatttctggccaagaatgtgcaaagactgttttttaaatctgagagtttaagcaagagaagcataaaaataatagaattgttactgaaaaaaggctaaaaagattatgttcaaaaaacatgcacttgaaataattgaatacgttttgctcttcacagatagagtgatgttgtgatggattcactagtagaatcaggagctgggactattcagggtggctaacatgttttagaggataataaccattttgaaatgtcaaattgcatttgggcaaaaatggtatatgtgtgtgatgtgctacatatcatgtcttaatccaggtaatggaaataaaaaccaagaaaatacaactgtaataatattggagctaaatgaactgtcagcagtatggaaaaaagttagctcaccaacaaaatttgggaatgtgcaatattaatgaatatattgttcagtttattggcataaatttatattatgcaaaaggtgcttaagacatatatattttttaaacacattgatttcttaccactctttatgtctcatagtatgtatcatactttatgtgcaaaagcctcttcttttcaatgattgtgttcttgagccattaagattgatacataagttctgggaaatctcattaatctaaaatagattgggtttcagatattactgttaaatattttgctactgtagcatcatcttagagctttccataaacttgaatgttctttccaggaatatttctcctgcatctgctgataaagaaaagaactgttattggagggtttattctgtactaggctacggctagttgtttacactgatagtgtcattgtttttttctcccattaaccgagtgtactaggtggtacttgactcgttttgcagatgaggaaaccaaggtgcaccactttctccattaagtaatagccatggtcccagcttgtattttttaaatctcagtgtctctgacttataaggcccctggtactggggcatcttcttctcctgccccctactcccaggagctttggccttctttggatggcttggtaatttagtaaagacagagagcaatctgttacaaatactttaagaagacttgttgtgatgagaatagtgggaataagtgattctgtatctctagcttccttcaaaggagtctcaacattttcttagatttgtaaggccttccccacattgcattattcccagctcatcctataataggcagggtggcccttttcaaagatgagagggtcaagcctgaaagtgcgagtgggcggcacccccagtaagtgatatttgttctcgagactctcatccatggttctgtaatatataccagccagtaaataccctatagaattctcaaagatagctgtgttccaggacaggtctccacactctgttctaggtaactaaatcaccccttatctctaacctttccagagaagtcctctaaaaatcatcccttctctctcccctatttttatcctctctcattcaactggctctttttccgagtatgtaattatgctccagccacatacatctttaaatcagtaaatgattcagtaaaaatatcttgactgcttattctatgcccagtgtgatgttaagcactaggcaaacagttgtgtatagatatggtctctgaccttaaagaacttatagcctagtaaaggggacagtcagaagacaaataatcatacaaatgtaataaactctaataagtactctgaaggaaaggtataacgtgctatgaaggcatttaataggaagacgtcacccattttggtttaaactgaggtttgaactgtaagttggaatcaactaagtaggagttgggttccagacagagggaaatgaatacgcaaagacttgaggcaggagggaagaaggccccttcaacaaactacatgaatcagtatagggggagtattgagtgtagagagggagggagaggtatgtaagggccatatcattcatggctttaaaggatcttttaaaaattagggtctaaatttatcttaaaagtaatgggactatattgaaagattttaaacatgaggtgcatattgagatttgtattttgaaataaaaaaggatggagattagattacagtgatataaaatgggcagagatgtggaaatcagttagccggctatggctgtcgtccaggcaagagatgatgctcatgcttggactagggagtagcagtagatattcctagaagtaagcatattcaagagatttgggaagtacaattcatgaattggatatgaggattagggatagggagacaaaaaggtgacttccatgtttctggcccatacaaccaaatgatggtcatgcatttactgatttgagaaacacaagaagactaagtttgagggaggcaataagttggaatttggatatgtcgaatttgggtagctttgaagaaatcagggcacaatattaagcaggcaattgaatacataggtctgaaactcagtgatgagttcagggcttgaactaaaaaattggtgatcattgaccatatagatgatagttacagccaggaacttaaacaagattgcctaatgagatactttactcggtgaggactaaactctgatttttcatcttgcccaaattcctttctaaggggtctggggagtcatgccctccaagccataaattctcatcagatgggttttatttaaccttgtatatcatgacttactttccaatctgactctggcataacaagggagaaaatgaaaatgttttatcccaaaatatattttcttgccataccttgaaattgccctgcaaagtctcttgtgggaaaaatccacattctatagagaatccccttcccccattgttttccttcatttctttccagatccaggagataatcaactaagagccaggtgcccttttaggtctaataagaaacattttacaacgtactctctctaaagtctggtatctgagagattcctccacacaataaaacttggtctccacaatcctttatcttaacctgaacattcctttccattgatcccggtcgtcagataaactcaaccaattgtcaaccagaaaatgtttaaatttacctatagcctggaagcccccactttgagttgtcctgcctttctgaaccaaaccaatgtatttcttaaatgtatttgattgatgtctcatgcctccctaaaaatatgtaaaaccaagctgtaccctgaccaccttgggcacaagttctcaggacctcctgagggctgtgtcacaggccatggtcactcatagttggctcagaataaatctcttaaaatattgtacacagtttcactctttttgtcaacatcagccaagcttctgtgtcaagtaatatacactcctggtctgtacttcttaactccccagttccttcttaactcattgtaatctaactcttaccccctctgctccaatgaagctgcttttgccagggtcaccagggataccctcaatgctgcacacaaagcacagttgtcagtctttaccttacttgacctttttgtaacatttgaagttgttaacaagccttctttgatactttcttctgttttggattctgctgaatcacttgctttttgtttttctctaacctctttggtcattttagtcaatctcctttatgggctttctatttggtattttcctgggctctctgctcattttactatagtagaacaactgaaaactgaaatatctacagggaccaggaaataaaactgaatgaagtagactattttcatattaaacactttgcacattgaacctttatttgtatgacaagccctttgtttacatacaaacagcagtgttgtttacttctacaaagaaccaatagagccagatctttgcatttttcaacagggacaggggatatgggtttgtatatgaaatatctcattttaaaatattttgatcattgattcaattccatttcacttttatacactgtgctggacaaagaagaaatatcggaagacctcatgtagctgtttgactgccagtttgccagctcccctggagaagtggcatctgttcttgtggtttcgtcatctgttctctaggttcctgattttcacatctgcttctctgatctagcagagccctgcatccagcttcttagtagatatcaccttcctgaggcctccctgacttagcatctctacttccctcttaatcaactcttattctattcactcacccaaaccaaactgctcccttgccatcatacccaatcaaagaaggagttctttctttaatatttttcaaaacagtctcctcacctattctttctatgctttgtcacccaggctggagtgcagtgttgtgatcatgactcattgcaggcttgccctcccgccacacccttctctctctcaggctgaagcagtcctcccatctcagccccttgagtagtctggactacaggcacgcaccaccatgcccagctactgtttttaagttatttttaagaggtaggggtctcattcagttgtccagactggtctcgaactcttgggcttaagtgatcctcctgccttggcctcccaaagtgctgggattacagatgtcagccaccatgactagcccctctgtttgtcttttattatcttttgcttggattactacagtaacaacagtggcaggcagtatagtatagtaattaagagcatggactcaggagacagacttcctgcttctgccacttattagctgtgtaattttggatgagtttttaacttctctaggcctcagtttcctcatcgatgaactggaaatggtacctacctcacagagttgttatgaggtttaaatgggttaatacatgtaaatcacttagagcagtacagagtttgctattcttataattattagttgattacttacttcctctgagccacctaccatatacctttattttgtcatcgtacttgtcccactgcattgcaaattttgtgtatggtgctcttttctactaaactattagctcgttggaggtttggactatttctattcatctctggatccccagtacctggcacaatgccaggtacaagtaaatgctcagccaatgtttttttttttctttttttttttattattattatactttaagttttagggtacatgtgcacaatgtgcaggttagttacatatgtatacttgtgccatgctggtgtgctgcacccattaactcgtcatttaacattaggtatatctcctaatgctatccctcccccctccccccaccccgcaacagtccccagagtgtgatgttccccttcctgtgtccatgtgttctcattgttcaattcccatctatgagtgagaacatgcggtgtttggttttttgtccttgcgatagtttactgagaatgttttttgactaaatgagtaaacccatttgagcctgagtttcctcctcccgtaaatggggatttgaataactgctccacctcacaggattattgggaggacaattgcaaaagcacttcggaaattctaaggatctatcaaatcgtaagggattcatggtagcattcagcatgggtcccctctggaattttgcaggactggtttgtgcctctttttacttctgggagctagttggagaccttgctagagggctcagcccatgcttttgcaggtcttttgttgaattactagcaacttggattccctgacgaagcttcaggtgaagagaaaaatgtatataatcccactaagctgtagggctcaggaacttcagccttgctgtccccagaactaagaatccaatacccagctgctttcttcccaaagcaactgacaattttcattcatttcaggaatctttctgaacctgtcatgacctatagacttcacaaagagctggtctctgctgccagtaagtatttatgttactaattaactgtgttgtcctagtttcttaatgtttactgcaataagcctagaaaattgtttgaggggaagtgattgagggcacagaaacctaaaacacatacacaaattatgcacaactgccaaatgaaagtattcttgcttgctgtctaactcaagagttctattatttttcataattagtgttacttaagtgggcttgagaaaattggttaacttgagggttgtgtgaatataaaggctttatttatatatgtattcattgcctcttccatcagaacaagaacattggctcacattaccaggggacagaaaaatggttacacgacagttgccgtttcaacttccttcagcattttgcctgttcaaatgcttttcgactgtgttgtgaaccattgtccttaatctgttagtgccagcatcacattttctagatgagaaaactgagggagagggcgtcagtacataggaaataaggcatagagaatcactcccaaaagttggcgattaaagaagcattgaaagttttggctgaggccactgtatgagtgcccctctccacctcaatgtgacccttattctgcatcatatcctgtgtggtgtagaggaaaaagattcaggggacttaacatcataatgcgtctttgttgaaacaagggagctttgttctttacttctgggctctctcagtgattttaacaggaatccagaggcagcagcacacttctcagtaccacaaggaaggtggatgggaataggtttccagctggaagtttatctgtgagacttcaggaacaacctgctgtgctcagagttctgactccctctgagacagtcttctcttctcatccttctcttttctatcttctattttctacatctttttagacctgtttctttgtgtgtgttttttttctctttttctgccttttttctttctttatgtctttgtctttgtttctgggtctctaatttttattgtatttcagtgcctatttatctctctgtctcttttcatctcattgattatctctctctctgtgtgtgtctctgggtgtctttctccgaatctctctgtgtgtgtgtgtgtgtgtgtgtgtgtgtgcatgtgtgcatgtgtgtgtgtttgtgcatatatatgtgagaattttgctcaatccagttgcccagaaagccaaaccatttatctcttactgttctatcccagagtctgacaacctggattaccgcctaggagctattcactccctggtatataagctaccagaaaagaaccgagagatgctggaacttctgataagacacttggtcaagtaagtaactgctggattttcagaaaaagttcctattagaggactggcccatgtggttggactacacagaaactgcctctcagctctttcagccccagcccttaagtgcttccttggaagctgaatgctctgtgaggaaggctattttgccttgacccatgtacatatcctcttagagtcatcatgcatgtggattgtctcagttgaaaggtagcagcaaggtagagtggggtggacacaggctttgctgtcagatgagcctggttttgaattgaagctctccaacttatttgctgtataatctcaggcaaacctctctgagtctgtttggtcatctgcacaatccctacaatgaaggccagttgtgtggattaggatgaacacaggtaaaatgcatgtcacatgagaggctctcaagaaatggcactttttgttaagattctggtcaacttcttgccatggtgtggctggcagtaacagacagcgggatcctggagaatagtcctggtgacaggcactgagataggcaggtgaaaggggcacttgtgtcccacagtggtgcttcctggccagaagatttaatattgtgaatcaagatgaatttacttggcttaaaaaaggcggaaagcattctgtccaggagccagcagacctgggctctagtttcatttctgctttctgctattagttcattttgtgaccagggacaggtcactcttgaggcctctcttggtatatatattaaaaaattgtaatgtattttaagtgtatatatttagcaagtgcagttgtctgcatactcaaaagatgcagtaatgatacattttaacctcatttggagaggctctgaaacacctaaaattgaggcctttaatgaaggtgagtttccaggttaatggctcttttggcctccccctgtaataaatcctgagtgctttgcctatctggacctcgagttttcctattatatgtgagatctccaagatctgattcagctctgactttcaaagactgttttctacacttctatagcaaatgaatattgtggacactgatgtaggtaataagcagaattaacaagagagaatggcttttatatttattgccagtgtttgcaatttgagctaatagagaacattaagaggcatgtggtctccaaaaagtagtttgtgatcatctcagtaaatgtacaaaaatcagcaaagaagctatttgcatgttaatttaaagttgccctggaggagtctttgagtccaagttccagatctgtcacaaatatgctgtgtgacctagagaaagttcctcccactctctgggccacaggtttgtgcatctataacacgaagagactgaagcagctaatctcaaagggttttctcagctctgactttctgagagtctcaacatgtgacgagacccaaggactcaattgaggatgcccgtgcttagtgagcatcagggtgcctgcctctatctgcccaaaggctggctgcttggcttactttaagaatcttagtcctcaaaatcttgaaatcaaaagaagacatgaacaaatagatcacagaaatagaatggcaaatactcttaagtatgtggtaatatgctcaagctcactcatagtaacaaaaatacaaattaaacctatactgagctaccatttattgtcaaatcctaatgcttattaattagactatggggaaactgtcctctaatacatttattgtattaatgcagtacagttccagaagaggggatttggcagtacctaacaaatctacacattcagttatcctttgacccagcaaaacagcgtaaaacagggtatatgatatgttagcttttttttttaaggcgtatactctaaagatacacctccaccaatacaaacaacacatgcacaagatttctcattgcagcacaattttcaaaagcaaaagattggaaacaacacaaatatctgaaaataggggactagtcgagtaaataagggtgtattcaacagtgtagtattatgcagtaatttaagaaaagaatgaggaagatctctatgaactttgttttgtggtgattttctgggatatattacaattttccagcacgtaaaacaaacatcataaaaaatctctggctgtaaaacaaggtttataatatgctagcttttcttttgtaagaaaaaagaggaaaataagaatatgtaagaatacacacacatttaaaaaaatttgtcaaatgaagcatacactaagataaatttaaaaaaaactaatgactccaaaagttaaatgtagagttgccatagatccagcaactccactcctaggtatatacctaagataaatgaaaacatgtctccacacaaaatcttgtacacaaatgtccatagcagcattatttcatagttgttgaaaagtggaaacaacccaaatgtctgttaactaatgaataggtaaacaaaatgtgatatacaggcaatggaatattattcagccataaaaaaggatgaagtactgatacatgccacaacatggataaacactaaaagcattatgctaagtgaaaaaaaacaagacacaaaagtacatattttatatgatttcattgatatgaaatgttcagagtagacaaatctatagagaaagaaagtagatgagtggttggcaaggtctgggaagtgggggtatgagaagtaatggggagtaattgataatgagtatgaggtttctttttggaatgatgaaaatttctggaattatataaggggtgacagttgcacggctccgtgaatatactaaaaaccacttaattataacctttaaaaaggtgaattttctgatatgtaaaatatatttcaataaatgtattataaaaataaactaatgaaagtggttattatactggataggtgtggtaagtagggtggaggtgataggggtaagagctagattcctctaagtatacctccttatatacttatgactattaagccatattaatgttttacatatccaaaaaagaaaattaaatcaaaaattataaaccgtaaaactgaacaccaataaaagcaaatgactttaatgaacctaagtgtttatcaacttgatagcataattacagagagaaagcaattatttcaactaacgtgtcaacacagtcctctgactcatccttaatgagatgtactctagaaacaagaagagcaaaattttaagcaacactcagtaggtttattaatagtagtaatataatttaacttgaaacaaacacacagatcttataaagataaagcaaaaaagtaaatatgttaatgttatcacaagctaagtttatagtgtacaaaagagatactgataaaaaagacataaggaaaaaaaattttaacattaaaattaaattaagaatgttaatatgaattcatgatttaaagagaaagcaacaagaagaaaaaactttatccactgaaacagtgtcgaagggattctacccaaaaagaagtgaatacacttagtgcccagttttttgtttttaaatagcatttccttttcaaaggaatcaggggtgcttagagaaatggctgattgcatgtctggagcaaggaaaatacaaagttagtcttggataaatagtaccaccaagcaagaaagaacagagtcacactaatagtgtcatgtccaaaggacgtagaaaccttgaaagggctgacactgatgatgtttgagccaacctgaacatcaataacaataaataatgtatttgattattacatgttgaaaaacaaaactcctggaggtgggtagaggaaggaaatctctttattgcagaaggaataccagctaataaacataggaggaatgacagaattagaaaaatcattagtttgcaatctaagtgatctgttttagacatgaatcaaaactattgggcaagagtattgaggaataggatgttcacattattccagtgtattactgacaagttacttactaatcacaaataaaaaacaatgtatctttacaatgaacctatctggcagacaccaccttaagtaattgatcaaagttagcatcagtaataacggaacaggccaagtgcagtggctcaggcctgtaatcctagcactttgggaggccgaggcgggtggatcacctgaggtaacgagttcgagaccagcctggccaacatggtgaaactccgtctccacaaaaacacaaaaattagctgagcatgatggtggatgcctgtaatcccaactactctggaggctgaggtgggagaattgcttgaacctgggaggcagaggttgcagtgagccgagattgtgccattgtaaataatggaacaaaccaccttatgtacctcctaattagacataataaaaattataaaacattaactgtgaaatatttttgccaaaaatacgtagcctgaatcaaattaattctttccaatttgcaggaaataaagagtatagaaaaacacacagtatttgacagtctataaagcttttgaaaaggcttggacttttcaaaaagtcaatgttgtgggaaaaagtggtagaggtactgttctacataaagagactaaagaaacaaacaaatacagtataagagctttgtttggatccaaatttgaaaaacgcagctataaaagactttttctcccataacatttgagaaaatttgaatatggactagatattagatgatatagaatctacgttttctaagatgcaaacatgttattgtggttttgtaggaaaatgtgcttattctttgatgatgaatgctgaagtatttagggttgaagcaatgtactttcagaggattaagaaaaaatatagacagaataaaagcaaatatggcaatatgttaatttttgagtctaggtatagacagtatgagtcttcctagtaccactctttcaactgttttgtatgtttgaaaatgtttataatgaaaattgtagggaaatgtaaataaaaaataggcttagtttcaatagagaaatttacacaggagaagaaaattcaagtgtttttaaaatgcacataattatcttgcctgtcaactgctgctttcatcatctatatgatgagtacatctatgcctttgtactgtgtttccactgacagcctgttttctaggctaataacaggcagaaccaaactgaccttagccaatttgaggttctcagttatccagttctttttggttagtatctgtagcttctattagtcagaagtaggagaactctaaggccacctccctggcaatcttactaccagtggaatattacaatggaagcaagctccaggcctaattctgccattcttatagctatttatcagcaggcagacgaaaaaagacttgaacaacctgttctgcaaactcaaatgaagtcccagctctctgtcctttcagatgccctgcctgacaacatcttggatgaaaggttcactggaggcagataagattggagtcagacaataaaatcctaccatctagtacccctatgtaaccttaggcctgggctaccattctgaagggtatgggttattagcttactaggttctttttacttttgtaataatacttctcttatttgagaagcaatactgtgcattgtataaattagaaaatttttaaaaagcaaaaaaaaaaaaaaaaaggaaaagctttctattcccaacattcaataatcattactgttaatatagttcaggttttttcggatctctctctctctctctctcttctctctctctctccctctttttctctctctcgttgtgtgtgtgtgtgcatgcatttttgtatacacatacctgtttgcatttttttttaccaaaatgagattatgctgttctttagtctactttttccattttaacaattttgacttttccagaccatattaactttttcccatttgacccaaaagtggccttttataggtgtttgtccaatctggtattcaatataggaacacattttatttatgtccttattgtgtttttaatctagcacagtgcttgtttctattattattattattatactttaagttctgggatacatgtgcagaacgtgcaggtttgttacataggtatacccgtgccatggtggtttgctgcacccatcaacccatcatctacattaggtatttctcctaatgctgtccatcccctagccccccaccccccgacaggccccagtgtgtgatgttcccctccctgtgtccatgtgttctcactgttcaactcccacttatgagtgaaaacatgtggtgtttggttttctgttcctatgttagttttctgagaatgatggtttccagcttcatccatgtccctgcaaaggacatgatctcatccttttttatggctgcgtagtattccatggtgtatatgtgccacattttctttatccagtttatcactgatgggcatttgtgttggttccaaatctttgctattgtgaatagtgctgcaataaacatacgtgtacatgtgtctttatagtagaatgatgtataatcctttgggtatatactcagtaatgagattaccaggtcaaatggtatttcaggttctagatccttgaggaatcaccacactgtcttccacaatggttgaattaatttatgctcccaccgacagagtaaaagcattcatatttctccacatcctctccagcatctgttgtttcctgactttttaatgactgccattctaactggcgtgagatggtatctcattgcagttttgatttgcatttctctaatgactaatgatgatgagctttctttcatatgtttcttggcctcataaatgtgttcttttgaaaagtgtctgttcatttccctcgcccactttttgatggggttgtttgtttttttcttgtaaatttaagttccttgtagattctggatattagccctttatcatatggatagattgcaaaaattttctcccattctgtaggttgcctgtccactctgatgatagtttcttttgctgtgcagaatctctttagtttaattagatcccctttgtcaattttgacttttgttgccattgcttttgctgttttagtcatgaagtcattgcgcatgcctatgtcctgaatggtattgcctatgtttttatctagggtttttatggttttacgtcttacatttaagtctttaatccaccttgtgttaactataaggtctaaggaaggggtccagtttcagttttctgcatatggcaaaccagttttcccaacaccatttattacatagggaatcctttccctattgcttgtttttggcaggtttgtcaaagatcagatggttgtagatgtgtggtgttatttctgaggcctctgttctattccattggtctatatatctgttttggtaccaggacaatgctgttttggttattgtagccttgtggtatagtttgatgtcaggtagcatgatgcctccagctttgttatttttgcttaggattgtcttggctatatgggctcttttttggttccatatgaaatttaaagtagttgtttctaattatgtgaagaaagtcaatggtagcttgatggggatagcattgaatctacaaattactttgggcagtaaggccattttcatgatattgattcttccaatccatgagcatggaatgtttttccatttgtttgtgtcttctcttatttccttgagtggcagtttgtagttctccttgaagaggcccttcacgtcccttgcatgttgtattcctaggtattttattctctttgtagcagtcgtgaatgagagttcactcatgatttggctttctgttattggtgtataggaatgcttgtgatttttgcacattgattttgttttctgagactttgctgaatttgcttatcagcttaaggagattttgggctgagaccatggggttttctaaatatacaatcatgtcatatgcaaacagagacaatttgacttcctctcttcctgtttgaataccctttatttctttctcttgcctgattgccctggccagaacttccaatactatgttgaataggagtggtgagagagggcatccttgtcttgtgcctattttcaaagggaatgcttccagcttttgcccattcaatataatattggctgtgggtttgtcataaatagctcttactattttgagatacgttccatcaacacctagtttattgagaggttttagcatggaggggtgttgaattttatcaaaagccttttctgcatctattgagataatcctgtggtttttgtcattggttctgtttctgtttctctttcccgatttccctggacagaacttccaatactatgttgaataggagtggtgagagagggcatgcttgtcttgtggcggtttttaaagggaatgcttccagcttttgcccattcactatcatattgcctgttgatttgtcataaatatctcttattattttgagatatgttccatcaatacttagtttattgagagtttttagcatgaagtgattttcaaatttatcaaaggccctttctgcatctattgagataattatgtggtttttgtcattggttctgtttatgtgatggattacatttattgatttgcatatgttgaaccacccttgcatcccagggatgaagccaacttgatcgtggtggataagctttttgatgcactgcaggattcggtttgccagtattttattgaggatttccgcatcaatgttcatcagggatattggcctgaaagtttttgttgttgttgtgtcttctgccaggttttggtatcaggatgattctggcctcacaaaatgagttagggaggattccctctttttctattgtttggaatagttttggaaggaatggtagcagctcctctttgtacctctggtagaacttggctgtgaatccgtctggtcctggggtttttttggtgggtaggctatcaatttctgcctcaatttcagaacttgttattggtctattcagggatacaacttcttcctggtttagtcttgggagggtgtaggtgtctaggaatttatccatttcttctagattttctagtttatttgtgtagaggtatttatagtattctctgatggtagtttatatttctgtggtatcagtggtgatatcccctttatcattttttattgtgtctatttgatttttctctcttttcttctttattagtctggctagcagtctatctgtttagttaatcttttcaaaaaccagctcctggattcattgattttttttaatgcattttttgtgtctctatctttttcagttctgctctgatcttagttatttcttgtgttctgctagcttttcagtttgtttgctcttgcttctgtagttcttttaattgtgatgttagtgtttcgattttgtatctttcccgctttctcctgtggacatttaatgctataaatttccctgcgaatactgctttagctgtgtcccagagattctggaattttgtgtctttgttctcattggtttcaaaggacttatttatttctgccttaattttgttatttacccagtagtcacccaggagcaggctgttcactttccatgtagttgtgtggttttgagtgagtttgttaatcctgagttctaatttgattgcactgtggtctgagagactgtttgttatgatttctgttattttgcatttgctgaggagtgttttggcagtacatatactaaaattggaacgatacagagaagattagcatggcccctgcccagtgcctttttttatgatactgttttaccaacaagagaagaccaattgtcctgtagaatgttacttcctagttttgtctgctttcttctttgtcatatatttcagctaattactctacttcttgtatgttttgtaaagtagaggttatatctaaaggctagatggattccagttaactatttgttggctggaacaaatcacatgtgatgttgtatacaccatatgctgcatcacatctgaagatgcataagattggttgattcaccttactgatgttaagattaaccattgctatatttttctaccctgtcaatgcagggctgagagtgtctgtacaatattttcagctagtccatatgtctttaatacatctaggcaatgataattcatttttaccttatgttatgctcattaacaaagcctttggtgttggttggagataatgttagctgaaacttacaggagcccctctgacttttacctgagtctttaaatactcattaatcacccctagagtatgcgtgtattcacaattagaatactacaattataactaatacgttatacatgttagagtatacatgaaaactaacaagcacataaaccaaatttcatcagttctaataacactttttctcaaattgtaatctgaattctgtacacatctgaaaatcaatggtttcttaaaattacacttatcaggcagcagttttgatgtaattatcatggcctccatatgcatgaacttgtaatagctgctcatattatagtcacttaagttaaattatgttcattgttgagtttattttctatttaaaatgtcttcaaaaatattacatgatgatatgacaatgaaattacttttctttcttagtggtacataaataatgtgctcgtaactgatgactgatgaaattcatgacatcgtatggactttgttgaagtatttaaagtaaatgacagataatataacaccagtggaggaagccaaagctgtcagccctttaaaaaaaggcaccatttcgctgggcacggtggctcacgcctgtaatcccagcactttggaaggccgaggcgggcggatcacgaggtcaggagattgagaccatcctggctaacatggtgaaaccccatctctactaaaagtacaaaaaattagccgggcatggtggcgggcacctgtagtcccagctactcgggaggctgaggcaggagaatggcatgaacccgggaggcggaggttgcagtgagccgagatcgcgccactgcactccagcctgggtgaccgagtgagactccatctcaaaaataaataaataaataaataaaaataaaaaataaaaaaaaggcaccatccttggggatagggacctgtttgcttgtgacactgattcactctcgccttcactattgtcttttccttttgaagaattttttattatgtaagatttcaagtatatatgaaaatagaagaaacagtatagggaagtattatgtgtccatcacccctccttcaactgtaatcaacacatggccaatcttgtttcatctatttccccacccatttcccctcctcccatgttattttgaatcaaatctaagacatcatattatttcatccacaaatatttcagtttgtcttgaaaagattagaactgtttataaacataacatcacatctaaaaagaaatgagtaataatgtaataatattatccattattctgtgttcagatttctgcttcctttttagttttgtgtttctggggtgtgtgtgtgtgtatgtgtgtgtgcgtgtgtgtgcgtgtatgtatgtatgtatagggtgggaaaggcaagcatacttaatagatggttctatgttcttctaacaggggacacacagtgtgtggttgtctttgcccccaattattttcgagagcactactttctgagattcacttaattgtcagagctggaagtccccttagatcacctaataacttcattttacagatgagggaacagatacctaaggatggaaaaagataggcccagagacacaatactttagtaaaagaaccaaaaaatattgaaggtagcttccttgtttaggagtcagagggcacacagttcttagaattgttggatgctaaagctgggcgagacctaaaagttcatacagatagcctctcattctgccagaggtctcagtctggcaatctgttgacaaggtccagaccagaaatatattttatttgtcctgcagtgttttgggaaaaaagtgatttggcttcaacatttaaaaaatccagatagttcacatcaaaatatacatttcaggaaaaaaagaggatgttagcacactggatctgcatgcccacgtggcagcaatcagttggggttgagtaatggtttcttgctttggaatgggcacaagcttctaatttgccatagccctcaccactcccaagtgttttaacaaatattatattagagttacattagatgtgacctaggaatttccctttcttaaaactagaagttattctgttgatggtgtgtctctaagtgagtggcgggaaaatggtggtctaaagaatgtctgcttgtttaaatgtggcagccacttctcaccaggcccatttctctcatgtaagttacctgccttgcccctctagacatttaaatttatgacctctaatctaaaccatgcaatcagaatcattttattctgtactggaggcttctcacaaccaacctcagtggactagagagttcaagattcctttgctgtcaaataacatcacatactcttgtttttggtttcattcatcttgttaacccacaatttggaatgttacttatcccccatactgattttcaaaatatataataaaaagagagacactaaatgcaaagcaatttccccaaagaataggtgaacttccaaatctcataagaaggccaagaaggaagagtatcctaaatgggatgccaagtaactccctcagagaatcagaaggtggctttagcttagaagagctcacatatgagttttgatttctccagaaaagttagacaagcaggcagtgggatgcaatgggataactataagacttggggagcaacaaatatgggcttgaatctctgccttgccatatgaccttgccaagtgctttgctcttggtaaacctaggcttcaaagctaaaatactctgctttttggagttgtgatgattctgtgagctgctgggacactgaacaaagatcagttcctttcaaagttcacaaaaggagatacacaagtgcccttgtggtttagccttttagggtcacttggtgttagcatggagatacttttccattttaatatctgaaaaaaacttccgtcactaaagaataaagattaattgcaggggtattgaaactgttaaaaggaacacatcaccagcccagcaatatcaaaagctatgaatggttgctgttcatttccatctgaatggtactcagctttgtctagggcttaacagacttcacattaagatttgtctaaggattctgtcctcctcaattacccactcagtgttaagaacctgccattctcttctgggccttagccttggtaggtgtggagagtgagtgtttcgggtagtcagttgggctgttcctacagccaaactgaccaaaagagattcttgccttttacttggctgcctccaggactgtttgaaacagcactagggagctcaattcctttacaaataattcattagtacctgctgtgtggcaggcacacacacttggaagttgtttatcatttagtaggagaggcagataagtaaacggaaaattgcaacttactctgcttgccagtggttttagttaagatgagcacagtgggctctggtctccctgaaggagatgtaacgttatgtgcatctccaaggatagatagacattttgtagatgtagggagaggggggatattccaggtagagagaacgacatgagcagagaggtatgggggtctgaaacaatgtggtataaccagacaaccccaatctaagcagtttagtataacaagagtgtcagaggtcagcagtacctgaaggctcctggagaggtaataataacaacagatacttcccagggtgccaggtaccatgctgaagcaatttatctttatttattcaacaactctctgaagtgggtgctattttcccaggtgggaaaactgaagttcagagaggttagagtgagtgaactcactgttgcgcagctggtaagtggccgtgttgggattcaaacccagcttcagagcctaagcagtgagtagggattggaaataggggtcaagttactcaagttatggaaggcctcatttgtcactttgaagagaattggccctatcccaaagtaggaagccactaaagggaatttaagcaatgaaagtgactagggatcagaaaatctgggattgcacgttctactctacagctaattgactgtgacttcgagcaaattcctttccttctttgggcctatgttttttcatctgtaaaataaggaagatgatcaagggcaagtcttaatgatccctttcagctctttcaggtttttgcttctctaacgggggtcaggaaggggctgatttaagagactagtaggcattctctcaatgtgctttgtggttctttgtacatgctttatacttatatgggctgttcctcttgctttgaatgtcctcttgcttccctcctgcctctccaaatagtatcccactagctttagtccctccccacatccctgtctgtctcttaattccttcaatgctgttagctaggttagctatgtctaaccactttgattcctaattttatactatcttgtattctttgctgattgtttcctttgtaatcttgccttccaatacatactttaggtgctcctttccttctacattttagtttctcttaccctctacagcacctaaaacagtcttggttgtaaggggatactggagcaaattttgttaatcttgccccttttcttctggcagtgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaaggtatgcattttctattctcactacctgtcttccaaacatgtgacactttcccccaactgccttttagtgctgtgtcttcctccttggctcacgttgacagtgaaaggaaatcccattatgacacaatgacatttaatggcaactctgaccctgggaaattcattcattcagcaaacattgcttaagcttataactatattattttcagacaccatgctaaatactgggggtaatgaagaagaaaaagtcactgtctgtgcctttaaggtgttaacaatgtgtagtatggagacagatgggtaaataggaaaatgatagtataaaagtagtctatatacaatgaaactgtaggggagaagatatttatgttctcacccattgctagtttcatggctgagatccctataacaaaagaccgattaacaagagaaaagcatacaaatttatttaataagttttacatgacacaagaacctttagaaatgaagacccaaagaagcaggtaaactcttgcattttttatactaagtttgatgaaatggatcgttgtgaagattagtgattagaagacagaaggatatgatctaatggtaataaacttagggggatcttagcaaggcttgtttgttcagattcttcttggtgtttctgtgtcttcgaggatagggatgttcttttccttcagttatagggagggtacctctggaatgacctacttcagaggaaggtcagagaattcttttatggcctgctccaggggagaaggtagagaaaccttcttgcttctgctgtttccacaaacgccaaagtgccatattttgggatagcaggtcctgaactccatcaaaactaaaaagaaatcaatgcttacacttattcgaaccccatctcattccaaaagtatatatggtagcatattttatattgcacataaaatataaggcatcatacattataatcaggtcaagtacaaaaggtaaaacaaaggtagagtcagaaaatgatgcccagaatgaggttaagacaaatatttattgacaaattcttgtacacttgcaacagatggccctgcacactggggtataagcttcatagcagctagtgccatcctagggaaaagcataattcaataaagaagcacagggaggcaaaagcagcaggacttggtgactggaagtcaccaaggatgggggagagggagatttctgaatcctgattttctgacttggctgactgggtggatggggctgtccttatacatataagaaattcagaatgggaaagtttgagggagatagaggaaagttcagtttggaacaggtcgcatttgagatttgtgaaagacatccagggagcaatgcctggcgagcagttgactatgtgaatctaaagcagggatcagaaagcttttccttaaaggaccgtataataaatacttaagcctttgcaggccatggatttctgtcacaactacttagctttgccattgtagtgagaaaacagccatagacaatatggaaacagatggttgtagatgtgttctagtaaaattctatttacaaaatgggaaacaggcctgtgggctgtaatttgctgacccctgttctagagcccagatgtgataaattgataaatcaattgattcatccaacaaatatgtgtcgagtacccactttatgccaggtactgtttcaggaactctagatatcatcttcatagagtttatatttagaaaaagtaaacaaatagtattcaaagtaagtaaagtatataatattttagattgtaatgaacattaaggagaaaagcagagaagggaaataggaagggttggaaagtggttttgcaattttaaatacagataggaaaggagaaaataaggaaatgaggagggcctcacagagaagatgacctttcagcagagatcgatagggagtagaggaatgattcattcacctatccagagagaaaggattctaggctgaggaaatggtaagtgcaaaatcccagaggcagaagtgtgcctgtcatattcacggtacaacaaggaggccagactagctagagtggattaagcaaaagatgaaatagaaaaagatgggctcgaagagataatggagagggacagactagatcctgtagtggagtcttataatccactggaagaattttagatttgctctgcctgggtaagatagaaggggggttttgagcatgggagtgacaggatttgatttaggcttaacaggcttattctggctgcaatgtggagaatatgaaggaagtcaaagaaaatctagataaattgagatacatactgtgttcatggagtggaagactcaacatgataaagatgtcaattctttaaaaattataagtttaaggtaatcaatatcaaaatcccagcaagagcttttgtagataaagacaagataatactaacatatatgtagaaatggaaaggaactgtaagggctaatacaattttgaaaaataataaactggaggtaggtattaataatattaatgcttactgtattgcttcagtagtcaagacagtgtacaattggcagaggtaacccgataagtcctcttgtctacttcttacataaacaaatagaacagaatagagaatccacaaatagccctacagagtatggcctgattatttttcatgaaggtacaaaagcatttcaagggagagagggtagtcatttcaatgaattgtattggagcaattgcagctctataggtaatgaaagtgaacctcaacctaaacctctcattttatataaaaatgagctcacaaaggatcatacatttacatataaatcataaaactaaaacttgtagaagataatatagaaaactgttagagcctaggacttattgaggagacatgataccaaaagcataatccattaaagaaaaaaaatcaataaattgacttcatcaaaattaaaaatttttgctctgtgaatgaccctattaataagatggaaaaaaaagctaccgagatttggagaaaatatttgcaaaccacgtatctgacaaaggattaatatctagactatacaaagaactctcaaagctcaacagcacaaaaattcaatctaattagaaagtgggcaaaagacatgaacatgacgtatgcgtggcaattaagtatatgaaaagatgttcaagatcactagccattagggaaatacaaattaagaccatgatgagagatctctacacacctattagaataggtaacgttaaaaaaatatatagtggcaataccaactgctgacaagggtacacaaaaactggatctctcacacatttctggtaggaatataaaatggggcggctgctctggaaaacagttttggagttccttaaaaactaaacatgcacttctatcggatccatcatttacactcctgggcatttatcccaaagaaatgaaaacatgtccacacaaaacctttatagggatgttaattaatatttgaaaaaaagttatttaaagcattttacacatattagcacatttacacctcatttcacataagaagaaaccaaggtacagagaagttaagtgacttgtccagggtcatggagtaagtaaatgttggagctcaaatttgaaatcaggcagttcaaatgtatactttaccacctctagatctttgttatgtgttttgcaaatgggtacctgaagtaagtgaaggtgagggtcattatagatgagagagctaaggaactttgaggcaagagttgctgaagggtcatccacatagtaaagatttttgatagaaaataattttctaatcctagcatttggtggtcagatcatgggtcttgtatgcttggctaaggagtttggtctttatcctgaaggcagtagggagccttggaagcatattctgaacattcattatatgatgattcattgcatcttaaatgtcctaattcatttataagtggataaaggagtgacacagcatctcatcattagtataacaaaataatttttcttttgtttttattctatgcatttttaggggcaaatgccaacttaaattttattagaaaatgtgttggttggcaaatgacctcaatcccaatctagttcataaaagtgtgattttgctatgtccaaagcatattatgtggcatgatttgaaaagcaattaaatgctagttatctcttattcccaggatataataggaggccatttctattaactagtggtcagctgttaagtgagattttcacaccgttgtaacctgttaatatgtgttaagtagtcgaagttctgacctttgtgtgataccagagatgtacgctgaccatgttttccaaacaaagacatggtaaccaaggatcttttctgatttatgaatttatttcaaatgaaacatcttacatggagatatgaaatgaaatcccagtttattaaatacttatcaagttaccttttttgaaaaatagcagaatgatatatgggtgagaatgttccagaaattctagaccttatgtaggtgtaacctcacatggtggttgtgggattaaaagagataatatgtgtgagagctgttgctgcttcacacatagggattatatgttcctggcaagttgttcagttaatggggtatgatttttcagttgaaatatattataatttcagtaatgtgttttttccatttacacttgctctttaatagaaaagggcttaaacacattggttttaagttttctttgttactcctttctttcagtctctcttttaagagcatccagggtctgtaaatacagtgtaagtgaatcagaagagttgatgcttaaaggagtctattactaagtcttgcttaaaatttttttttaacaacttgaatgatcttttctaatttttttcttttttaagttggaaagtaggtaaataataggggaagatctacctctacactgattccctagaacaacattgccaattattctgaagttctctctcttcccatctcacttagcagtatgtatcagggtgcctgaacctcatgttgttggcttgaggcatagaggtaatttggactgacagaggaaggttgacttctgttttccgaacattttgttttggggagctgccaggaattagtggggaagagagaggtcatctctgaaggcggttcttagcaatttagttttgaggacagagctatttcacctaaggggacaaaatatagggtagatccatttgaattttagaactggaaaggggccctaaagaccttcaggtccaagcttttcattttatatgaagcctcttttcgcatgccatggtagtggtaacaggtttgcatttctgcagctccattcctgcttgtctactgtttggaacatcagctctcccccacagttcttcccaactagtttataaaagaactcggataccagccacaaacttttaccagttgtctaacttgtgctttgcaaactcattttctcacctacacaacctggcatcagctgttttcctcctttattgctcccaagaccactctcaaagagctagaaagcagtggttctgcccctgtagacttagatttgtattcagtgaacatggaatcagtgtgggacagcgtatttccagctcgtttagtcctttttctaactctgtgaatgatggatcgtatttccatttctgagataggaaatggaggcattgagtgtagtaagtggcaaagctgagacttaagtttaggtctatcaggttaaggctgcccctcagggaaagggggacctgttttattgagatgtgagctgtgcttttctttgcatcattgatgatgacttagctattctagctactcttgagttccctccttatttccagtctttcctttttagtgggtgggcatctgctttttaatcatacaggaaggatcttgcctaactgtgttaagtatagttttctgggagaatagttgattatttttgagataattagaaaatctattatcggtgtatgtcaaaatggattttagtcttactgcttaagatatatggttcagggaaatggaagactgaatggtatagtcttttctgcagacatggatggttgaaggcagttcttcctataaactggccggagaaagctgggttattctcagtgtggagtttgtgggaactccagtgttgcctatgttcccaaatggccaaatgggacctcatccaggaaaaaagcccatgtcgtagcaatgtaatggatttgagaaggcaaacaagagaccctgttaagaaatggctctgatttatatacttttcagacacccagtctagcaacctagaggaaacagacccttccagtcctggtctgtctctcctttctctaaaaggtggtgtttgtgaatttcagtctgccaccagagggtagcaagagaacagatgaatgtgtccctccaactgatttctggaataagatagatagatagatattttaaaatataagtaaatgtaaatatatagttatactttatagattttactgtatagatttatattttatacatttgtattttagaatgtatctctatatctacctacctacacacacacacacacacacacacacacacacagacacacacacttggtggggggtgggcgtcagtatgtgtaaagagagagaatctaattaagccaagactctacttcacatttaatttctgaaatgataaggttaagctaaaggttattgaaaataacatttttattatctgtacatgtaaggatattttcattagtctctacatgtgaatctaatatgtatttagcttggaatttggcaaacattctcaattgaatctggagaaaaaatatctttaagtttgaatattaagatcaaaacgtaacctggagaaaaaatatctttgagcagagaattattaagattgggagatttcagatgtatttattagttacaatgaatctttgaaaacgtagcttcaagttttccaccttggctaagtggaggtctttcacacattcttcaaatgcccagttacttatagctttgaagtgaagtcaggccctgtttgaggtgaataagcatgtccaaacccaatgagatagggtgataaatgtaggatgcagttgtgatctgaggtttgctccaatgttcagagagcagaaaagattccccttttgattctgggaattatgccgatgattcagaatgaggtgaaaatatccactccttccctttttctctctctagctggggctgtaataataattatcacagtaaaaatgatagcattttttgacagcttgctatgtgtcagacatggtgctatacatttgacacaaagcatctcctcgatttctcacaactttatgtagtatttacttacaggtaaactgcggtctacagaggttaagtttctatggactatcaaaatcaaatatctgtttttattttctttttggaggcttcgagtgtgtgtgggtggggaagaatatagaatcagagatttttgagaatcgaaaatatctccaaggtcatattgtccattcccctcaatggccagcgattttcttgtatcatatattttttcctttgctgttctcctttgagtggcctgaggtctcaggttggaacaccagagtctagataatacagtaagactggggccagtgtgccagagggccagataggtgtactttggcagctagacttaaagcagactgagcttcagcagtctggtgataggccaataggaatttcagaaaacaggaatcaattgaggagcaatgagagatcgggtggactttttctttgctctgagatttggagagtgaaaactgggtcattgctactttcttagattaagactccttaccaagaactctgaaaatgtccaggctacctctgtgagctcttcagatatccctagagtgagaataatggaaagaatggaaaaatagctttaaactagacagcccaggggttacatcccaactttatcctttactagctgggtggtcatctaaacaagccagtttacccccctgagccttgtttccctcattaaaaaaaaatgataccaataattagacatacttcatagagtttttgggaggagtcattgagataaatgtttcaagtactttgtacatagtacattggccactaaattttagtacttgcccctgccctataccaccacccctttgctgtattgacaggagatgagctctgtctttgtggtggcattccctcctaatacttttattaataccttggtatctactaagtctttgtagtcaaaagaggcttttcttagtagctgttacaccattgtttatggttgttaaatgatagagaaactctttaatttcccaacctaaacgcatcttaagttgatctaaaaagaaactgcacttggaatctgccatctcattcttagtagaaaactcacaatccatgctgagtagatagagatgtccttaacaggatctgactttatcttctctcccccttgatattttcttcccaagacaactgggaaggggaatgaacagacaattagaacacggattacagaccggttagatataatcagtggaagtctacagctgtttcaggcaggaggtactggtttttaggggaaatgacacccgattgggcattagaactcttggattctagtctcagttctaccacctactagctttggggccttgggcaagtcacttccccctctttggacatcgattttcccataagtatattggatgagtaggactagacaggattctggaatgttacatctaaaaaggccttaaagactatgtgttgctgagaccaaagacagccttagtgacagcccttttataaaaagctggctcttggtaacaacagacgtgatactttcaaagttctctacatactctaagcaaactcggtgacacacttgatgtttaatgtggtctgtgccaaatgctaagagctcattacttttgaccctttgccacctttgtttctagtgtagttaagagtatggtttttgctaatataaccagaacccagaaagctcaacatagccttagccagagtgtaaatggagactcagttggaaagctgggattcatcagggccaagtcttgtagctttgatttatagaaaggcaaaatgtttttttgtacaatctgatatttgcagccctgaagcgacatctggaaagaatctggatagttgctcatttctgccaagatttccaagagttagaatgggtctggatctcttggcctttggcaattggaaatgaccatcttatattaaatttcttctctctttcacacctaaagacatgacagagaagaatccgtaagggggttaatatgtgaccaaactcaggcaagcagttcattaaccctcttcccaatggaggtgatcgctctcctggcagtgtctcaaagcccagcaaattatccagatttagttcccagaagccttcaggagagggattccaggagttgggctccttcctgaatacaacccaaaacaacagccaaggcccatcagaatgaaataatattcctcggatattgagttctcttagaccaggcctttagaatggcactcagtgccaaccatatgcccagaaaacaaataagcactggtttgcccccagactctactttggccaccttctgggatttttttctgaagtcactatcagagaccatgaagccctaattgttcttaaccagtccacagaaagccaaatcagtctgtcctttttctggagttttggagggtgggaaaataagttctgcctgatactgtttctacccgaggagttatttttaaacttaaaatgtttccttctatggtttatagtggaaagagtgttagccttgaagtcagacacttctgagttcatatcatagccctgcttcttactatcaggtggccttggacaatgcacattctttattcccagccaagcctttggcctcacatcctctttctagtcttctccccagtgagttgatctagtctgtctatgagttaggaattcctacttaatttttcagctacagaagaaccactacagtgtccagaggagggaaaatgaaggcctataccctgtcaagttctagtgataattttctcaactttccattcattcagctttctaattattctttcctcccttaatcctgtggaaaggggtagatagagggatttattttgtggttaccctaatgcgctagttgttcaatcatgtccttcaagcccaggttgtctttgcagagaaaggaatttgtgttcagagaaaggaacttgtaaacactcaataaatgagttaatatacataaaacacttagacatgtgcctgacatgtagtaaacattgtagaagagttgaccattaaaactaactctgacccatggcttgaacttggaaaaagtttattccatcaaagccattttagtcagtcttctgggtcagcagctagtaccaccatttccaccttctattactgctgtcactaccttttcacaatgattgcatgagatgcataggaactggttttgcatcctgtgccacctagtatttgaccctttagaaagtctccatatgctatgagtttcccattcttttaggatttatttctgcttttttttttttggagacagagtctccacttctgccacccagtttggagtgcagtggcgtgatctaagctcactgcagtctccatctcccaggtttaagcgattctcctgcctcagcctcccaagtagccaggattatgggtgtgcaccaccactcccggctaatttttgtatttttggtagagacagggtttcaccatgttggccaagctcgtcttgaactcccgacctcatgtgatcctcctgcctcagcctcccaaagtgctggggttacaggcttgagccaccatgcctggttttatttctgctattgtaaaagggtaggttgttattccattctcagaacctgcttagaataagtcctttcatggatacacaagaagccactggggcattaggtagagcttgctaggtttcttttcttggacctattctaactcccttgtcagctctgaaagttttctcattaatattggactgccaacagtgagttaagagatcttgggcccatattctctttccttcctcctttcttaatagaaactgtggagttttccgcaagttgcccttcccaattccactagttatatctgtagtttataatcctgtttttaaggtaccaatgtcaccccttcattcaatgaatacttactaaatgcttactatggacaggtgaagttctaggctctggggatacaaacaaaacaaaggcccttttttgtgggtcttatgttctgctggagataaacaatacatcaggtggtggcaagtgctctgaagaaaaagtaaagcaaggtagtgggttgttcctttatggaagatggtcagacaaggctactgttaatgtgttatttaggcagagaactgaataaagtaagggtacaaagtatggtagatatctttgggaagagcaattccatgaatagggaaaacctagtagaaaggcccaaggcagcagtgtgcttggcatgttgaacagcaaagaaaccagagtgtctgggagcaaggatgacaatctgctccatttctcttcccaaaaggaatagcagtaacacacaggttaatgcccattgttaaaaaagagttttgaagtgaggcctttggagggccacagaccagaaaaagaggtaagtggattcttcttactacagcaattgccaatatttccacattaaagtttggcttgaatgtttgcatctgtaggccagctttgggaaggatgttgcaatccgtgatgactgcagggttattcaggccacattttaattttagagaagacacacaacaggaagtttcccctttgcttttctagacttttctcacttaaagagagtgtggttttaagcctaccaagcaccttctctgagctctgcctactgccacattggcaaaactgctctcaaccagctccttaccaatgagcctttcagtatattttcaggagacagggcatgtggacaacaccctgtccaggtggaattgtcagctctcattataaatcgtagaagtcagtgagcccatatctatcttaaggcctgggtagcttcttgaagaagaacaacctgtgaggaagggttttttttttcaatgagaagtgaataatttttataactggagcagggaaataagatcatttaatctgacagagagcttgaagagcaattaagttcatatcacctgatttgcatagcatgtaactgcttcactccctattgctccggtctgaaaatttctctgttcctccctccctttctctaccactctcctctccctctccctgtccccctctttcactctctctccctccgttccctccgttcctccctctccccccgttcctccctctcccctctctccctcccccctccccacctctttgtgtgtcttgtgttttctctttctctaaggaaacataggtttaagttctttttagggttcatgataattgcaataactaccacttactgagtgctcagtatgttccaggctaggttctttacatcaggtataccttgctttattgtgctttactttattgctctttgcaaatattttatttttaaaaacaatttgaatgttggtggcaatcctgtttcaagcaagtctatcagagccatttgtccaacagcatgggctcacttcttgtctctgtgttacattaggaaaattcttgcagtatttcaaacttttttttctttcttacatctgttgtggtgatatgcgttcagtgatctttgatgttactatgtaattgttttgcggctccatgaactacacccagacaagatagcaaacttaataagtaaatgttgtatgttctgactgctccgccgatcagccattcctcatccctctccctctcatgcttccctattccctgagacacaacaatattggaattaggccaattaaaaacccgacaaaggcctctaagtatgcaagtgaaagaaggagttgcatgtctctcatgttaactcaaaagctagaaatgattaagcttagttaggaaggcatgttgaaagctgagataggctgaaagctaggcctcttgtgccaaacagttagccaagttgtaaatacaaaggaaaaattcttgaagaaaattaaaagtgctactccagtgaacacacaaatgataagaaaccaaaatagccttattgctcatagggagaaacttttagtggtctggatagaaaatcaaaccagccacaacattcccttaagccaaagcctaatccacaggaaggttgtaactcttcaatctgtgaaggctgaggaagtaaggaagctgcaaaagaaaagtttgaaactagcagaggttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaagaaactagcagaggttggttcatgatgtttaaggaaataaaccagttccatgacataaaagtgcaaggtgaagcgacaagtgctgatgtaaaagctgtaccaagttatccagaaaatgcagctaagatcattgatgaaggtggcaacactaaaaaacacattttcagtgtacatgaaatagccttctgttggaagaagatgccatgtaggactttcatagctgcaaagaagtcaatgcctgggttcaaagtttcacaggacaggctgactcttttcattaaggactaatgcagctggtgaagccaaggctcattgaccattctgtaaatcctagggcccttaagaattatgcaaaatctactctgcccatgctccatatgtggaacaacaaagcctaagtgacaacacatctgtctacagaatgttttactgaatattttaagcccactcttgagacctactgctcaaaagaaaagctctctttcaaaatatcactgcccattaacaatgtagtaatcacccagcagctctgatggagatgtgcaaggagattaatgaatgttgtttccatgcctactaatacaacatccattctgcagcccatggatcaaggaataaagtaactttccagtcttattatttaagaagtagatttcatcaggatttagatcccatagatagtgattcctctgatgaatctgggcaaagtaaatttaaaaccttctggaaagcattcaccaatctagatgtcattaagaatattaataatttatgagaggaggtcaaaatatcaacaaaataacagaggtttgaaaaagttaattacaaccttcatggctgactttgaggagcttaacccttcagtggaggaagtaactgtagatgtggtagaaatagcaagagaactagaattagaagtggagcctgaagacgtgactgaattgctgccatatgaggataaaagttcaatggatgagaagttactttttatggatgagcaaagaaaatggtttcttgaggtggaatctactcctggtgaagatgctgtgaacattgtggaaatgataaccaaggatttagaatattgcataaacttggtttactaaagcagtggccgggtttgagaggagtgactccaattttgaaagaagttctgagggtaaaatgctatcaaacagcatggcatgctacagagaaatttttttttgtgaaaggaagagtcaattgatgcagctaacttcattgttgtcttcttttaagaaattgccatagccactccagccttcagtaagcaccatcctgatcaatcagcagtcatcaacatagaagcaagaccctccaccagcaaaaaagggtatgatttgccaaaggctctggtgattgtcagcattttttagcaataaattatttttaatgaagggatgtataccttatttttaggaatcatgctattgcacacttactagactacagtatagtataagcaccatgaaaccagaaaaaattgtgtggctcagtttattgtgatacatattttattctggtggtctggaaccaaatccacactatctcctaggtatgtctgtatgttacctcattcaaccatcacaacaaccctatgaggtagatggtatcactattctcattttgcagctgacattttcaaaatgcaaactgagcttcaagtttgagattcatatagtttaagtttcttgcccctggttacatagcaaagctccaacacaactgactctgactctgtcctgactctttgacctctactttgtactctctcacctctattttgtactctctcttcccaattatagttggtgaaggaataaatgaaaaaaaaagttctattatttaatatgctctaaagggcctggtagccaaaattcatccattcattttaaaaactgtcattgagctgctttatcttgcctcgtgccctactcagccctagtctctagagaggaatcacgaaaaaaaatctctgctgtcagaaaagttatgggacttgggggtatctggaaccaactaacactcaggatgcagtgtaataaagactgtggtgaagatgtgcattggatgctgtgggagcccatggaaagggaacttacctctctattgggaatcagagaagtcttcatacagtgggtaatgcatgatgtgagtcctgaaaatcagaggagtagattaattgattaaccttctgtaagaaaagtcctcctataacagaggactgcaaattatttggcttaaatatgatggagaggagttcatttttctctcacataaaagtctagcagtgaatagtccaagatcaatgacatacttctgccatcctcaccacttggcttcagtttcttgatcctagatagctattccatttgtccccatttactagccagagagaaagggaaaaaaagacagaatgtaatacagacagcttcttcataaaagcatgacccagaggctttcatgcattatttctacttgtattctgttatctaaaacttaatcacatgtccttacctagctgcaagggagactaagaaaggtaggcatgggtgcccagctaccattcagtgacttccattagtaaaagtaagaaggggaaggtgggtaccagtaagcaattagcagtctcttccataaagggtaagagtgaaagtgttctgtgtatagatcactctggatacatacaggaatgagacaccagagaaattaagttccataaaataaccaaagaactaaataactaagagactaaagaactttaataattcagcatggctatagtggagggtgaatgtaggggaatagtggaagatggggaagatggggctggagatttcaggatgtggccagattattgagtactttgtgtgctaactaaggaatttggcctttgtcccgaagacagtgaagagtcattgaaacattttaagcagtggagtaacacaattagattagagttgagaaagatcactctacctgcacttgggtagacagattaaagacaggagtggctggagacagaaggaacaattaggagactattataatcatagagagacatgatgagactcaaccaagtcagtggtagtgagcagaggggacagattagagagacattaaggaagtataattgatagaacttggtgactaaatggatgtgggatgtgagagagggggaggattttaagataataatgtccagatttgtggcttggacattggcattgttttagataataaaaaattttaagggacgaaagtgtttaattctagaaatgttgaatttgagatacctctgggatatccagaaggcaacattgagcagttagttagatatattggtatagaaaccagtagagaaacttggtagtgcaagccatgtgagtggatgacacggttgagaaagcgaatgagtgcagacaagtgagatcattagaaggttgaggacataatcctggagaacattaaatttcagagagagccagtgaaagagacgacagtgttcagagaagcagaaaggtaaagagagaggaatttttagaaatggattggttaaatgtgttaaatgttggagcacagtcaaaataaaaattgaaaaagtacctgttggagtcagcaatcagcaggccagtggtgatcattgtaaaaacagttacagaggagtgatgtgggcagagacaaggttgaggatcaactggaggatgaagaaatggagacttaactgtctggaaagtgtagaagaaaatgaatgtgatggcagtggagagtagcttgggttcagacaggagagacttaagttcatttaaatgcttttgagaaacagtattgtaagaaaggagatgaatgatggaggaaggtccctgagaaacaggaagagatgagatgggatccagagcataggtagaggcattctccttagaaagtgaggagagataaagtaggtttataagtgtggatgtcaatgagtttgtcagtatggggacagaaagttgaagttgtttactttatttatttatttatttatttatttatttatttatttattttgagacagtcttgctctgttgtccaggatggagtgcagtggtgcaatctgggctcactgcaacctccaccttccagatttgagcaattctcctgcctcagcctcctgagtagctgagattacaggcatgctgcaacatgcctgactaatttttgtactattaatagagctagggtttcaccatgttggccaggcttgtcttgaactcctggcctcaagggatccgcctgcctcagcctcccaaagtgctgagattacagacatgagccaccgcgcccagctgaagaagtttacttctaatgacctcccttttctctgaagtatgaggtgacgccatctgtgagggagggtgtctatggtctggtatattatgaatggctcagcaaggatgtcttctaactgagcaaagggaaataatatatgatgcgtttatctccattaataacactcacttgggttcaatcggaagagattgttggatggacagatgcatggatggatgcctataaacataataaatatgtattctgttttcctccactcaatgttttcaaaacgtttttttagaagtttagttcagggttaaaattttcttgaatcccatctgcattaagtaagtatattctcatttgttattcctcttcattattctagaccaacatttttcagccttggtattattttgacattttgggccaataattcttgttgtggggactgccctgggcattgttggatgtttagcaggattccttgcctttccccactagatgccaaccccccttccacagttgtgacaataaatattttcacagatgtcatgaaatgtcccctggaaaatagaattggccccatttaagaggttgtattcaaaaccaaatggaagggccctggagagagagagagagaagggggatttaagctagacaaatactcatgtacatttatcagttgatcatgacaactatactcatagacatgatcttcttttggcaaattagacaactgaggctcagagaggttaaatgacttgcctaacatgacagaggccataagtgatagagctggggtttgaactcatgtgtgttagatccctacaatttaggttctttcttaagcaacaataaaaaatattttagagggtgtccttgttttcatttttattatgttttaaaaaatcaaactaaacttaaaattcagcacaaaaatttaaataatatagaagtgtatagactaaaacaggaatgtatctgttgacattcctctgtaatcctattcactttcctagaggttatgattgtgattgttaacaatttaatgtgtatgcttttagacccttttctttgcaattataaatgacaaaggacagtgcattcatacacacacaaaactatttttgaataatgacatcatactatatatactattccataagctactttaaaatatttaatctttccacctcagttcttacaaatctacatcaccaccttttaacagttgtgtaatattcctcagtgagtgaaccacaatttatgtaactttcccatgttaatagatatttatgtagttttattttttttatggtacatggaacttgcatagatatcagtgtgtgtatgtgtcaggatttctgcttaataggggttttaaaagtagggagatcagaggtcttgcctatttaaaatcatgattgctactaccagattgacccccaatatggataaaccaaatcatcctcccaataacagcttataaaggtgactgtttttacccacttctttgtcagtttaggacaatatcgatttttcttaatttatcagtctaataggcaaaatgtgatatcttgtttgaattgtagttttataattattagtgaagttgatttttatgttcacaagctatttcattttcttttcctttgtatgtccttttcagtggctggtcgcttcaaaatcctcccctctccaggccactcccacactaaactcttcacctaaggcaaccactaatcagttctgttagtataatttgtgtttcctaaagttttgtataaacggaataatgcagtatatacttttcttttggtctggcttctttggttcagcatagttattctgagattaatttaagttgttatagtgagtcaatagttcattcctttttagtactgagtagtattccatcatatataccaaaatttggttgtctattcactagttaatggacatttgggttgtttcagtttgggtctgctgcaaacatttgtgtacagtctgtacgactatatgttttcttttttcttgagtaaacatgaaggagtagaaatgactgagtcacatagtaattatacatttaatttttaaagaaaacgtaaaacatttttcttaagtaactgtatcattgtactttctggaagagactgtaaaactcatgttaattctgtatatgtttggtggaatcctccagctaaactctctgggtctagagatttcttctttggaagtttttaaactatgaattgaaattttttaatggttataggactattcagatgatctatttcattgggtggtttttttttttaattcactatgacattgtatgattttacattcccatcagcagtgaaagttccagttcctccatattcttttcaacatgtggtatggtcagtctaaaaaatttcaaccattctaataggtgttcagtggcatcgcatcatgtttttagcatgcatttccctattgacttaatgatgttgaactttttttatgtttgccatttgtatgttttctttggtaaagtgtctattcaaatattttgcttattctttaaaaactgatttacttgttttcttattattgagttattgagttttgggagttctttatataatatatatataatacaagttctttatcagacatatgatttacaaatattttaactcagtctgtggtttttcttttcattcttaacagtgtcttttagaaaatcatgagttttcaaatttgatgttcagtttattgattattttatgaatcattgtatctaagatatctttggctaacctaagattacaaagatttttctcctcgaaattttatagtttcagcttttaaatttgattatagcccattctgagttagttttcttctgtggtataagatacgaattgaagttttttttttttttttttttttgcctatgtatatcacattgttccagtaccattgctgtcctttctccactgaattgcctttgtaaaataaataaataaatttatctgtatagatgtgggtctatttctgggctttctattttgttccattgatctattcacctatcttgacatcagtgccacactgtcttaattgttgtagctttataataagacttgaaatcaggtagtgttagctttccaactttgtttttctttttcaagattgttttggctattctaggttctttgcatgtccttatacatttttgaatcagcttgtcaatgtctacatacaagcttactggtatttgggttgtgttcagtctgtagatcaattttgtgagaatttacatcttaacactattgagtctttatacctgcaaacaaaatatatctcagtttatctagattttcttaatatttctcagcaatattttgaagattttagtgtacaaaatctctctggcactttgccttgcaaattctcacttccttgtctttcccatactcccaattcagtcttctcaacgtagggatactactgggttccacttgggttccccttcctgcactgcagcctgcaaaactctaagctgggaaactcatagggctgacctcatttgtttttttcagtctctcagcattcactgtccttcactgctggatttccaatgcctttaaaactactgttgcatgtatttttcctagttttgttttgtttttacttgtttcaggctaaatgagtaaaactagtttctgtgccctatcttggccggaataagatagtagctgtttgtagtagtattttagtagtagtagttagtagctgttaatagtagtagtattttcaggtgacagtttggccttttacattagaattgcaaatgtatttgttttttgcctcagcaattccagtccctcttctaggtggtggagatagagcagtgaacatgacagacatgcttctatgttgtgtaaaatctagcttggagacagacagcaaacaaaatcaataagtaaaacgtgttatatgttagaaagtgataggaaatgctgaagagaaaaaaaattaaaatggaaggaagataggaatgcttgcgtagagggaggcatgtcattgttttaaatatattgacctggaagggcttactgagcagagtatgtttgattagaatcctagaagaatggatatctgaaggaagatcagtctgggtggaagaaacagtcagtgcaacgacctcatgtattcgaaaaatagcaaggaatatttgtaacaactactacagtgtttgagctcacaaaatggtggctctttagactattattactaatgatggtggaattaggaatatgacctagaaccgtatggcctcaacattaatctgcttgctgttaagttacattttgtcttccttacaatcatgaggcatatactcacggtttgtgattgttcatgcattgtttcttatcattgtccaccttttacacagcttgccttgtgttctcaatcatgttatttccatgcccatgtagtctgtgttgacccttgcctgatgggatattgggctctgacatttctctttacactaatcactggggttgattttgttagtctcactggctagacagtggtctcctttctccatcacatatgtgtatcatcccatagtgtatgcacttgggctaaaaggttggtctccatggagactggaaaatccttaagtacacatgagacattatataaaaattctaatcacagctccttctgcatgccttcggcacttcttatagcatccaaggcactgtgttgttgctttttaattttattttactttttattgaatagataatgtaccatggcatgaaattataaaagaacaaagtgacataggagggaaaacacagttgttctccctgtattccccagccaatcattagtcctaccttgagacaaacaatgtaatcagattctttggtatcccttcagaactatttaaggcatatgggcatgtaattgtgtttagtctccttccatgtcctacccccacccatagaaggcaccttgacagctcctttaatttctttcttaccacactctgtgaagtgggtgatgctgtccctatgttacggatgagaaagccaaggctcagagaagtgaggtgacttgcctaaggtctcccaggaaggacatggaaaatccaggactaatgccatcttttataggcattttttcttccaaactgagaagtgccaggttctgtgccttgagcatagtaggagatacctaaacatttacctgtagctagagtgattaagaaaatctctgattctttgagtcatgttagtattcacgttacaaactctagatataaggccaacaagcatcaactggtgggtagcattcagaagacaaaaacttgatctaattattctctagatatcttccttctttctccacagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaaggtcagtactgaggttcacctttagcttctgaatggtgattagacacaaagaggatatcgaagggcagaagcggtggcatgaccatttttctctctataaaagtagacctttcctggctcctgagcttaaaagcagccagggtttgtagtttgtgctcagagaggggattaagcctttgacagcagataggatggtgatgagcttgtaaaggaagttaccacgtggaggatccctataaggccagtgcaggatccaaggtgttcttagatttatgcccccaatatattgaaatgggtgagcaaggtgaatgttgtgaaattttaaattcaaatatagcaaacacggattggataactactatgtgccaggtactgtgctaggtgaaattaagatacattgcttgccctcacagaagaaatggagacatagataagtgaagaaataaatgccttcagtggaataattgctagtgtggagactacacccattctaaatgtgcctctgccctcctactccactaagaccatttttgtcaggtttgccaataatctccatgaggccaaaccaaatagctacaacattgttctcatcatactcagtttgtgagtagcatctgacacagttgactaactcctccttcttgaaacactttattcacctggctctcaggataccagattttcctttaatctcaccagataatccatctcagtcttctctcctggttttccttctcttcccaactttacatgttagaaggtcccagagcttttttcttagtcctgttctctgatcatgttcttttcctgtgtgatctcattaaatttcatggttttacatatcatttaaatgctaaagatgatttccaaatttatctaagattgatatcttgcctcttttgtcatatcaaatttcctgctcaacagttctccttggatgactcatgggcatctcagtttacactgtgcaaaacataacttgatgcctgactctttcttaacctgctcctactctggtctcctccatctaagtaattggcagcagcagtcatccagttgctaaggtcaagaactttggaatcatccttggttactactttccctttttccttcatattgaatccattggcaattcttgtcagctctacctgcacattatatgctaacttctactactgcccactgcttctatcactgtaagccactattatctcttacctggtatcattgcttgccttcttccttgcctgtaattcattctccccggcagccagtaacagcacatcctttaaaatatggaaatcaggattctgcaagcttcccaagcacacatcagcagccggctcccttactgtctgaatcatcgacctctctccatttccaaaatgtcgctttctaacaagctgacattggacaaaccagacgtcaaagggcagcgggtcattatgagagtggacttcaatgttcctgtgtagaataaccagataacaaacaaccagaggattaaggctactgtcttaagcatcaaattctgcttggacaatggagccaagtcagtagtccttatgagccacctaggccagcctgatggtgtccctatgcctgacaatactccttagagccatttgctgtagaattcaaatctctgctgggcaaggatgttctgttcttgaaagactgtgtaggcccagaagtggagaaagcctgtgccaacccagctgctgggtctgtcatcctgctggagaacctccactttcatgtggaagaagaagggaagggaaaactctgggaacaaggttaaagtgagcccgccaaaatagaagctttccgagcttcactttccaagctagggaatgtgcatgtcaatggtgcttttggcactgctcacagagcccacagctccatggtaggagtcagtctgccacagaaggctggtggttttttgatgaagaaggagctgaactactttgtgaaggtcttggagagcccatagcgacccttcctggccattctgggtggagctaaatttgcagacaagatccacctgatcaataatatgctggacaaagtcaatgagatgattattggtggtggaacggcttttaccttccttaaggtgctcaacaacatggagactggcacttctctgtttgatgaagagggagccaagattgtcaaagacctaatgtcccaagctgagaagaatggtgtgaagattaccttgcctattgactttgtcactgctgagaaatttgatgagaatgccaagactggccaagccactgtggcttctggcatacctgctggctgaatgggcttggactgtggtcctgaaagcagcaagaagtatgctgagactgtcacttgggctaagcagattgtgtggaatggtcctgtggggggtatttgaatgggaagcttttgcccagggaaccaaagccctcatggatgaggtggtgaaagccacttctaggggctgcattaccatcataggtggtggaaacactgccacttgctgtgccaaatggaacacagaggataaaatcagacatgtgagcactacgggtggtgccagtttagagctcctggacagtaaagtccttcctggggtggatgctctcggcaatatttagtacttttctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatctttactgcaccctggatttgcctacattcttcaagatcccatttgaatttcttagtgactaaaccattgtgcattctagaatgcatatatgcatattttgcctgttaaaaaaaaagtgagctgtgttagcttagttctcttttgatgtagcttatcctgattagctttgtcactgtttcactactcagcgtggaaacaagatgaaattccatttgtaggtagggagacgaaattgatgatccattaaatagacaataaaagtgtccattgaaaccatgaaaaaaatggaaatcagatcacatcattccctctgtgccaaattttcagtaacctcccttcatacctagaataaaatttgcattttattcttcattatatgactgttgcttatttctgtgaccttcatttctgaactttgctctctcactgtctcttttgctctctactgtaatctcattgttcttgcaggtccttacttgtgtcaaacttacctaagggcctttgcatttgctactctcttggccctaaacattcttcctccagaacttcacaaggctcactctttcattcaggtgtctactaaatgctttcttctcatagagaccttttcttaacattctacttaaatagttctttctcctcctccaatcactccctatccctttatatggcttaatgcaactcatatcccctgcttctgtttgttcacatgtttattatctctctctcccattagaatgtaaaatctatttgattaccaggccctagaacaactcctggtatacatatcatgtatttagtaaatattctaagaatgaatgagtggatgtataaggaatgatgaagagattatcacttaggttaagggatcaactctttgacagaggaggtgagctggcattcaggagaaagtggaggggaacattggatgcctgtctgttgttccatagtctcatttttacagaatgggtttgtttatttacagtctccccaaatataaactctatgccagtggccacttgttttttttactatatccaaagcatgggcacagtgccaggcatatagtaattccttaataaatgagtgcaaaaaatgaatgaactgtgtgtcagtagatagaaggtctaatttaatcttggctactagcctgctgaataacttgagctagtcacttcccctctctggacctcaatttgcccctctgtggtgatgagggctttgggacagaagatctccaatgaggttacccagtctagacattttttatttttaacttttttaaaaactgagctataattcacataccataaaatgcaccattttaaagcgtacagtttaatggtttttagtaaattttgtgcaactatcttattccagaacatattcatcatcccagaatcccaatacttttaaatttacttctcccccaacctctgacagttactgatctactttctgcctctacggatttgcctattctgaacatttcatagaaatataattatagaatatgtggacatttttgggtggcgtcttactcttagcataatattttcaaggttcatccacattgtagaatgtatcagtacttcattctttcttatggacaaataatattcctttgtatagatgtagcacattttatttatccattgatcagttgatggacacttggattgtattcattttttggttattataaataatgccgctgtgaacattcatgcacaggattttgtgtggatgtctgtttttaattatcttgggtatatacctaggactggaattgtaggttatatggtcggtctatattaaaacttttgaagaattgccaggctgttttccaaagcagctgtacctttttttttttttttttttttttgagatggagtctcacagtgtcgcctgggctggagtgcaatggcgcgatctcagctcactgcaacctccgcctgccaggttcatgtgattctcctgcctcagcctctcgagtagctgggattacaggtgcataccaccacaccaggctaattttttgtatttttagtagagatggggtttcactgtgttggccagactggtctcaaactcctgacctcatgattcgcccacctcggcctcccaaagtgctgggattacaggcatgagccactgcaccaggcctcagctgcaccattttactttcccaccagcaatgaatgaaggctccaatttcaccacatcctcaccaatactttgtatagtctgtcttatttattctagccatcctatgtgagtgtgaatccataatctcatttaatgttcagcactcccatgcgaggtaggtatgctgaattctgttttatagtgaaggcactggaagctcaaagatgatgagtagttttcccaactaacacagctactaaatgacagaacaatttgcactcatctatcttatcctaaagcttatttatttactataatatcacacttcctataacctgtctgaacactgttctgagaaggaaccaatcctgctcaccagtagcatctcattatctcactctgaaatttgatatcccttttgtatatagtatgtcagtgactcctttcaccctcgtcatggactccatcacacctccataactaagccctgattattccacttctttaacctctcttgaatctgcctctcttttctgacgcagctctagtttggatccttctcaacagcggtcccctagcttgtctttctgccaccagtctttctggtccaagctacttttcattggaacgagcctatttttcattacttttcgtaatgaacccaaagggatgtttaaaaatgcatatttgataatgccacttctccccacccccagccctctgccccccaaaatcattgtcttctgtgactcaaaggcagagtttgtattcctgagcatggcattcatggacttcatgatatagccccaacttattgcaacaacctcacctccagctacccacactttttcatctgtaattggtccctatgctcaagccaaaccaaacttttaattatattttcttaggcaaagcatggtctttcactcctccaagttgttttttgtttgaatgccctttctactttgctccaccttttggaattcttcaaggcccagcttaaaagttacctgttttataaagaccctctctaatccttgcagtcagtattagtactgtcttactcctagcacttatttgcatgaatctacatgtattataataattgatttatttctattactgtaccagtgtgtatcctctcaaagcttctccccacctcttacccacccatggaagagaggcctccactttaagggttggccccacgcctatttatgaggcctccctgtctcatcctgattcactcccagttcttcgtagtccctgagacttgtctgtgtgttttcctgtagaaatgggtggctggttagggaaaggggatggcaccgaacttttattacctgacagagcaatgaactctcttcagaaagagtaagtagactctggaagcagacttcaagatttgaaatttggcgtttccacttagtagttttgtgacatggagactgcgggtgtcttagattccttatctgtaaaatggggctagtaacaatgtactactttatagagctgttttgaggattacatgagataatccaggtaaagcacttagaacagggtctgccatggtataagtgctcaagtaatggtatgtgttgtctttatcagtattattctcattattactgtcattgtcactattatcattatttttattcaccataccccagaacctagaaatagtttccctgctgaaaggcctggctccgaagtcatcatggcttctatcattacatttcctattttcccgagccagcagaagatactttcctgagtggaaggtagcagcctctctgaggctgtgtatgtgggtcctctttatgaagattggctctcttgagatggtgatgttactctatggcctgtagggcacaggcaacctttatttccctaagggagagcagagatggagtcacttgtccagaagaaagtattcagataggaacatgcagctgagatgttgggctaaagcatgtgagggaaagaatttatgtcaccatgcactttattgtttggagagagtagatgtgcttgagttactcctgagtgctgtgtttaaagatggcctctgccacaaggcacgtcctggaagccagaggctctagttatttggcgctcttgtgctcatgttcatgccattatttgtgagcctttggtagttttttgtttgatggcctctgtctggttgcacttatgctagggttaataaataaagggctatgtgtctactttgggacaaaattagggagactataggggaactccccttggttccggcccctttggcagtggcatcagtggtggcaaattcccaaggagaataaaactgtctaggggacaaaaacctttgcagcaagacttcccccatggaaacttttgcctcactgcccacccaccacataatagtgtaaataataaccaccaattaatgagtgtctgttatgtgccaggcactgaaataagtatacctaccatctcctgtaatcctcaccataacctcatgagaccggtattctttattattcccgttttactgaggagaaaatttgaggtacagagagaatagggaacttgtacgaggtctcacagtcggtaagaagcagaactgagattcagacctggccacctggcttcagagcctgcatttcttttaacattttattgcgaagaattccaaacataaacagaaattggaaacaaacgtattgaactccccacatttcagcatttaaaaacatatatcaagtcttatttcatctatacccctacccgttcccccaacctactcatcatgtcatttcatttgtaaatgtttcagtgtatatctctaaaagaaaggaactcttttaaaagcaaaaccgcaatatcatcatcatacttaaaataaaacaaaacagtgattccttaagatcagctatccagtcagtatccacattctcctattatctcattttgttaaaaaaaatatcaagatctaaataagatccatgtattgcaattggttgatatatatctcaggtttcaatttgctggccggaacctctgttctttttttttattattattatactttaagttctagggtacatgtgcacaacgtgcaggtttgttacatatgtatacatgtgccatgttggtgtgctgcacccattaactcatcatttacattaggtatatctcctaatgctttccctcccccctccgcccacctcacaacaggccctggtgtgtgatgttccccttcgtgtgtccaagtgttctcattggaacctctgttcttaaccactgcactcgaagttttttatgactatggaaggtgacaatttctttacagcaggcattctcaatctggggtttattgacagcttcagaaggctctgtgaatcactaaaaaattagttttcaaaatttttgctatatttgtgtgggttaatttttctagagagatggtccctaggtctcattagggtctcaaaagctttaagtaagtctcagaaccactgaaagacatgtactaatgtcagaggaaattgtagaccacaaaagctggggaaagaacagttggaggtttccttccgggttggagaacgaagttaaagtatgttatgttgattaacttaaaatttgagagaccttaacaaaatacttttcagagaagtggttaagaattaactgatgatgtcttcatttgcaaagaatagaatatgccattgactggggactttaagtcttttttgagtgacatattcctttaataaaacctcttggtttactgtggcttattgaattgtggtggtgaaaatcatacgcggatcttgaattccctatttggattggatctgtggctttacatgaactgggaagggtagagaatgattttgtgggatatagttggtttgtgccacagtgacataactgctttgaaaatgtatacaaattttcaaaattaagtatgtatgcatgtatcaaaatgaaaaggttttaaaagttatcattaatcttccctcttggcaccaacttttcctagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggtaagtgcttgggaatcccatgggagccagagctgaccctaactacttttcaccttgagatccttctgagtttggagatatatttaagtggaaatatgttccagtttactaccactaatattggaacagtgggcaagatcacaataatcagtcacaataatcactagaatgtaagctccatgagggccgggattttttacctgttttgttgacctctatatcccaagtgctatgtgcctggcactgtactaattgctgatatactatttcttatcctcacaatcccactgtaaagaatgtattattcttaatattttctttttttttttttttgagacggagtctcactctgtcacccaggctggagtgcagtgacgtgatctcggctcactgcagcctccgcctcctaggttcaagtgatttccctgcctcagcctcctgagtagctgggactacagacacttgccaccatgcccggctaatttttgtatttttagtagagacagggttttgccatgttagccaggctggtctcaaactctcgacctcaggtgatccacctgccttggcctcccaaagtgctgggattacaggcgtgagccaccacacctggccaagaatgtattattcctgtttttttttttgtttgtttgttttttttaatttggaaatggaggctgctgtagataagtgacttgccaaagattcacagctaataactggcagagctgggatctaaatcttaccatgtctcacaggcaccaaagcctgcgttctttccactgaggcagaactatcactttaccttcctataagaagctatgaatctgtgaacccttgttttctcattctccctttccagtttgggagaaatagggacaaaggggcacaacttctgccaaactctggatttttgaaattattgcaaattcaaggtgtggctgacttcagcaaatttaattaactattgcatgttgagacttatgttgagagactggggctaatccagaggggagttttaggggacacaattctatgaagatagtaagatataatggacaaaataaggatttgagtatcagaaaggcttggatctaaatcctagctcttttactttgtagctttaaggaatttcacaatatagcaaaatgtaaaaccttaaaaaatggttaagaataatttatttgacaaatatttattgagtactgaccatgtacctggccccattctacatgccgaagacatagaaatgaataagacttatgaagtccctgtcctcttgaggtttagataagagggcttggcagactatggcctgtggacccgattgggcccactgcactgcctctttttatatagcctgtaagctaagaattcttttttacattttttaatgtttggaattaaaaaggaaataatattttttgacatgaaaatgttgtgaaattcaaactttgtccataaacataaatacaccccttcatttacatgttgtctatggctgctttcatgccacaacagcagaattgagtagtagcaacaaagacttcatggcctgcacagcctaaaatattaactgtctgacactttacagaaaaagtttgctggcctttaccttagattctagagtactgataagaaaacatgaggcccagaatgggaatcgggaggttgggagaaggtaggatagcaaggaaatggcaggaatggagttagtatacaaaatatttgccatgaatacttaaacacttggtggagcagtgtcacaggtttggttccaaactttctagagaaaacaaaaagagagaaaccaatggttatataactaagttcctaaggtaaaagcaagccaattgttcaggtaagccataacttttctggttttgaggccagggaaaaatttcttccatggattatttcatataacaacctcagtatgaaccaatggcattgtctcagagcacaatttagtaaaagctattcagtgtgcggatgggagggggtccagtacaatttctacaagtccagtacaatttccacaagtagttgactctgaatgctctggtttgatccactgatgctgatgtgatcactcatgcgatcacagttaatttatgtaagctgtttgtaccttggtttccagatctgtaaaatgggaaaacagttcacctgttagaattattattgctaggattaaaaggaatgacaaaatatctggcgtataatcagcattcaaaatatgatattgatttccctcccctgtccctcttctcactatgacttggctcttctgagacatagccaagaaaaggaaaactttaatgtagacctctgcttctgtttttaagtcatgtcgtgaccttcctatcaatctgggtagaaggttgggtaactcaacttatactcgtcacagtaaaatttgtcttgtctgttgccaagccttgagactggccagattctatcagctcagcgcacacagtaactcagccctccttccctccctcctgcaaagttcaatcccagtggcattcccctcttccccttcctccagtcctaccctgggctgctggcggcagctactctgatctaatggtctcagctaatgtaagtactgatctgacttgttcagtatcagcctaactatctaaatctgggcctcagctttgcctggcttcattttctgctttcaatcagttagcaacaggctggcacgatgcagctttttttcaaaaccccatgcttccagctttggctacagaaagcagaactgaggtggttttggccttggtggagaaccccccaaacctctggtatagttgcctctttgaacctaacctacactatctattcacttcttacttcctccttgctcccctcctgattctggctgcttctcctagtagattccctggcatctgaagagttatcggttaagcaaaagccacacacagctctgaccctgtgctataactggtagttgtttgctcctggtactggccagtagcctgaatggcagtattagagggagggaactgttacctcagccagcccagtctgtaccttgcagttgtcaccccatttcagctctgttgtttaggactttgcctgccatcctgaggatcagtacacaggctccattgcattagtgagccagctgtgccacagtcctgcccccatcttcaccccttgcattgacttaacatttgagtggccttaacattcttcacattttttctcagcaattaaaaataacaaaagcatggtgcatgttaaattgcttttttccatgacagtcaactttaaaataagaatcaatagtgtttgctgatggaattttatcaaggatccttttctgttccagacatgagcttgatactttcactcttctgttgcgtctaatcattgtgataggccttgtgaggtatgatttaccctcccctttttatagatggagaaacagaggctcacagacacaaaacaacttgctcagagttacctaggttgtaaggtgcagagatggggcttgacctcagcttcttgggttcaagattgggactctttttctttataccatatttcttcagcagcgttggccatcttctcctttctgtttttctaaggaccacttacttttgggggggtacaaaattatacaagcctatttttttctgccttcatttgagtttactgcctcttaggtgtcctggctttgcaaagggcaggcatgtagctaccgcaaagggatttaggactttcctttgggtaatgaagagggaggagggctatatcccatctactttacatgtatttgtttatttaatcaggtataatcatatgcaaagggagagacaaaaatgaaaagccattgtctctgccttccaaaggtttgtggtgacactggcatgcaagcagtcagtcccagccaatgtgattaatgttctagtaggggtgagaagaaattctagtaggagcatggagcaaggagaccttcattctacctgaggtattgagatgaaagtgaagagcacaccatggactgggactttatgacatatgggttgaggggcccttcttagctcctttcctctgtcttggctggaaaggaaagattgcatctggtggcatgcttttgggcttgtaaggccttgctcagtcacagagccattaattctccactgaggtgactaatgttatgagtggcatttgcatctactctaaaagtattaggaacagacttgctcttgcagtaatgggtgttgctggccattatccacattttcttgtttggacttatgctttaataatctactgtttggtttttattctctacttttcttggagcctaacgccaaattgttttataaggataaataatggctaaggaagcaggaaggctttaaggtgagcatggaggagtgtcatagaaaaaaagaggtaattctaggtgactgggggaatctacaagaggaatcaacctcctcctactctgtgccttcaggttgggtatagaggaatataaggaaaggtggaaaaaagttgctaaggttgaatactgatgaccatcaggtcccaagaactctgcaaatgttaagattctttggttatggtcatttgacagagattagagagagagggaacaggtggggcttgagaaggagatcaagtttgtagtaaaagccaggtttcggaccaaagttgaaaagaaattaaaaagaagtacagcttggtggaaagcctataggctcaagtgacttagtggttaaaagctcaggctcctgaatcttccagatgtgagtttgaatcctggctctgcctcttcctagctgtgggactttgggcaggttacaacctctctgaaccttagttttctcatttgtataatgaggatagtatttgcgcccataggattgctataacaacaaagtgagtcctctacatgcctagcacatcaagagtactcagtaaatgatagcagttgttttgccttcataggagactattactagctacttgatcttagttagttcagctttacttctttgagccagttttctcaactgtaagtggggacaataccaccattgaaggcaaggattttgcatggattaaattagattaggtatacaaagaatctggtaaaataatagaggcttaagaagtggtagtattactaggtaacaacctcttaggaaatggcagacatggaagatggggtgtctactcttctgtattcgaggccctttgagaagcctcaagcctaaaatgtagatggcataaaagagttcagagttatattttcaacccacaacctgtccctaccatgccaaacacctaggaagaggcgaactaacctcaaggtctaactcaagtctcattctgtccatgaagccttctgacaatcctaccccagttagctctcccttgattcacatattttggcacccaagattgaccctctaatgtggatgctggtttatagtattcacacttgtttcccatgaatatgacttatatcccccaactcagttttgagctcctagagggcaggggtcatttgtgtgtctttgtgtgtgtgtgtgtgtgtgtgtgtgtgttagagtgtagggttgggcacaaaagccctcacaaaacccccatattgaataccgttcaatttaggtttcagagagagaaaaagagagagacagagggattaattattttaaagcaggttaagtacatgtagagtacttcaaaaacagcctataaaagtcagctgggtctaacatttaagtcagtccagcaggccagcatggcacatgtaacgagcctatgtaacgagcctgcacattgtgcacacgtaccctagaacttgaagtatatttttaaaaaataaaaagtcagctgggagagatagaggcttatagacttagatcattggctcattcatctggaaaaacagtccaatccccatgttatactggtaaggaaatgatccgctgaaggtcacacagaaagttagttttagtattaatcatagaatccaggtttcttgactaccagttacatgactctcccctttctgcctcaccagtttgatactgtggcttaactgtgactgagacacattagaggcaagagagaacaacatcggtgtcttcagccaagaaaatcctttgctgctacctcaaagctttacttgtaatgaataatcatttggaggtagcaataaagggcccaagaggaaatgaggttaatgatgtttgttttccaaggccctaggttcatgttcattaggatgtggctataacttgggaatgaatagggttcatattttagggatgtcatctggttcactcatcaaggcatggtttcaggtagacatgttttccagctctaacagtccagcatatcatttctttacaattactgccttcccctccacaactccgcctcccagcagtaaccagtggaaatggggcagcactctcagctctgctactctgtggggtgcagtgaggaagcaacatcatatggcttaatggtcctcaatcttggctgcacatagcatcacttgggaagcttttaaaaatacccatgctcaggatccatcctaatcaataaaactaggacgtatgaggttggggtccaggtactttacaattttaaagctccttacatatttctaatgtttcactagggttgaagaacagtggtagttgggactacataggtttcagaaatcagatggactgatcaactatgaagttacttttcatctctgagtctctgtttcctcagctgtagaacggagataatactttctgtcttgcaagattgtggccagtgttgaatgagaaaatgtgcataaagcactgagtacagtatcacagtacctggaacagaacaactgttcaataaaggttagctaaaaaaattttgccagtactattgtattaccattactattattattataatttataatttttatattaccaatgataacaaaacagcagacaactggaaaggcagtgggtgtggaaacaggaggtatgggtttcagccctcactctaccatttaacctatggttgtggatgaatcagtttacttttctgaacctcagtttccttctctgtaaaatggggataataagacctatttattcatctctctcaagcttattgtaaacattaagcagttatcgtctgggagagtgctttgaatagtataaagtatattagaagaattggattattattatcattttggttaattttttctgctgcaatgctgtatacccagtctgatgttaaggggaatgacatgtccagaacgtaagatgcagactaaatggagagacaattcatatgtgtgcacatgaatagtgttttgtttcttccttaattagaacaccaatcacactgtattatcattatttctttacatatatatcttgctcaccagaatggctagatggatgaattttttaaaaaacgtacatattaatatataagaacttcacgaacatttacatggatgtgaattacatatacctactagggtgttcagagggttgagattttagctgggtcttgaggaatgattataatacacaggagacataagaatagggacacatatagggcaagaagcaggacagagtctgacgcttacttacctctgctgtatactaggcattgtctataggtcatctaattgagtccttaaaatcaccttgtgaggagggtttttctttctttttttttaaattatactttaagttctgaagtacatgtgtacaacgtgcaggtttgttacatatgtatatatgtgccatattggtgtgctgcacccattaactcatcatttacattaggtatgtctgctaatgctatccctccccgctcctcccaccccatgacaggtcctggtgtgtgatgttccccttcctgtgtccaagtgttctcattgtacaattcccacctatgagtgagaacgtgcggtgtttggttttctgtccttgagatagtttgctcagaatgatggtttccagcttcatccatgtccctacagaggacaagaactcatccttttttatggctgcatagtattccatggtgcatatgtgccacattttcttaatccagtctatcattgatggacatttgggttggttccaagtctttgctgttgtgaatagtgccacagtaaacatatgtgtgcatgtatctttatagtagcatgatttataatcctttgggtatatacccagtaatgggatggctgggtcaaatagtatttctagttctagatccttgaggaatcgccacactgtcttccacaatggttgaactagtttacactcccaccaacagtgtaaaagtgttcctatttctccacgtcctctctagcacctgttgtttcctgactttttaatgatcaccattctaactggtgtgagatggtatttcattgtggttttgatttgcatttctctgatgaccagtgatgatgaacattttttaatgtgtctgttggctgcatgaagaggaggggtttttatactcatttcgcagatgaggaaatttacagtcgtagaggtgaagtacctgtctagggtcctacaacctggaagcagcagaacaagatctgaaagccaggtctacaaaactccagactctgtctcacttagaagtaagagtcaagggtttgccttaatggggcagtaggcagaccaatttgattagagtagaactgatagttaaaatccagggttactgcttgggacagtaatatgggaccagctcaaggagggccttgattttctgtgaaggagtttaaacttttatcttctacattttagagctgttgggaaagtctttaaagagcagaaaaacagtgtaaaaatacttaaattaaattttatagttgtatatgtagattcaatttagtatgtttttacatttactgtaaatatttttgtagaaaaaaatggatgaatataaagatccactgacacccttgcatagttatgtacatgtctatttcagtatggtcttcatcaggccatgagcactttctgtggacttttttttcacttgatattattttgtatgcctgtttttgttttgacctggtctaaatttttggcagttcacacataatatgtattggttaaatgcttgtatgaattgaattgtttgtttagcctttatggttaagtctgattttttttctgataagatgcatgtttttgtgccaattgctttttcttaagtgttttttttgttttgttttgtttttttgtttttttgcctcttggattagtccatttgggcctgttcccaaaagcaaaattactggatcaacgagtatgaaccgtctcatatgtatgattttgtacttcatccacattgttccagaatccttgatgccctctagataaaataagcccagttcacattgccaccagcaatgtgtgagtttacctgtttcactatagtcctactagaaccatcttatttaaaaagtgtttatatttattttgtactaactgacaaggaaactaaagacacagaggcaggaaagtgagttagaaaacaactataatagtcaaggcctaagtgaaaaggacctggatatcagtgatgatgaatttaagcaattcaaattcatcatcatcagacatttagtaagcacctactatgtacctggccctgcactaaacatattagtacctgatttaatcctcccactatctctgtaagataatatattgtggatctttattatatagctggggaaactgagacttagggaatggatatgacacacccaagatatctgaaactccagagctggggttcaaatatagactttctgaagggacagttgccagaaaaattacaaaaaaaaaaaaaaaaaatagccagagttgttagtcaccaagaagaaatggaggccaaggaagttggcccaggtaactctcatattgggtgcctgctcatgagtagtgttctgtttggctaaccatccaagttcctggtatcattttctcttccaggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtgtaagtagggttgtacctcaaagttgactgaagtcctgtactaggccactaggaatgctttcaggatcaccatattaagggtatacagtgcacagccctggggcatccttcactttatagtctagggaaatatcataggccagccctgttgggagtattccactcaatgctcaaagctgagggatttctctaaagctgaaacctttgattcttagtacctgctaggagacccatttttcttagcttcctttatctctgtatggtgatattattaccttctgattttagcttccttggctcaggatattttttaaaaaaatttcttgttatttctactggttttaaaagtaatttaatgaacagattcattcactgtacttatgcttgaggcttttattttaagcaaagggtatgatttaaattttttttcaaaatgactttggttctccagagagtctcttacagggtgggagctgagctgatgtgcaacagaccttcctgaggctgggccgcaagccaaggaaccaaggaaggagcagctagggtgggaccacagcagtgctcagggaccagctttgcttggccacaacgcgcttgcctgtcctctctttatcgactgggaccattctcagtatactgcctcctggtcttcctttttcttgtctttcttgttttccataattgtaaaattggagaaaaagaagaacaaagcctccacagctttgactaattagcttactatatttacaaaaagccaacaattatactttgaaatcaagactggtttcatttatttcccccaagaagagcctgactcagcaacatactcagaccattctgaagcaatggggataaagagtgtcagctatggccttaggggtgcctatgggctctgggccatttcacatttgtatgtgtagggcctttgccagcaaaggcaggggctggcattggtgtcccatctggttcagagtctcctgtcctttctgttggccattggttctcacgtgtataccaaagcaacttatgggacttggttggcttctgtttgcagggtggcttccaggaccaggttttttgaaacagcttcccggaaaacaggaaggtaagatatggaggtgacaaaagaaaaaccaaatcgccttttaataactgcatccttagcatacaattgtgctcactctaacatctttctctttttgtttctctacagctctgtctctgtctgtcactttctcttccccaattctgtctctccatccctatctgtctgtcacctgttcacctgtgtgtctatttgtttctctcatattctttttctcacttggtgtctctgtcctttttttttttttttttgagatggtgtctcactctgttgcccaggctggagtgcagtggcacgatcttggctcactgcaacctccaactcccaggttcaagtgatcctcccacctcagcctccctagtagctgggactacaggtgcacgccatcatgcccagctaatttttgtattttcagtagagacagggttttgccatgttggccaggctggtctcgaactcctgacctcaggtgatccatccacctcagcctcccaaagtgctgggattacaggcgtgagccactgcacccagccagtgtctctgtcattctcaatctctttctgtctgtctgtgtttctttgcctgtgtccccatagttgtctttatctgtctgtttctctgttcatgtcactctatatgtctctgtttttctcttcctgtgtctctttgtatctgttgtctctttgcctcttcatttcttcatctctctctctgctcatctttcccttttctctctcacaagcacatatgtctgtgcacacttgtgtgtgcatgtgcatgtgaacacacaccaagcagtatctcaaagactttacacccaatattttttgttagtttttttttttagtttacttttttgttattttacttatttagattccattatatactcaaagggcagctgacagggatatgtagaatattacactctaagataaacagccttagggcccccatttcaaaggtaaacattggacttaggcagtggttctcaaactggctgcacatctaagtcacctggaaacatggagaaaaaagtcacatattcctggatttcattctagacccactaaaacagaatctctagtagtggggcctgggaatatgatttttttgttttattttgttttttccttccctccctttcttcttttccattagtttgttattaaaacttctcaagtgctggtacagactgtccaaggcctggaatttaggaccctttggactagaacatctggagagatatttggttagccttcagggactcttttgtgagtttgttccttcttggttatcagagagtttgaaattgttcctcctaacaggtgacaggagcagaactcttctaggtggtcagttaaaagcagaacaatatacctttcccagcagtggagttggggtagattttccatcctctagtcaaaactatgggaactgacacactaggacatgattctgcacagcagttcattctagctctgattgtcagtgagccacctggaacctcaggctgggccaaattctccttagacaataatttaccattcattctaccatagcagatgaaagtcagatcaaggccccagatttctcttactgatagcatgaagataaaagttttcacctcagaagttttttaagtaagcttaatcaaatatctctcttgagaaaagaaaaagaaaagaagaagggagacgaagagagtctcaaatattcttaataaggtggcctatgccttcctagaataagccacttgagaaataaataacaaggaaatagaacgatgtaaactggaatgaactggatatgtctacaggaaagctttttagaggaggtgatatatgagttggggcttgaaaaaagaatagaactagacagaaaaaatgctgtgggggcagttattgatctgcaagcttggacaggaaaccaaggcattgagaaggaaatatgtaagaagcatgaagaaagtccaatagaacttttaaggcaggtagacttacaagagggaagctatagccaaactggtgttgagagtgtgaaaagattggtagccactaccaatgggctgggctttgtcagccagtgctcgaggaagccttagatcaagcacaacctacaagggctatggccaaagcaggcacttcaggctagaatatcactctacccaccctatgtctgggcttccagaacctagatttaatcctgttctttattcctagattccattttggcaggaatgtaggtaagaccaaagtaggtacacttgctctccagtatgtcatgaactaccatcctgagtacccacaggctcctcccactcagcatccacatagggaaagcatcccttccatctaggcctccaccttgtaaccaccacttgcatcagtgcttccacaggttggcctctgatcaagatcctcagaccagtcacatagtcagtcccgtctatggtcattgttgctaagttcttctctcatctctaatgaaaatgatgatctttttaaactttgtcttgcccctttttggtccccatttgtatacctgactacggcctagcgtttgaatgacgtcacccccttattcatttcccttacacaatttaaacataaataactaagaagaaaatgagtagtggctcatcaagaacataaaggaggtgagaacatttcaaagaggcccgacagcttatggtttcagaagttattagtgttccactttggctagaatgtgggagtgaaaagagggaaacttagctgggggtgagaccagaaagatggattggagccagatcgtgaaggcattgtataacatactaaggtgcttggtctttatactgcagtccatatgcggatgagtcatagaaaggggggaagaatttcaagaatgacagtcacattctgagctgaccaagttgtaaaaagatcactttggtagtgggaaagatagatgggagagtaaagactggagaccagttaaggagactaattgtcctggcaagagttggggaagccctggcctatggcattcccagtgggaatggaacagaagggacagatttgagaaagactcaataagaccttgctacattttcaaacatggaacattgatgaaccgagaaagagaaaagtctaacttgggcacttaagtagatggtacaataattaatcatggagaagcaggttttatgggaaagatgctgagctcaattttggacacagtgattttgaagacacagttgttaaatttatacaaattttttaaagacactttgagacttaggtagagatagatgttcagtgggtaactgcaacttaggctagcagttggagctggatgtatgtatacatagatttgggggttagaaatatgagtatagccactatataagtctggggagtggggctagtcacatatgctacaatgtgaatagtagcctgttgtggggaggtccctagtatttggtggcaattgaagccatggatgggaataagatcctccagggagtaagtgtaaacagactggagagaagagaaaaacagaaggttgaggacatagccctggggaccagctgttgtacgtaatgctctggccacactagagtgggtttcatttgccaagattttctcctccccaagctgtccccagacatgggtaatttagaactaatccaagcacatcaagaggctggacaaggttggtttggtcttctaggcaaaggaggattcatctttcacatggtacttgtctgtgtcctcacccttatccctgttagagatcatcacagaatgtagttcgtggtctgcagccagcttccctgggttctccaagcttcacatagtctggtactcagagaattgttctggcacctgaaagatgtcttcacatctctttaagcctgccagagaaggagccccaactataagcatggagctaaatgttttgaaacatctgggctgaatcacttctccatttttcaaatggcctctttagcactggcctagaattgtcccccattcccccaatttacctttccagtcctgatttctagaatcttagtgaaacgtctttctttatccacagttctcaaggcagacttcctggagatgaaagttgaggctacaggtatgcagtccccatccctgattacaaaatcttgttccacataagccttcattacgggatctgatattttgaggactggaataacatgtagatcagaagggtgggaactcacttctacgcctcagttcattactctatcactgcctgacccttaaatttagtgactttcaattccaaggttttgtgtgattttaagtaaccttcctctttcatttctttttctcctagccaaactatggcgcgcttttacagattgcctttgaatcaaatttattaagaatcctaggctgtgacattttgggaaagtacatttacttctctgagcctcagtttcccagtttctaaaatgagaaggttggaaccttctaactctgacacctctcgggcctttaaggaaaccaggaacatgctttctgatgttataacagatgccaagaggctaccttagtgtctgtagatggattcattcctgcagaccaaatcattatttcagtcttacccacctgaaccttcattcttagtcctttatgtttgtccaatgcaaagcactttcacattcattatttcatttgatgcatatcacatgccaggagaagggaggataatatgtgttctaactcaacaaataaaggaactgaagttcagaggggataagtgacttgcaaaggtcacaggagactcagaggtcagggaaattcctttctctatcataggagttctgattgtttgactatcagattgctggcatgatgtgacctgataacacacataaatgagatccaagtatctggagcttggcttttcatgtgctccctaaccttctttttttccctgtcactgccagtcctcagaggtccgtgggtagataagcttctccttatcagcccctatggaggtgaagtccctgttaaaaggaagtttatagttattgtatgaccataaaggcagtgggcatgatgtgggaagaaatctcagaggttctagtatcaggcttctatttctccatgtagattttggggagtttgagttgaggtcaaaggcacaaagtgtccagccctggtcatagcaccatcttaggcctgtttcatgagatttgacttgtaagagcctttgcccagcaatccgctgttgctcagaagatgagctaccaattataggcttagctacctaccaagagaagccccactgatcagtggctgttaagtacttgaccagtcctcgctaattccctactctcttctttctctttcaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttctttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagtaaaatactctttttacaatccatataagcccttgattggaagggcttttcaaaatcatttagtctaacaactgcccagtttccagtcgggggaactgaggcagagcaaggtagtgatcacaccagtacaagatctcaggtcccaggctcctatgcaagttttttttccccattatatcacacttatctagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagagtctgtataattataatgttgcccagtgtgagggaaagagctttcctacttgcactcttctaccaaggccctgttagtgcactgattatagtactgacagataaacctagataaagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcaattgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggcaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtccaaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgtgaaagacatatgctatatccaaataataaaacaaacgagatcctggggctcattcatgtgactttcaataaagtatgtagactgtctaatataagtggcctccatctgcagttttgtcatggaaacaatctttgagcatatcattgaggcatgatggtacatggaaccactcactacctactgcttgtgttgacttctacaaatctaaggaaacctaagtaaagagttcttttgcacctaggagtctccatttacagtctactttgaacaatggcctcgcagttccctcaggcttcacaacatcattttgtgacaggtgacaggcccattttacagataaggaaacttgaggcttagggaactgagaaataatttgtccaagattacacagctaggttaactggaaactacagaggccttcccatttccatttctaatacaattcacagcccccagtagtaaagaaaagaaatccctagggtaaatggagaagattcttagaaataggaatgataaacatctttaagtcttgctactcaaaatgtggttcgtcatcagccttggcataagcattagctgggagcctactggaaatgcagattctcggaacccactccagcatgtggaatcagaatctgtactttcacaagatccccaagagactcctatgcacattaaagtatgacaagcactgatatgaggtatttgagacagcaaagcagcttgaggaaggagtccctttggtgagacaaagaccaaaagtggtggataaggatgatctggtatgttgggagtgggtacaaagattaagtcatagttgcctgcttttttgcattcctttatacttgtgctttgatgacaaagtttctccacctcaaagaatagtgaaaccagcctggggaataagaagagtgaaaagtacttggctttcaaatctctgagcagtagaagcagtggaaagacaacatgaggccatgggaagagctcctttcaggagccctcatggtccagaatcagcgctatcattgcctccccttaatgttgagcaaatccctctccctctctaggcctcaaattctctgcctttaaaccaggtactctcaaaggatcttttcagctttgatattctgttattttgtgatgttaattataccacagcctacattgtaatgaaaacatgggcaactccactggcctttttctggccctagtttcacatattcagtttacataagaaggggtaattcaggaggaaagttcacagtcatggcaaagcaacatgaatggaaatcacagggaactagaaggggcatgatctaggtagccagcttgaaattggccagtattttaattaaagtataacaaggcatccaaactgctttgaacaagctgctgcttcatatcacacgctgatgaatcaatttatgtattctaaataagctttactttgaacgattcatgaattcctctgacttgggtcttttgagggggcaaaagggacttacaaaacagggaatactaccactccctgcatctgccactcatcttcaggtgattctgatgtc

SEQ ID NO: 12107 - DNA, 23802 bp, Human
cttcctgatcttccttccttccctccctccctctctcctccctccctccctcttccttcctccctcccttttttccctccctccttcttctttcctccctccttccctccctccttccttttttccttccctccctccctccctccccttcccttcctttctcctccctccctcccttccttctttcctttactccttccctccctccctccctcccttccctccctccctcccctccctccctcccctccctctcttcccttccctcccttccttcccttccttctccctccctcccttcctccctccttcctcccttcccttccctttcctcctccctctctccctcccttcccttcccttccttttccctccctccctcccttcctccctccgttccctcccaccccacccactctctagaacgcatatcagggagaagggtggctgaaaagggacccagaatggcccacacagtctcagcacccaccccactccccatcacaagcagctgtgtcctggtgcctcccattccaatggccacaggggcagctgggaaaggaactgtctagggtcaaggtcaggccaaggggagacgtggccaccacagttctggctcccagcatctctggattttctttagaaaagcccatgacacccactggattagcagaaactccgcgaggggtgaggctgatctacttgacaaggagagactgacctgggtgctggaaggggccatgggcagccctctgtgggtgacccccattcagacaggctgccgggattcccagccccagggcctggctccctgcccagagcacttccagctcatggctcgccagcaagaagactccttatcagccttaagggtggggcggctccgacgacagggccgtgggggctcgccagggaggcccctgcttccagcttgaacctccagtaccaccccgggtgagcttgggcaactcatttctcttctctgagcttggtttcctcatcttcaaaacgaggggtggggctggggaggcctccagctctgaggagccaacgtgggaccctctgcccaccccaaacccctgtgttcagggcccgagctgggggtgggaagggaaggcagggactgcagaggtgctgtgccccagactcaatggtggcctccagttctctgtcccgtgttgctgagacccatcccctgtgagcctcgacctagaaggaacagcccttattaccccaatttacagatgaggaagcaggctcggagaggcaaggtgacacccagcccccacagccaagaagtggcagagccagggatctccgaggtcaggctctctcggctggtcttgggccccccatggcaccggtgacggatgtggtgctggtcttggctgggcacctgccacctctctccctctgatggtggccccggcaggacagacagtgggagaggagaggtgggggatagagatgccagctcagcaccgaggttgaccgggcacaggccaggctggaactcagagcctccttcctctctgccttgctcgctgcagacccccagggacgaagcagccaaccctggtgggggagggtggagggtggtggatggggctggggatggaggtctcattttggcagtggaggggagtcgcggggagtcccctaatctgaggagactccagcttcccccaggccccggccagagctccatcttgccaggttttggggggaggataacttgaggagtcgactgagagctttatctttgcccctgtgacgggtggcctgtggtttcctgccaacaactcctgtttccggaggcccaacaaggcccacgcagagccaggaggggcagtggggctgggcctgggtggccccaccagccccgccccatctatctttgggaatttatttgtccatgggcgaggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggtgagtccgggcgcctcccgctgcctgcaccagcccctaccccgggcctgtcctccagactctgacatcccttgcgtgacaccagcgagcccctcttcctctccatccaggggaaggccttcctggcaagccactgtgcgagaatagaaaatcctgccaactcgctgttgagatggggacgaggccggaggggaagccctgcccgggggccttcggtgaacaggaggcagagtctctgggttctgaggagccggctcagtgttatggttcctttgagtggttagtggtgttcagggccagggcaccaccaaccacagccactgagtcctcgacctctgaccgcctgccaaaccaggccgccactgacacacagaggccatgccccacacccgtcaccccatatgacaagttagagagagacagactctgctgccagcttccctgcctgagcaagggacatccagggacgtttgaggcccccggagcagagaaactctcacattctgaatacctggtgccttcatgttggcatgtcaggcggaggacagagatcggttctggtcccagggatgatagttcctttctgggcatctctggacctgtcccaccgggctgggagtgcagaatcagaggcagcgtgggacgctcctgcagtatggttgtctcgggagccaagacaggcctggcagaggctggcacacttgtgagtgtgcatatggagctctgtgcctatatgtgtctgggtgtgtgtccctggtgctgggtgcccacatgtgggtacccttatgtgtacatatggctgtgcccatgtctgccctgtggccaagtgtctgggtggccagtgtgtgtcccctgtgtgtggtgcatcttgtccactcacagtgactctgcagaggtctcctggaggccccagggccactggagggggctcagcccctgttggggtcctaggggtgcccagtagcccctgcctgcctttgccgtgtgattctgagagctctaccctccccatttttaccatggttccgaaccagaactgctaaatggagtccagggcaggctgacccagggcccaaacaaggaccacgaagtcctagtcccccggaaacttctggcgtccaaaagagccctccttctgtcccaccagtccccagaacctcagagccggccaggtggacccagggccagaccccagccttgacctctcctctctcttgttcagaaactaatttgacatctgtgatgtctgagcttgtgagggaaactgaggcccagagaggggcagtggggtttccaggtccacagcaagtcagcagcaaacccagggttgcagctgagccctcctgacccccaggcctctgctgtgccttctccttcctcaccatcacaaggggctgtggatcctttctactgggcactgatggtgggatgccaggtacaggacgggccggaagtccacccttagtatcactcctgaccgtccctgggagaggctgtctgcgcaggcccagcctacccttgctggaagaggctgggggaaggctgtcctctctctgcccctgcggctccctagttctgctttcagatctgcaggtgtgaggggcaccaggtccctcctctgtgtgtgtcacaggctgtcagcgttggagggacccacccattcccagccgtagcctatgccccaagctgctgcccagccgggaacctatacctccagtgacggggacctcactaccgtcctcctgcctgtcttccctcccaagactgtctaatcagtttccaaatggatgtggcccttctcggtgtctgtggggctcaggaccacagggattagccaggatctcacagcttagtaagagactaaccaggatttgaacccacctgcatggctccaaagtcagccttgatattctggaaaggcaacctcctcagagagagggcactggcctgcccacgtcacacagcagagggtggaaggaaggcagagtccgtcatcaccagcaacccccagggctgcaggcccaggcttccagctcctgctcaggctgtggtgcctgctgtctcttgcgccctcgtctggccactgctcagtactgcactgacctctcagccaggaacccacagcggcaaaccgaacccctgacccagcctggacttggtcttggcatctccggactcagcttcctaaccggcccgtggggcacgggttgcaggggaccaccccccgccaagagtgcactcagctcagcactttgctgtttcctgaggagggctttgctttcatgtctgatcctgtgggcactgccaggggatggaaaggagcatgagagaagagccaggcccccgtgtcccagacacagggcaaagcctgggtgggggatgggtggacacagagacagacctggacagagggacaaacgccggagcacaattcagacgaagggtgggaggtcccgagactcagagttactgaggctgagcagggaggctgagaagccaagaacacagactcaggaggaaaaccgaggccatggtctccgccagtcatgctcctccaggagatcctgggcaagtgcaggcagtgagtgggcctgagaccagaaggctgagctgagctgaccctctcagatccagttaagatggtctcagttaaggctgggcacagtggctcatgcctgtcatcccaacactttgggaggctgaggtgggaggatcacctgaggtcaggagtttgagatcagcctggccaacatggtgaaaccccgtctctactaaaaatagaaaaaattagctgggtgtggtggtgcacgcctgtaatcccagctacttgggaggctgaggcagcagaatcacttgaaccctggaggcagagtggagctgagattgccccattgcactccagcctgagtgacagagtgagactccatctcaaaaaaaaaaaaaaaaagatggtctcagttagagctctccccgaagagctgatgagctctctgtccctggtggtgtacaggcagtggggaggaagccagggaggccttcctggaggaggtgacacactgatggaaccagccataagcaaagacctgggggctgtgggctgggctggcctgctctcagctttctctccagtccctctgggtctcttctcaactaagtcctcactcatcccctgcgcctccacacagacctcttgaaatcacatgttctgagatctccaagtggagatcagagtgcaccaatcagggagaaggatggatagaaattattggggggagaaacacatccagggaccgtttctgcagcatcttctccatgcctggtgctgtgccggggaacagaggtgggacatggaatggagagagggagagggaggaactgagggtgaattagccagactcctttggttcctgtgagaaaagtctaatcaaacagatttaaaaggaagggtgggccgggtgcgttggctcacgcctgtaatcccagcactctgggaggctaaggcgggtggatcacttgaggtcaggagtttgagaccagcctagccaacatggtgaaaacccatctctactaaaaatacaaaaattagctgggtgtggtggcgcacgcctgtaatcccagctactcgggaggctgaagcaggagaatcgattgaacttggggggcggagatggcagtgagccgagatcgcaccactgcactccagcctgggcaacagggtgagactccgtctcaaaaaaaaaaataaaaaaacaaacaaataaatgaatatataaataaaaggaaaggtgggggtatccggtggtttatgtaactgaaaaatcagtgtgggtttcaggcccggctggatcctccaggatgaagacacaggaggagtaaggtttagaggggagaggggatgaggaattcctgcgggtccagtcttggttctcaaaagaagctgcccatgacctatctccctttcctggctcttctttcctctgtggaggcttcattctcaggcaagttctctgtcttcacagtggtgaaacggccaccagcagctccaagctaacatctcaccagtttagccactcccgaggcacaagagtggctccttctccagagctccagcaaaagtctcaggttcaattcttattggccggggtcgggtcccgtgcccaccccagaaccaatcaatcattgcagtcaaggaaacggaatgccctgattggaggagcctggttgcgtgcccacccttccaggctctcctgtcgggacacagtgtgaaccaaggtcttggggccggagaggaatagagaaggtgtcactgggactaggctgaaggggccataaaaggagcccaggggagaggctgtgaaagggagagcaggggcgatggcgaaggcctttgaacaccaggctgaggcgcccggatttcttctgcaggcagaagggagccaagacaggatgtctagcaggggagggcctggagcaggcaggggtgggcgtggggaccggaggcaggacagctgtgaagaggccgcagggatgggaaggggggacggggcgggacccaaggcagaggcagtgagcacgggtgacagatgtcgtcaccccggcaggcctcacgcctggggcggcccctgctcagcttctgcccattgttgccgcagcacgtaacacctggcacagccagagcttccgacgtctcaagagaagtgggaagtgagatttatgcatgaaagaaaccgcttggtttttagagattggtgacgtattcaaaaaaaaagaaagaaagaaagaaagaaaaacagaccgggtgccatggtgcacgcctgtaaacccagcactttgggaggccaaagtgagcggatcacttcagctcaggggtccaagaccagcctggccaacacagtgaggccctgtatctaaaaaaaaaaaaaaaaattacccaggtgtggtggcgcgtgcctgtagtcagtcccagctactcaggaggctgaggtgggaggatcacctgagcctggaaagttgaggctgcagtgagccacgactgcaccagtgcactccagcctggaggacagagtgacaccctgtctcaaaaataaataaagaacaataaaaataaaataattaaaaacacaaatggttggcctgagattcaattccacattcagttagtcattcaacacacagtgtttgttgagttcctattatgtgccaagcactattctagacactaaaaatacagaagtgaacaaaacaaaccaagatcctgcactcaaggaacttaacccagatgcccctcgacttgtctgcgggttgcatgggggcctcagggtgggccccagttctgagcacattccctcccaggcctggagtctgctcatgcccctccccaaggctgctgctccctgacagcacacgccccatctggtcaactcctgcctgtggcccatggccataccctgtgtcccaccagccacctggccggtcctcccaacccatgccagagctgcccccgcacctgtcccagctcctccagtgtctcagccttcccaaaaccagcccttctgggtccttagatgaaagccgagggaggaccagaaggactgggggatccaatgaatgtgggggcatgatggggagggtggctgtgaggatgctgcctgggtgttgagcctgggtgatagggtgaggacagcaccattctccatgacgaggacacaggggaacaagttctaaagggagatgaagagttcaggttgatccaattgaatttctgtctgtatagtggttagtgcttggcacgaaatagatttcgtaggccgggcacagtggctcatgcctgtaatcccagcactttgggaggcagaggtgggtggatcacctgaggtcaggagttcaagaccagcctggccaacatggtgaagccccgtctatactaaaaatacaaaaattagccaggcgtgttggtgtgcgcctgtaatcccagctcctcaggaggctgaggcaggaaaatcgcttgaatccgggaggcagaggttgcagtgagcctagatcgcctcattgcactccagtctgggggacagagcgagactccgtctcaaaaaaaaaaaaaaaaaaaaaagaatttatcaggacatcaccacattgtaaattgaggagcatctggacttagcgtggtttgacttaggattttttgactttatggtgggtttattgggggtattaagagccttttgactcaggatgggtttatcaggttatagccccatcgtcatttgaggagcatctgtgtaagacccttgggtgcgagatttttgtttgttttgttcacttttgtgtttgttttgttcaacagtgtttggcgcatgaataggggctggataaatacgtgtttgtttttgttttttagtagagacagcgtgttactatgttgcccaggctggtctctaactcctggcctcaggtgatcctcccctctcagcctcccaaagtgctagaattgcaggcctgagccaccacacccggctcatgtttgttgaatgattgaatgtgtggaattgaatctcaggggagagtgcagtctggagatagaattctggggacacagcgtgtctgaggcagctcactcagggaatgggggcggatcaacattgaaagaggaatttgtgaaggaggaacggagaacagtgaaaatgggaggttttcattatatgtgcccactgagtgccaggcactgtgctaatttccttaagaactcatagaggccgggcgcggtggctcccgcctgtaatcccagcaccttgggaggccgaggcgggcggatcacgaggtcaggagttccagaccagcctgaccaacatggcgaaaccctctctctactaaaaataaaaaaaattagccgggcgtggtggggcgcgcccgtagtcccagctactcgggaggttgaggtgggagaattgcttgaacccgggaggtggaggttgcagtgagccaagatcgtgccaccgcactccagcctgggcaacagactgagactccatctcaaaaaaaaaagaactcatagaagcttcccccaaacacttacctagatgcttctgtctcctggggcccaggctgagtttgtagcagagcctcactaaacacttaatgaataagcagcgcctttgaggtaggtggcgtcacctctgttttattgagaaaaccagggctcagagaggtgtagtctctagcctgaagccacacagctggggagcagcagggctggcacctgaccctcagccactccaccctgtggcctcttccttgagaaggccattggagagccccaggatgggggattgctgatgacgaggtagaaagcatggtgagggttatttctggaaggggagaggcttctgaagatgcctgtgtctgacatcaggccctcttggttgtcttcccagggtggtgacaataaggccagatcaaggcatggctttggaggagcaggcctggcaccatagtcattctattattattttttgtttttttgagacggagtctcactcttgtcgcctaggctggggtgcagagtgcaatcttggctcactgcaacctccgcctctgaggttcaagtgagtctctgcctcagcctcccaagtagcgggattacaggtgcccgccaccaccatgcccggctagtttttgtatttttagtagagttggggtttcaccatgttggccaagctggtcttgaactcctgacctcaggtgatccacctgccttggcctcccaaagtgctgagattacaggcatgagccaccgcgcccagcccatagtcattctattatcaccagagttgaggtcatgaatgccagatctgaccgacctttcccttcgacctcaagaccggcagctccaaggtgcatcagccccggcttgtgggctccaggtggctctgtttcccctctgtgctctgcctcctgggagacacgtcgaagccagtgttgctcagtggaggtgggctgagtcctgggctgggtgcctcaagcatggggacacttgagaccgccactcctgcaggcctcagcttccctgtctcttgggaaaaggtagaaagttcgttttgggcaaagatagaaacgttgctaagctgttggggctgaaggtgccgagagggaggtcagtggcctgtcctgcagaggggcccaggacaaggagaaactcctcctcccccctgcatcagctccttctggcttggacacagaaccagaggccctcctggaggaaggggcccaaggaggccagtggggggatgggcaatgctcttgctctccctgatggggctggaggcagcgtgacagactcaggacactgaggatcagaggcctttgtcatgcctccacctgttgctatctgggacctgcaggggacagcagtgaccaagcttaggcttcgggagcatgtgacttggccccagtgccaaggtgagagggggcttagagaagaggtgggtgggccatgagaagaaagaagaggacattggtgggtggcctccctggggcctgcagcagggagagaggtgactctgggactaagaggcctggagagttctgttaccagatctgagccctgggggaaggagcagggagtccattgctttgagctccccttggacaggtgagctcggggtagggtaaggagtggagggggatgatacatctggccacaggtgcactcacagatttgccctgcaggtatacagccacacaccccataccccaacacacacacacacacacacacacacacacacacacacacgttaccctgaatctccaaaaagagtctttcctcgaggaaggggccacagcctggagaggagtgttatccaggactatttcatttgcaagcaacagaaaccaaatccgaactggcttaaacaaaggaaggacatttattggtttacgtaactgaaaagtccagaagtagatttttcaactgtgcttcaggtatggctgaatccaggtgctcaaacaacattgtcaggattctgcccctctctatctcctggcctggctttcctctaggagagcttcattgtcaggattgctctctccagaaggtggcaaagatgactaccatagttttcgtcttgcagccaccctgcttagccactcaatagacaggatgtttctttcctggcaattcccagaaaagtcctggcctcattgctgaaactcctcaggtcatgtgcgtgtccttagacccgtcactgttactagggggatggaacattgattggcaagccttggttatctgcccaactcctggggctaagagggaggttagcctcatggaaccttccagactgaaagtggagaatccaaaggaacgggacagctcaatgctgggaaggcaaggccagaatttcccaagaaaactggaagacctcccgactgagccactcccacagtgcctcgaccgaggggctggacgctgcaagccctccagaggaccacctccctgctctgttttcctcgctgtctcccagggggtcccagcatggctggatcataataacaactaatgtctatactgcatttattctgtgccatccccattctgagtgtttctacatgtatgaactcactcacttgatcactacaagaagtaccattgttggccgggtgcggtggctcatgcctataatcccagcactttgggaggccgaggcgggcggatcactaggtcaagagatcgagaacatcctggccaacacggtgaaaccccatctctactaaaaatacaaaaaattagctgggcgtggtggtgcatgcctgtaatcccagctactcaggaggctgagacaggagaatcgcttgaacccgggtgtaggaggttgcagtgagccgagatggcgccgctgtactccagtctgggtgacaaagcgagactccgtctcaaaaaaaaaagaagtaccgttattattcctattttatagatgaggaaactgaggcacaggggattgaatagcttaccccaaatcccacagtaagtatggagctgggatttagacccaggctgttaggcattgaagaccatattctcagccttcgtgctctgttgggacctctggaaggaggagcaccctggaaggaggaggcttggcctccaggccccagcaaactctgttcttggaaaaggattggaaagagtatttgaattagcagtttctttctttcctttttttttttttttttttttgagacagaattttgctcttgtcgcccaggctggagtgcaatagcgcgatctcggctcactgcaacctccggctcctgggttcaagagattctcctgcctcagcctcccaggtagctgggattacaggcacccaccaccatgccaagctaatttttgtatttttagtagagacagatttcatcatgttggccaagctggtctcaaattcctgacctcaggtgatccacccgcctcggcctcccaaaatgctgggatggcacgcccgtcctgaattagcattttcatagtgaaaagcaccgtggaacttcaggcccaggccagcagcgggaggcaggggaggctgtcctgcctctagcccaagacaggagctttaggagcagatggtggctcagaggcacatctggggagggcgtgggaaagcgtgtgacaggtccagctggtgccacaaccacaactccccctctgtccccacccgcacaggtgggtgtttctctatgagaagggctaccagacctcgagcggcctcatcagcagtgtctctgtgaaactcaagggcctggccgtgacccagctccctggcctcggcccccaggtctgggatgtggctgactacgtcttcccagcccaggtgagctggctcaggtttgcaccttcccctcacagggcctgtctcagagttgggtgggactctgtcccacgtccctgtgggaccagcccagctcctctttctctctggacctctgtgaatgccgggcagaagcagcctggtgatatcaccccatgttggtggcagggggtgtggtggctgctgcgtgtcctgtgggctctaggggcctctgctggggcagcggtggggcccttggggctcttctcccagctcccagcccaccccaccctccccctgcccctcacttctagggggacaactccttcgtggtcatgaccaatttcatcgtgaccccgaagcagactcaaggctactgcgcagaggtgaggacttctgcccgccagcccccttctgggactcacaggggaaaatgacgtgcagagaaagtctccaggggcactggaggggaagccagagaggcttcctgcaggggccatagtgatggaaatttgggcgcatattcacacacagcaactgtcaacccttgcagagctgagccttcccgcccagcacacggtgtaccaggcagggtgccgagacttcgtgcccacccccaccgcccagctgacattggcagtgggcagctgggcatgagcccggggggcgcctcggcagagcagtgtggggggaaatgggggaaggaggctgtgagcaggcgtcactccagagaggtctgagactctgccccacgctctccctagggccctggggggtggggagaggggctcttctcaggaccccacccaaggggcctgggaccagcagcttttgcctcccccagcacccagaagggggcatatgcaaggaagacagtggctgtacccctgggaaggccaagaggaaggcccaaggtaaggtcagcctcctcctgtccctccacagtcccccggctgcggtccctgacgtcctgcaggcccagcttggtgctgacctgcctctctccacacccctcccgccgaggcggcctccgggagggactccctcctgccgtctcccctcctccgccctggcttggcctgcccgtccgggacccagccacgtttctgtccttggctcctttgcttgagtggcccgtcactgggagctcctggagaaggggtctggggcggcctcctctgtttagtgcaggcacccaggggtttccctctggctccaggcatccgcacgggcaagtgtgtggccttcaacgacactgtgaagacgtgtgagatctttggctggtgccccgtggaggtggatgacgacatcccgcggtaacactctgaccttccagagagctaagaacagggtcccaggccagacagaggggggcctaggtctagaaaggatctttacccctttttctgaccccaccctcaccccatccgcgcaacctaggctgaagattcccctgggtcctggccacgctagagcacacccacccctccaccagcccagggctgcaggcgggtcccggaggctcggcccaccccctgctgtgccaagctctgtgtgggacacacagggggcctcctggggaggggcggtgagtgcgtgtggtgtcctccagccctgcccttctccgagaggccgagaacttcactcttttcatcaagaacagcatcagctttccacgcttcaaggtcaacaggtgcgtgggaaattcgggcagaaatgcaggcagctggccggggccgctccggcagctctcagctgtctctgtctccctccattcctgctggcgtggaaggaatcaaaggggcaatgtggagcctgtgaggggtccccaggctttggggcgtggtgggcaccctcccggatgacacacagcagctgtcaacaccttccacccccacaggcgcaacctggtggaggaggtgaatgctgcccacatgaagacctgcctctttcacaagaccctgcaccccctgtgcccagtcttccagcttggctacgtggtgcaagagtcaggccagaacttcagcaccctggctgagaaggtatggagcatggtgccaggcacgtggggagggctgggccgcaggatcctgataaaggctttttaggcccagttcatcttcccaagtctcctcggtgagggctgagtatatgtatgggtctgtcccctgatactggggccccctgagcgtcagatccatgtcttcagcaggtcctggcatggaactggcacgaaggaggtgcccagaatgaacggatgtgggcagaccttgtcatctggatgtttgttgatgccctgctttaaaaaaaaaaaaaaactagataaaagcagcttggtcaggtgcggagggtcgtgcctataatcccagcactttgggagtcagaggcgggtggatcacttgaggtcaggagtttgagactagtctggccaacatggtgaaatctccttctctactaaaaatacaaaaattagccaggcatggtgacgcgcacctgtaatcccagctactagggaggctgaggcaggagaatcacttgaacccgggaggcagaggttgcagtgagctaagattgcgccactgcactccagcctgggcaatggagcaagattccatctcaaaaacaaaaaaaaaacaaaaacaaaaattggccgggcacagtggttcacgcctgtaatcccagcactttgagaggccacggtgggcggatcacctgaggtcaggagttcgagaccagcctgaccagtatggtgaaaccccgtgtctactaaaaatacaaaaaaattaggcaggcatcgtggcatgcgcctgtaatcccagctacttgggaggctgagaccggagaatcgcttgaacctgggagacagaggttgcagtgagctgagatcacgccactgcactccagactcggggacagagcaagactctgtcaaaaaaaaaaaaatacaaaaattatctgggtgtggtggcgggcacctgtaatcccagctactcaggaggctgatgcaagagaattgcttgaacccgggaggcggaggttgcagtgagtcgagattgcaccactgcactagtctagcccaggcgacagaatgactccgtctcaaaaataaaaataaataaaaataaaaaggcagcttgaatcctatagcctatggccctgagaaatcctgtgccctgggatcctcgcagtcacctgggattccgaagaagcagtccctatgagcgcagaactagctgaccgggttcaaatcccagctctgccccaaacgagcagtatgaactcagacaagtctcttaacttcagtgggtgtgagtttttggacccaccgacggggggcaataatggtgccagtctcgtggggtcgccccgagggtcaagtgagttgacgcggtgtgcgtggcgtgcctcgctgcctggcacgtgggaagcctatacacctggcagagttgacgccgtgtgcctggcgtgcctcgctgcctggcgcgtgggaagcctgtacacctggcagcacgtgtcccttattagtcctgcccttgcagttgcctgttcaagaacgaaatcaatcccttttctgtgatgttatcaaaataacccactcacgacacatttgtctgtctacaagggaggtcagcaaacttttttttcaagggccagatagtaactattttcagctttgccggctatatgggctccgtgccaactacccaagtcagctgtggaagggcaagggcagccacagaccatatgtgaagagtggacctggccatgatcaggcccatgggcctcagtttcctgacccctggagggggttgatgccggagcaacacacatgctgaatgttagacctccctgttcctaaaaatctccctgtcatcagggctgggtgcggtggctcacgcctgtaatcccagcactttgggaggccaaggcgggcggatcacgaggtcaggagatcgagaccatcctggctaacacggtgaaaccccgtctctactaaaaatataaaaaattagccgggcatggtggcgggcacctgtaatctcagctactcaggaggctgaggcaggagaatcgcttgaacctgggaggcagaggttgcagtgagccgagatcgcgccactgcactccagtctgggtgacagagcaagactccgtctcacaaaaaagaaaaaaaaaatctccctgccatcttcaactgggaacttctcagtaactaggctcctggcaagtttcccagctccctgtccccttctctgaccaccttccagctcttctcctgttgctcagcctatctccacctgtcccattactcgcctcgcccagaggagcttcgctttctccaatgttttcttcccaatccaggtcttcacagattccttctttaattaatgcagtaattgtctgcttgcctcccacactgtgacctgtgccaggaactcaggagttggtgatgaatgagacagacagcttcgtcctcctggagcttacagtcttggaggagatgggttaatacataatcacactaaataaacttatgattataaagcgagaaatgctcccaaagaaaacacacgagtgaaacagaagggaataacaaggacgtatctgggttacaagagcagggcgaaaataaataaataaataaacaagaaatggtcagagagctggagtgtggagggtaatgggagggaaggccagtgagggtgacaggacctctaccccaaaacagtttctcagtatcttttcttaaataaaaaatgtccagttttttttgttgttgttgattttttgagacagaggcttgctctgttgcccaggctggagtgcagtggtgtgatctcggctcactgcaacctctgtctctcgggttcaaatgattctcctgcctcagcctcccaagcagctgggattacaggcacccgccaccatgcccagctaatttttgtattttttagtagagacggggtttcattgcgttggtctggctggtctcgaactcctgatctcaagtgatctgcccacctcagcctcccaaaatgctgggattacaggtgcgagccaccacgcccggctccaaaatggtctgttcttgagagagtgcgtgtaccagctgtgagatgggctttttttgtttgtttgtttttgagacagagtctggctctgcacccaggctagagtgcagtggtgggatctcggctcactgcaacctccgcctcccaggttcaagtgattcctctacctcagcctcccaagtagttggtattacaggcgtgcgccaccacacctggctaatttttgtatttttagtagagacgggttttcaccctgttgaccagactggtcttgaactcctggcctcaggtgatccacccgcctctgcctcccaaagtgctgggattacaggtgtgagccactgcgcccggctgagacaggggtttttgatcctgaaatcccagatcttaactacttgtgtccctggcagggtggagtggttggcatcaccatcgactggcactgtgacctggactggcacgtacggcactgcagacccatctatgagttccatgggctgtacgaagagaaaaatctctccccaggcttcaacttcaggtgtctgccaggcccccagcagcacattcttccttgtggtcctgcgggcttttctactcccagaacacttcaggtctgagaaagtgtccccagaggggagcagagggtcctgggcagctctcattctgcctgggtggccatgcaggaagccagcagggagaaagatattgaagtctcaaatcccctgtccctgggtctcagaccccttcaggcccacctggccaggactagctggggaaattgctgacattgggagctggggcaatggctgagcacagcagcccacacctgtaatcaaggcatcttggggggctgaggtgggattgctttgagaccaggaatctgaggctgcagtgagttgtgattacactactgcactccagcctggcgacagagcgagactccgtctcacaaaaaaaaaaaagaaaaaggagttggggcaagagttgagtacaactttcccagaatgaggcctgggatcctgcccggtgttggggatgaggctgtactcagagaccactaaatctcctgtatccctgatgcgctaagaactccagacccaagacagtcccctccatcaccctcctgccacctcatcccttccccaaggtttgccaggcactttgtggagaacgggaccaactaccgtcacctcttcaaggtgtttgggattcgctttgacatcctggtggacggcaaggtgagtgtccagtgtgagggtggtggcagctgagacacattctcagctcctgtgagtacctttgggcatctacagttatagacaaccggaagttgggtgggttcatccagcagttttacttctaataacagatggtcatggggcatgtccagagcagggctttgcaacctgtggccatgcctccccacagtctccttgcgctcagggaggcagagccaaggtcaaaacccaggtctactgaccagcagctggtggcccatgtagagtccgaggtggggacagttcacagccgagggtggggaagtccccttgtcccaggtccggccttttccagctgggccccttccgacggttagcccttctctccctgggtcctgccaccaggccgggaagtttgacatcatccctacaatgaccaccatcggctctggaattggcatctttggggtggtaagtgctggggtcaccggctcactgtgctggggttggcccctcctcttccacaattcagtagcagcaagacgtccctcaccctaaaacttgaccctaactgtctatcatttttgagccagcagctgcccaccccaccaactacatagatctaagaaaaccaaggcccagagctggggcaggacagagttggggtggaaccatcttggtcccctgagagtcctgcagggcctcatccaccctccaggaaactggcctccagtgaggtcagatccagccagggcctcaccaccagggactgaggtgggatgtggagggctccgtacccacccccggattcccacgctgtctccgtgcccttccctgaccccaggccacagttctctgtgacctgctgctgcttcacatcctgcctaagaggcactactacaagcagaagaagttcaaatacgctgaggacatggggccaggggcggtaagagaaccccccgagccaggcccttcgaaggcctccggcgcttgtgtctgtgttggggtggggggcgtgggcagctgcttccccagcactgacttgtatcccccaacccttgcaccacgtacacaggctgagcgtgacctcgcagctaccagctccaccctgggcctgcaggagaacatgaggacatcctgatgctcgggccccaactcctgactgggtgcagcgtgaggcttcagcctggagccctggtgggtcccagccagggcagaggggcctccccaggaagtctcctaccctctcagccaggcagagagcagtttgccagaagctcagggtgcatagtaggagagacctgtgcaaatctgagctccggctccgaccccacacaccctgagggagccctaccctagcctcagccgctcctggtggggaatggctggggctgggcaggaccctcccacacacctgcaccctagcttcgtgcttctctctccggactctcattatccaacccgctgcctccatttctctagatctgtgctctccgatgtggcagtcagtaaccataggtgactaaattaaactaaaataaaatagaatgaaacacaaaattcaattcctcggctgaactagccacatttcaactgctcagtagatacgtgtggttagtggctgccatactggacagctcggggcattttcactgtcaaagaaagttctattagacagccctgcttgagccctgtttcttcctggccttcggtttccctggggaacttatcgacaatgcaagctcctgggcccacccccagacctcctgaaccaaaagctccagggctggccgtatgatctgtgtggatggcaaactccccaggccattctgggacctaagtttaagaagtgccgtcctcgaactttctgactctaagctcctgagcgggagtcagacttagccctgagcctgcacttcctgttcaggtgcagacactgaacagggtctcaaacaccttcagcatgtgtgttgtgtgctcacgtgccacacagtgtctcatgcacacaacccagtgtacacaccacctacgtgcacacagcatccttccacactgtgtatgtgaacagcttgggccctgcaaacacaaccatctacacacatctacacccccaagcacacacacatggtccgtgccatgtcacctccatagggaaaggcttctctccaagtgtgccaggccaggacagccctcccagccatgaatccttactcagctacctcgggttggggtgggagccccagccaaatcctgggctccctgcctgtggctcagccccagctcccaaggcctgcctggctctgtctgaacagaaggtctgggggaagcgacgggtggagtacaataaagggaatgaggacaaacctctgccgtccgtgctctctttccagacctctctgaaacacagtgtgctcgtctgtgaaatgtggggctgagctgggcaatctctgagatccctctggatctgccggtggggaccagtgagccgactcatacgccctgagcccagcagggtcagtgctgggtggagaggtcagctcacctctgtccacgggttgccatcttggcacagccctgaacattggcgctcttcccaaccctccatggctgggagaggcctggcagtggcacaagtagagaaccccaggagtggcctcgtgaaacagtggggaggaaggggctggctgtgccaggagggagatctggcggaatcccaaagaggggaggagggacttgactgaggctgtgtggagggccctgctgtgggcatgacctcaggcctggatttacagccaggtaggatctctgggcagcatcccccacccagtcaccatgctctgtctagaccagtgccgtcccatagaaccttctggaatgatggaaatattctctatctatgctgtccaatagggtacccagaagccacaggtggcctcggtggaaatatgcagccaaggaaatgaaattcgtattttatttacttttaattaattaatcaatattttttttttgagacggaattttgctctgtcgcccaggctggagtgcagtggcacgatctcggctcactgcagcctccagcccctgagctcaagcaattctcctgcctcagcctcccaagtagctaggattacaggtgcccaccaccacgccttgctaatttttttttgtatttttagtagagatggggtttcaccatgttggttggccaggctggtctcaaactcctgacctcaggtgatccgcctgcctcggccttccaaagtgctgggattacaggcgggagccaccatgactgcccaatttacttttaattaatttaaatagttacatgtgactagtggctaccagactggacaacacaggccagcccctgccatctccctcagggccttggccttctgccctcttccccaaccaagacctatcatttagattttataagactggaacttcctcttctgcccccccttctttctccagacacacctgcttttgcactttctgcccccttcccttccaagtgagcagaaaagggtccctcctctgtattcagcctcaccacccagcccagaggctgcccagcagaagccacctccattctcctacccctacatctgtccccctcttctgcctcctcctggcccaggttccccagcagctctgcccctctcccctcactgcaacccttccagaaagaccagtccacacttccctctgcaattggcctccaccccaaccacttctcctaggtgcccttgccaaggtcactggcagtgtcctggttgccaagtcttaagcagacacttgggccccatatcctgcttggcctgacagcttctcacattgttgtccaagccttccttgtcgaaagatttccttccagcagctcctaggacacaccctttcctgacttcccagcctgtctggcgtgcaaggaaaagacaggtttcaattgcagctctgccacagttcactgtgtgtccttgggggaagtggcttaactctccaagcctcctctgtgagtcaaggataataacaacttctttttttttttttttttaaatagagacagagtttcactatgtggaccaggctgttctcaaactcctgggctcaaatgatacgctccacctcagccttccaaagggctgggattaccggcatgagctactgcacccggacaataatagcttttagtagggttgaggaaagacctgtaaacagcacctggcatacagtcgagctctgcccctcaatctatccaccctctcaatggtggagtccactagttgttccggatatctgttctcccggtagcaattcagtccttggttcttggttgggcatgtggctgcccagaa

SEQ ID NO: 12108 - DNA, 14449 bp, Human
ataccacactccaaaaaaatagagttcttgtttcacccctctctgagcccctaatcccatatgaagatctatgaattggaggaatgctggagaaaaaaatggctttagaacattgaattattttcttctgctgacctccctagtacagaaggggttgagaatgccttcctccctcccctctgattaaagctccctcacctccagctgggctggtgtcctgtgtcccaagatgaacccaagagtgagacagtctggctttcctccccccgtgcttcatccccgtgtgaccataaggggagagtagccagctgtaaaagcacaagggttaaagtaacatgctttggagcagagttgaatttcaatatgagttgcatttagaggttcagtcttgggcaagtcttttgacagatcctaacttctctgagcctggttctgtaaaatagggctcataattattgatcacatgaggtcatctaggcaaggtgcctgccacagcagggggtatgttgtgggtgctcaataagcgataacaactagtagatgtttttgtgcctatgttacaaataaccatatatcccaagtgccagaggactatgtcttgtattcccaggcctcattcagagtctgacgcatggcaagctgtcttatatcaggtttccccagaaggagatcctgagagagggagttgcgtacaagtgtttatttgggagttgcagagagtaggaaggagcagagaatgcagttgaggaagggaaggcagcccataaaaatgcatggaataaggccaactaccacagcaggccactgggaaatggtgcccaatacatgttagatttattccacttgaggggccggggattgcggtacttatacattcattcctgaatgttgtggactgttcccagggacatgttaacttccttacatataaaaccaaccacagttctggggttggagagagacagagaaaaggcctttggttacagagatgcaaactgggccattgggagtctacctacaaccttgaaaggtcctggcagcactatgcaggtgcccagtaatcaggtgttctatgaagagaactagctgagcccattcctccatctccaaaaggctccatagacccaactccaccctccatcctcctcctcaaggagtagtagcttctgacacttctatgaaagttgtggtgtggggagagatgataaggaagaagtttcaatgagggctaagcagagtggatccgcgatcagaggagaaaataaatccatttcagtaaaacccattttattgcagggaggtggagggagggatggcaagcagaggaggggaggcagctgcccaggagagggcagctctgaactgctggctgggaccagctcagtaggaacagatgaaaggaagtcttctgaggcagtgggctcgacgccagtagcctcctgtgaaggcagaacagaaagggactttcagcctcttgtccatcccaactcaacccacaggagggcctcttttcccacccacacactgctgtggagtcagagtatataaaagacccaggaagcctctcccacaaagggtcaggctctttgtagcatctcctccttggggcacttcccatctcccagacctttccatcgttcatccccagccccacctcacctcgggtacacagggccacgcagtgaccaccgcgggaccagggctggtgagcagcccagtacgcaaagttccagcggctgccgtcaacccactgaaagcgtctgcagcgaccctggagaaagcaagaggggaagaagggatggggcagagggaaggcagagaagcagacctggccccgtatctgccagctctttctgctgcccaccgggcaatgggcccttccctgctggaccatgatgggaactgtcctagtcatctgaaatgctgatccacggcaattatcaccatcagattctatgcatcccagtgacaggcttgtccttccagccctaacaaaaggtagaacaagggttgccaactcatcctagagatgaggaaacaaactcatggtcttgttttaatttttttttattttatttatttatttatttatttttgaggcggagtttcgctcttgttgcccaggctggagtgcaatggctccatctcggctcaccgcaacctctgtctcccaggttccagtgactctcctgcctcagcctcccaagtagctaggattacagacatgcaccaccatgcccagctaacttaagttacatagatagtgagagatggaaaggaacttggacccaaacctcctgattctaaatccttagctcttccctgaatgcccaggcagccccctcagtgttgtctgtgggtgtccatctatccctggttcttctggagattatacaggagaaaaacagacaaatctgatgcaagctgagtgctggctgagatcagcaggtgcaccccatttagtgttcacacttctcttaccgagcctgtgatcctgcctccaatccagacttgaccctggttgagcgcgctgacagaacactggattcgataattaatattgaagttgtggatggaaaccaggttgcccctgtagcacctccggcaagtaaactacagggcaggataaaagacaaagaatggagcatccttcctacatgaattcacatgggtcttgagtccccacaattcattccctccctcccctgccacaaccatttgaaggttggagaccaaaatgcaacttctgtttgtaggtggccctcccctcttaccccaacacctctctgaggctcaggttctactgacacccccagggccctcaatgggaaaaagagccagtgatagcaatgctgggggcatatcccacacccgttccatgctcccacctcagcctcagccataggccactcacccaagcttgactaaacgtctgaagacttctcaccaggaggtagcggcaggtctggcacccagggatgcccaccacttttactgtgtcctcttcctcaggacacgtaaggtttttgtccaccatatctggcactgagatagactcaacagccccatctttcttggaggcatcttcacttccagagccccactcctcctcttcctccagctccctgcaaggggtctcctccatctcctgctctggtgtctcctcatcctcaggcagcgtcttagcacccaaaggggtctcaaaggtggaagtctcagaccctggcagggaggatagctaagtgtccttccttcacatctccccttgttcctccccagaaccacagacagctcacaccttgccctgggcatcagagtgctcaactctgcctgggaaggggaacctggaacccagtctctatgaggggaacccaagctgcctgacaaggtcaaggtggttaagagcatggacttagagtcgggcagtcatgggcttgggtactggttccatcatccaccagctgtatttctgtgaaatgggtatacaataccacctacttcatggcgatgctaagagagttaaaggagagaaggcactcagtaagctcaaagtaagcataatggagaaaggacaaaattgggaatgtcacagtagaaccaagaccacagacataacagacgccttgagaaatcctttcaactcctggccatagagtccccatccctttaagcacacagaaattcagaaatagaagacgatcaaagaagggggtgggtgtgtaactctgaccccatctaccatagaaagggaaaaaacagagaaagaaagactgaaggcaaaaaacacttacttagatgaagagcagaaactgccccaaatagaagagccagaagtaaggggagtttcatcttggctttatcctgcaacggagaacacagtttgtcattgacacacacagacacacatgcacacacatcacaatcacaccattaggggaccgtgggagtgaggtggagaaaaagaaggcctgaatagaaatcaggatgggccagaaaagctcatgccaagcccagctcctgatgctccaggatccaggacgcaaggacctctttctaaacagaacgcagcaaaccctgaggggtggctgaggctggctttccttcaggcccggaagtaaagaagggactattacgcttatttgtttgtacttaatgggtccctcagagtctatgacataaaaaaggcgggagaagcaatgattattggctttcctaggaacacataggacttagaaggtatgtcccctcctcagagttcaagaagccacccacaccctcctccatgtctccaccatctcctttccccagccaaggagcactttcacatcccgcagaaggaatgtgcaaggcagaggatgaaggctgcccctgctgacatcctcataacctgaaagccacaggtagacgcctgccagccctccagaaactgtcagccacagccagggacctcctgggagaataaactgtcaccagctccaccacagcagagaaagcactcacccacccagagaccttcctgggtctttagatcttcccaaagcccaggtccttctttgcttcctctcacaaagacttcttatatagaggccttggaggaacttcccccagggagagagagtttgcctctgtcagagggagatagcaaggctgataaggaccatttcatcacttccctggggagcccactcattcattcagtgaagatttctctcccgatacccacttcaggaacccaggggccatctggaacagctctgggcaatggttcttatcctgggctacacttcagaatcgccttgggtgcttttccaaaatacatatctcccctgttttactggtgttttgaactgccacaaacattttgagaacaaatctgtccatacctattaaaataaaaaaatgcacatttgatcagtttcactcttttgagactatcctttaggcataaatgcgcctataagtaataaaacttttacagagttatgttattccttgactatttgtagaaatgaaaacaatattgatatccatcaatcggacactgagtaaaatgtgtcctctctattctacagaatgttatatggctatgaaaagaagagctggacctgtatctataaacctgaagagatgtttctgtgacatgaagtgaaaaaaggcaagatactgaggaaagtatttagtatgtgaatagttttacaaggaaaaaaaaaacccccgcataggtgcttatctgtgagcatccttatgtgaccattgatggagggaatgctaaaaggaatcacaccaaatagttgaccttgttgcctccagaagcaggggaggagagggaagaaagcaggagacagattgttgtttatcttctttttataactttgcatttcttcagtggttatggtaaatgcgtgctgaatctgtaattttgaggctgccttattaaagatttttaaaaatatgcagatgccctgcccagaaacttctgcttggctaataggtctagcgtgaaggtcagatgtctgcatttttttaaaagcttcccagctgactgtgatggaagatgggtctaggagtcactgtcctgaggatcttcaagtacaggaaatgttcacgtatgtctaacttccttccttctgaatcagaccactcagttggccaacctaccagccttcattatggtaacatttactgaacatttttaaatgccatgcatggcaagtggctggatgcagtggctcatgcctgtgatcccagcactttgggaggctgaggtgggtggatcttttgaggtcaggaggttgagaccagcctggccaacattgcaaagccttgtctctactaaaaatacaaaaattagtcaggcataggggtggctgcctgtaatcccagctacttgggagtctgaggcaggagaatcacttgaacccaggaagtagaggttgcagtgagctgagattgcaccactgcactccagcttgggcgagagagtgagactccgtttcaatcaatcatcaatcaacaaaatactgttcatggcaagtattacctcatttaacctgattttaaaaacctagtgaggtaggtggttgataccccattttccaagtgagacaacccaggctctgtgtggctcctgatctccccgcaacactgcccttattggatcgatgccctgtatacaccctcttgtagctccaggggcttgtccttatcagttagtcattttacttttcttgtgagattacttggttaatggattaacatctgtcttccttcgtgatggtgaaggctgcatctctttactcaccattgtatccttggtgcttagtacagtgcccggcacatagtaggtacttaataaatatacattgaagtaattaatggttaagtaacgtactcacgtaaacaacagggttagaattcaaatccagttctttctggcaccaaacttctctcccctcccatatgcctgcttgtgtgtcaaaaatgatgctatccaggtggagataaaatcagagtgaagcatagatcctgtattcaattagcttacaacctaatttgtaagatgagtaaattgaggtcaaacaaaaggagaagggttaagaccaagctaggaaacatcctctgctaattcagaaggaagtccatgcatagtaaaacagagcagaaaaggctccatgaaccaaggagctgattcctacctggatggaaagatgcaattagaagggaaggaaacaggcatttcaagtagaaggaacagcttgagcaaaggtgtggaggttggacagccttggtatatgcacaggacactgtaatttccttcataactaaagttaacagtacacacattgggaaggaatgagaaaaacgaggaacgatgcatttcatcttgagccgaggatggagataaccctcccctgtctccattgatttaaaaagacagaagcaggaatcaaaggaatactcaacaagagcctagtcaggagctttgagctgggctctgcgcactcccatctgcaagccctccccacaggacctctttggctgttggacagaggattactgtcataaggtgatgagagggagcccattcttggaaaccagttgactgttcagggaccctcactcctagggaagtctctcttttaggtcatacaatccaggatctgaaatccacagcttagcaaccctgaaaatttcatcaacattcactggaagtatacagcagtgtctgagagggtggcttctggagtcagacagtccaagtcagactcagattgactgggtctagcacttaatagctgcgtgtcgtgtcctgggcaagttccttaaactttctgtacctcatatcatcatttatgaagtagagatgacaatacctacctcactgggtagtgtgagaaatgaatgagataattcacatgtagcatgcatgctgtgagctgcccagtcacctcaccccttcctgtggtttcttggattccatttcctatggatcttggtggaggacaggcctctcatttttgaagacaaaagttcctaatagattttcagcttcctttgcagctaacgcatatgactgggctctatcaaagagaagaagcatctattcaagattttgaatctggagctagtgaccaaaaagatggaggccaagaaggcctctctctggcggtggcgttgacaagattgagttcctggagttgcagtacccacagaggcactgcaggatacattgatccagggtctgagccctacaacatcctgggtgccagacacaaggtctaggtctcagcagcagtgggatcctccctagacctgttctgcagcctgactttggctccatgtctggttttccggcccttcctgcaatttcatgagctactccgtttcctttcagtcctggatttttctacttagatcagccaaggagagtttctgctgcctgccattaagagccctgactgatgcagcatttagcacagaaactggtatttagtaattgcttagtaaatgaatgctacccagggtctttgagtgtgaccagcattaatcaaactttcaagagactgatgtctacttttggtgccaatgacataaatgaggttgaacggtactcacaaggggcccacttgcccaggctctctgataagcacattctttccctgcatcacaactgtggtgtgctcaggacttgaatttcaaatgggagcgaagagctggaggccttggggtccagtgcctttgagcaagagaacgatacccatcatctccgtttaatcctcagccctgcctccttccccaagaaatgttgactcaacactgcaggatcctgaatcttaggcatcctcctttctagccctaaagttactacagagcttggaggttcctaaacagactcagtcaatcctctccataccagcacttccaaaggggacctgacagatcacctctgcatttaatcttttctgatctaattctcggggggctcatcccaactttaggcttgtgggggagtgtgctgtagctcctggtacaagctgtccagggtcagacctggtactgaggggtctgctcttctacaagagtgggctgttgcaacaggagaaaaacatgtgtgcaccaggcagagcagagatcaccttggagatggtgtcaataccaaggagctcttgggatgcccctcccatgcccaacccccaacacatgacagcttaaagactaaaaaaaccaccacagctccagatatgcagctcacactattcagccctcacctccacctgcatccctccccacaccctgcagcagagcttttcaacctggaaactatgaataggcttcaagggaccatgaaccctgcaattatagaaaacatggtgtgatgtttctagggtgaaggtccaaaccctccatgagattctttgatgacttcccaaaaggcaagagaacctctaactttactgagtgatttttttctggaagaaccaagaatgacattccactgttcttcaccaataaagtcctgcttggcccttttgacaggcagaattcagttgtcccctggtgcactgtgcataatccctgggactgtaaatatgatggattttactcctgtggttgtgtgatgttacatgccacagttgactttaaggaaaaggaactgccctctatgggtatgatctaatcaggtgatcccataaaagagacagggctctcttcctgaagtcagagagtccaaccatgtgggtgattcaatccaagggaaattctccatcactggcttcaaggatggaaaagaccacgcacgtggcaagcaatgtgggcagcctcgaggacctgagagcagccctcatctgacagtcagcaagaaaacaggacctcagccctgcaactccagggaacagaattctgccacaaccacgtgagcctggaagagaaccctaaactccagatgagcacacagcccagacaacatcttgattttagccttgtgagaccctgagcagaaaacctagccatgctgggcccacactgctgatgaactcacgatgagctaataaacatgagttgtttgaagctgctaaatttgaggcaatttgttatgcagaatagaagactaatacagccctcaaggcccatctccctcccacggtgaaatttacagtgggtgtagggattggcagagaagggtcccacaggaacgggctgaggagctgctggaaaataacgaaggtacagcagagaggtaagatggacactgagaaagggaggtttgattcaggccagagatcccaccattctctccctcagaccataggaagccaggtggcccttctagttacatgttctgctccaggattctctccccaccctcagaaaagtgacagactccagggacctgatctctggggctgatcaactgcttgttaactgggcttggccaacatccccacggggcagataaaagctggtgaaagagctaacgccactgcaagggtgaatggctcgggagatatggactgggcggttgttctgtgaaatcggcctggacaacagttccccatttggatgccccaacaattgacatagaccaagacgattggcatgtgagatctggaaggccccttagaaacgaaccagcacagtccccacgtctcagatgggttcttcccgcttcctcaggaagtgacattatcctctttcccctccaggaacctctgctcccagagaccatgaacactcagtgagcttagaaggaatatgtctttgcagtaattgcctcccctgccccatcttctaccttccccagtccgtctacttctccctatctctgctgccacctcactagcccctgcgaccatatttgataacatgtatcacaggccattgtccccatgcttcccattcaaagtcttcccacatagtagcaattaacccaaacccattaccaccatctgcaaagtctttcatgatcaggctcttgtctacaagctcaaactcactggcatgacaagtgacccttgtcatcctggtcccagctccactggccaagctaaagcatttgtactggttaaaaggccacctcctcagataagccttctccgagaactctttctaaaagaagcccacccaccccactctcctatttggtacttttgttacacatcatcacatttatttccacaagaacatttaccaaaatgatataatcttgctttcttactggtttcttgtttattatctctctccttcagaaagcaaacttcatgacaacaaggaccttgtctgtcttgttcactgcctataactctgcccaggtcatagaaggagtttttccattacataatgaattaattaatcaattgactaatcaacttgaactttaccccctggagaaagtttagctgagtttagatcagagcacacatgcatttatttcgattctacaggtattttctgagcctcatccaccatggacacaagcctctaccaggctctggatcatcgattgattcattcatttattcaacaaatacttaaagagaatctctagttgcagggaggtttaaggtagctgataaataaggcaaacagaacgagcatattagtaaaacaaggcaatatattgaggagatactcagaagtgtagaactaacatgaatggaagagacacacattttcagtgttgtcaggatcacttaaagtgtgacggcaggcagagaaggcttgcttgaggaggtagcgcttagcctgggctcaacagactgacagataggataggataagcagaggagaagtgggatggcatttctaggggccaaccatctcctggtagtgctggaatttgagccaggatatggatgattttgtgtttcttggaggttaagtcaatgagtgagctggcttctctgctttgcaccaaagccaagctcctccagcaagtggtgtagactcgctggccacttcctcaacaccctcttcctcctcttaccatagcagtcttgtttctgttatccctattgctccaccaaaactgcttttgcccaggtgcccactgactaccccattgccaaacccaacagacattcttcagttcttatcctacttgacctctgcagtagtgatacctcttcacttcccccttcttaagaactgcttcccttctcagtagcctttgtggccattccctcccaatttctgttggcaggctcctcttattcttccagatggttaaatattggggatcacctggcttcttggtgcacgtctctcctaattctgcacacccaccacgggttatgtcatctactcttgtggctcaagctaccaaatatatacgcagatcattcccaagtcttcatctccagccccaggcctgtttctgagctgcagactcacacatatggtcacccaagatgcttctccacttggatgtcccatggacattgtgagtccaacacatctcagactgaactcaacacacacacacacacacacacacacacacgcacaaacctgcttcactttttgtggtcactttctcaggagaaaccatcaccttccaactagacctgcaaggcaggactctggtcatccttcacccctcctgcccatcatccacacattagttagttatagtgctttcttcaccatctcatccagccacccatccccattgcctctgccactttcctagtcacctgctgaccgtttttcacctggatcatttcagtggctcccaaattactttccctgcctccagtcttaccaccctcctccacctctgatgcactgtctacaagcagccaaaatgagctttctaaaacccagagctaatcacaccagcactttccaattactccttcttgctctcaggcacagtctccttatgttttagcgcctacttacctaaacctctcaacactgtggacatttttgactggatacttttttgttacagaggcctgtcctgtgcattgttagatgtttagcagcctctctagcctctaccaaaaagatactagtagtaccttctcggctgggctgtgacaatcaaaaaatgtctgcagacattaccaaatgtcccctctgaggcaaaactatgctcagttgagaaccacttcttgacaacctcaattctccccctcaccacacacacacagtgctccaatcatgttgaacaccctgctattttcctaacatgccatgatcacccatattttgtcacatgtcatttcatctgcccagaatgccctttcctccctaaccactgcgctctttccttttcttcatcgaagtttcagccaaggatcacctcttccaggaagcctgccttggctctcccagagaaaggtagcaaggacactaatcagggcttctctctagtccagccctcttcccacctcattgtagcaatcttcttgctgtttccccagtagagccagagccttgcttccttcacctgtgcctctctggtcctgcacagttctggaaacacagtacaggctcaattcatgtttgctgtgtaagtgaataaatgaagaaaagcaatttttgtttaagcttgtcaaagattgagttgggctccctgaaatgagaccttaggcagaaattttaataacgataacaacagcagcaactaatatttaggaagtgtttctaggtgctaagtatgttaagtgctccatattattcaaccttctaaacaactctaggacacaagtgccattaaactacctaaattacagacaaacagctgatcctgggaatggttaagtcattttccaggtaagtgtcagagccaggatccgaatggagcggctgcactcttgtccgtgactcacttcccctgtggtggtgaataactagcacaaagccatttacatacgttgtttaatgtaacttaccctgtaagttgcatggggcaggtgatgatttggaaagcacaaagaatgtggtcctcggatgttaaaagaccctggttaaaaaataaaaataaaaaaataaaaaaataaaagaccctggttccattcttggctctgctgcccataagctggacctccttggcagttccctcatccccccagtctcctgttgctcatctgtgagttgttaaggatgaccacctcacagatgttgcagggcttgaggaggaccaattgaaatgtggtggtacaataatctactaagtgcctgaaacatggtgcccccaacaaacaaacaacaatgctgaatattgtcctatgttagggatagaaaaagcaaggcttggaaaacttaagtgatagtccaaattttgcatgccagcaaacggtggagcttggaaaagaactctaagtcttccgttggccatgaggagaaattttctgagcctcttctgcataagtgctcattaccgtgtgagacacatcacagtcctcaccatcagggaactagaagctcagagctgggattgtaggttgaatctctctctctctctctccctctcctctctctctctctctctctctcatgtccagtatttactgagcctccattctgtgctaagtagggtacaaagttctcaggatacagtaggcaatacaaaatatacagctgctgcctgcgtggagttcccaaatgaaagcctaatggaagacacaactgaatatttttaaaatcctatgatggtacattaaactgcaactgtgacaagctctatgccagagaggtacctggtgctatgaaaaccagtactaggtaacagtacagaaaggaagggatatctgagctgagaactgagggaactataggagttagctataggttgggtaggacacattccacagaaacacaataaaactgtttcacagccaggtgcggtggctcatgccagtaatcccagcactttgggagtctgagttgggcagatcacaaggtcaggagtttgagaccagtctggccaatatggtgaaac

SEQ ID NO: 12109 - DNA, 25370 bp, Human
agggccaggtttgtccactcattcaataatatgtctagaactattatgtggcaggcacagggacatacagagatgtccaaaggcatggtccctgctctccgggagcttctggtcttagcatgggacacagtcactaagtcaacgagatcctactggatagtgacaggtgctctaagggaataagatgagataatgggatagaaagtggctgggctgggactgggggctactttgggtgggcaataataacaggcctttttgaagaaatggcagttgagttgaaatggatgaaaagatgcaaagatccacgctttcccaaatgacagtttgagagcaaaatacaggttcccagccccatcttagatttcgtgaatgaaaatttgaggggcagggcctaggaatttgcctttttttcttccacatgattcccatgcactttgaaactggacaccttccttggggcttttactttagaatcacactgatgaatttcagggtaccttccagttccccgagtctgtggcttagggaagggagcctctttgtgtgtgaaagccaggggtagggagaggagcaggactgcttgtggtcagactgcaggatgcagaaaataagcgtgcgcagctcctcaccacaccgcgctcacccagggccctgcgtctttggctgtcaggagttctaaacctgccccccgggaggccctccctcatcccactcccactcctgttgaattccacatactgagagggttgcagtcatagctgcatggatcagttctatttcttgtgcgttgggaaccattccaaacagttggtacatgcgcactctccaggcatatttttaggatcctagggtgggttgcctgtgtctccccgcccccaccccgtctgccccccacccccgcaccatccgccctgagtgtgggagggaggtcttcatgctgccggcactcgggacctgcctgaccaccgactccgccggagtgtgggcttttaaacctgcagcagctgctgcagtagaaacgcgcgttagtcgcagcagacacaggcagcctcaggtgggacaagtcttgtctcttccagcctgtgggggagccacggcttcccccccacaaccaccccctgcccacggagcaagaatgtatctccctggcaggagacctggcgcgaggtgaatggagaaacctgttgtgtccccttccttcctcccctggcctcagttccccatctattcaataggaagaaccctttgggatttctttgcgagagaaaggggagttttgctttaaacggagctcttcccggccgtgcgcggtggctcacgcctgtaatcccagcactttgggaggccgaggtgggcggatcacctgaggtcaggagttcaagaccagcctggccaacatggtgaaaccccgtctctactaaaaatacaaaaattatcacgcctgtagtcccagctacttgggaggctgaggcaggagaatcgcttgaacccgggaggcggaggtagcagtgagctgagatcgcaccactgcactccagcctcggcgacagagcgaggctccgtctcaaaaataaatgaataaataaatttaaaataaaataaaaaggagcccttccccctttcacttcctctcctccgcgatcgctgctttcagctgggcaacagcacagggcggtcctgcgcatccggggggctgcgctcccagaccggtggctggggagtaggttgcaggggtgtcactgtgtcaggggaggaggaggaggaggaggaagaagaggtagcggcaaggtcgcggtctgaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtgtaagttctccgcggacttttgggaaggcgggggaggggcagggcgggtgccagccgccgcgtccttctccagggtcctggaattcgcaggcgtgcacgcggttttcccggtagctgggggtctgtgagcctgcttgctgtgggggtcctctttgggtccttgggtgtaggagtagggtgtagagagggggctctccactcccccactggcgctagaggtgatgagaggtgggcaggggccttctggtttcctcgatttatcaggctttccctgcagctgcttctcccagagtcgggtccccacgtgttagggccatgggaagggggcagggatgccagggggctgggtggcagctgtcgccccaggagcctccctgggccttggcctggcagctgacccaggcgccggcaggttatttataatcacagggtgtcactgcctactcagagctggagaaactcatcagcccggcatgttcctgagctcccttccggtcaacttgccccacccgcggccagcctctctggtgtccagctgggggtcctgcccagaggcctctatctctgcacccagctcggccatccccttcccccatcctcatgccacctggcaggagctggcgccacaaagccaaagaggcaacttgtggaggctgctctgccaggcgccttcagagccctgaccccggggtgggtggggggtgagcaggtggaggggagaagcagcgctggacaatggggatgcgcctcattccactcgttcagtaaatgcggtggagttcctcctgcttcctcctgggagggcagccctgacgcctggctctccctcggaggtccagcagtccgcgttctctgagctgcatccccaggcccctggccgcctcccacctgagcggcctcgtaggcgctgtgctgttgctcagccaggcctgcccgtcctcctccactcccttagcatccactcagcccccagatctgggctttccagtaactccctctcccttcctccctggccttcccacagtgtaattattgggcttatttgggggatcatttgcctgatgtcgctgtcagtccgggaatgccctgagggtggggccccagcagcacttaactgcttagggaatagatgtgaaatgaacgcgtgaatgaataaatggagttgcttttgcttgaacaatagaaatttaattctcgcagtcctggatgtggaaatctgagacgagggtggtagcatggttcggggtctcagggggggctctctccttggcttgcagatggccaccctctcgctgtgtcctcacatggcagggaaagcaggacatatttaactaagtacaagtatgaaaattaggaaattggcggccgggcgctgtggctcatgcctataatcccagccctttgggaagccgaggtgggtggatcacctgaggtcaggagttcgagaccagcctggccaacatggagaaaccctgtttctactaaaaatacaaaacaattagctgggcatgatagtggcgcctgtaatcccagctaatcgggaggctgaggcaggagaatctgtctctatggatttgcctattctgggtatttcgtataaatgaaattgtatagtatgcggcctttttttttttttttctggcttctttcacttggtgtcatgttttcaaggttcacccatgttgtggcatctatcagccctccattcctctctgtggctgatactatcctgccgtgtggggctgccacattgtggtcatgcattcatcagctgatggacatttgggtggttttcacaccgctgagtgtagtggctcatgcctgtaaccccagcactttgggagaggagaccgcggtggctggatcacttgaggtcaggagttcaaggctagcctgaccaacgtggtaaaaccccgtctctactaaaaattcaaaaattggctgggtgtggtggcgagcgcatgtaatctcagctactcgcaccagtgcactccagcagcctgggcagcagagcaagactgtctcaaaaaaaaaaaaagaagaagaatgcttctgagaacattcatgtacaagttttttgtgaacatgttttcaattttttaatttttaattattattattattatttttgagatggagtttcgctcttgttgcccaggctggagtgcaatggcatgatctcagctcactacaacctctgcctcctgggttcaagagattctcctgcctcagcctctggattaactgggattacaggcatgggccaccatgcctggctaatttttgtatttttttagtagacacggagtttcaccatgttggtcaggctggcctcgaactcctgacctcaggtgatccacctgccttggcctcccaaagtgctgggatgacaggcgggagccactgtgcctggccatgttctcaatctcttgggaattttctggcttatctggtaactcgatccttaaccttttgaggaactgctaaactgttttctaccataactacctcattttacatccctatcagtgatatacgggggttctaatttcttcacaacctcatcaacacctgttatctgtagggtttttaaaaaatgatagccatcctagtggaagtgaagtggtgttttattgtggttttgatttgtatttccctaatgaccaatggtgtttgtcatcttttcatatgcttaattgggcatttgtgtatctctctctctcttttttttttttttttttttgagaaatgtctattcaaatcctttgctcatttttaaattggattatttggctttttattgttaaattataagagttttttgtatcttctggatactaaacccttaccagctacattatttcaaatgttttctcccattctgtgggttgtcttttcactttcttgagagtgtcttttgatgcatgaacattttaaatttttatgaagtccaacttacctattttttcttttattgcttgcgtttttagtgtcaacaagtatgggatttgtactcttatttcatttttttgttgttgtttttgaggctgggtctcaccctgtcacctgggcacaatcatggctcactgcagcctcgacctcccaggctcaagggatcctcccacctcagcctcccgagtagctgggacgacaggctggtgccaccatgcctagattacttttttgtttttcatagagatggggtctcactgtgttgccccggctggtctcaaactcctgggctcaagcgatcctcctgccttggtctcccaaagtgctaggagtacaggcgcgagccaccgtgcctggcctgtactcttattttgtagaatgcccctcagtttgggtttgtttgaggtctcctcgtgattggtttcaggttaggcaccatcacaaccccagagggaggcgctgtcaccccatgttatgtatgggaaattggcttgcctggggtcaccaaaccagtatgtggcttcagcccaggcttgtccacttggggcctctgagtggacagtggtctttgcctcttttatttatttatttatttattttttgagacagaatctcactctgtcgcccaggctggagtgcagtggtgcgatctctgcttactgcaagctctgcctcccgggttcacgccattctcctgcctcagcctcctgagtagctgggactacaggcgcccaccaccatgcctggctaattttttgtatttttttttttttttttgagtagagacagggtttcactgtgttagccaggatggtctcaatctcctgaccttgcgatctgcctgcctcggattataggcgtgagccactgcgcccggctggtctttgcctcttcagggcccccatctctagggttgcttgtcgcctctgctgcttgcaggactgggtttcagtcagcagtgggagctgtggcccctgcccaggagctggtgggacaggtggagccctgagcctgctccacctcaactaggagttgctgtgactgctaccccaccccaaggcctggggaagctccccgaagccagcagagtggctgatgcccacgtaccggcccccttcccacagatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccaggtctgagtccccacctagcacacggccaaggctggcagggactgcctggttcgggtgggtcacacgggaagcttcttggatacgcagggacccccatccatcatctctcttggcccaagacagctgccagggcttgcagagagcaaccctgtccagatcctacctcccatgccaaacccctgccctctttgactgtgccgcgggtgactgctctgttctatctgagtctgctgagaacaaatgggacccagagaactttcaggtcattgtgagtcaggtgggctggcacagagaaccccccttctaagtcactgcctctgggaatagctctccagcctgttcacagttggccagggccagggcagcctgagccctgcgcccacttctcccggatcctggggcagttggggtttgtgagtctggaggagatctatcaatggacatctacctggggactgtggggtccatgagcagatgggcagagtataccaagtttgtggccccattatccccaaaacccaggcagagggaccgccctctttcaggtaacgctggaaaggtggggtggtccctaaggggcaggaggaggttcctcagtgcctctctggttccttagggagagaacgtcttttttgtggtcaccaacctgattgtgaccccaaccagcggcagaacgtctgtgctgaggtttgatttggcgaggggccctggcgtgggggtgggagagccaccggcagtggttggggtctactctcttctgaagcaagggtgtctgtccactccaagggtctcgggtggctgtgtgcacccgggtgtggttcctgcattatatgggggagaagtaggttctcagagtgtgtgtgggccaggccgaagaagaacccctattctatctcctggagtgggacccggctctgagctgggggaacccccccatccaggtgccccttctctcctggcagaatgaaggcattcctgatggcgcgtgctccaaggacagcgactgccacgctggggaagcggttacagctggaaacggtgagggcctggagcggccacgggctgaaggaggactcggagtgggaggctcctggcattgatcctgtcccacccctgcaggagtgaagaccggccgctgcctgcggagagagaacttggccaggggcacctgtgagatctttgcctggtgcccgttggagacaagctccaggccggagtgagtggctgcagcctcaggaccctgaggggtttcccagccccgtgcggtgggtcccagcctgagggtggagtcctgcccactctgggagcctcacgctgagggaggagtcaggctgtcccagcgaggcccgacggcctccccagcatgagcaaattaactgtcctgggcagaggctccaggggacccaaggaacaggcctcacactggcccaggcctgggggaggggcacaggggtggggcctcctggacaggctgttctgggttggttttcagggagccattcctgaaggaggccgaagacttcaccattttcataaagaaccacatccgtttccccaaattcaacttctccaagtacgtgggcttggctactgggggccacgggtgggccttggtcgatgaggggccttggctggccctccgtgggtctctgcctgggggtgtgtgtgcgcgcgtgtgtgcacgtgtgtgcgtgtgttcgcgtgtgtgcgtgtgtgcgcgtgcatgtgtctgtgtgcatgtgtgcgtgcgtttgtgtgtgtgcgtgtgttcgcgtgtgtgcgtgcgtgcacgcgtgtgtgcgtgtgtgtgtgatgtctgcatgtgagtgggtgatgtctgcatgtgaataaacggtgggtggcgctggggcgccccttcccctgctgtaaagtggggtgttgctgcggggagctgtcagcactcaggttggtgagggaccgagtgactcctggccaggccgggaaacatcaagtcttacttcatttctcggctgcccatggcctccacccagaagcaatgtgatggacgtcaaggacagatctttcctgaaatcatgccactttggccccaagaaccactactgccccatcttccgactgggctccgtgatccgctgggccgggagcgacttccaggatatagccctggaggtgggtggggtgcacgcagggagccctccctgagggcctgggggcactgggcctggctctgtgacgaggagggtgtggacggggactcgtggggcgagggtggccctgcaaagtcacctgcccccagggactcagtgttttcagaactggctgtggcacacaggcaggccgtggcagcgggcgagggtggccctgcaaagtcacctgcccccagggactcagtgttttcagaactggctgtggcacacaggcaggccgtggcagcgggcgagggtggccctgcaaagtcacctgcccccagggactcagtgttttcagaactggctgtggcacacaggcaggctgtggcagcgctcagaccacgggcagtcagtgagagccagacctggcacctgctgtgcggttctgagtccttggggcaccagccgaaggtgaggcagagggaccccctttggcacatgctggctggagtgtgaagtgcctgtccagagaggcctaccctgtgcggctcccttctccctgaagaacgagggaggcagccctgaggcagggacgacgcagtgttctcagccgctccatggggggactaagcctcctggagggtggtctcgaggggctgacctcgtgcctgagcacctcctcctattgtccagtgccggtgaagggctggcctgggatgctgtccgtctccggaaagctgtgtgtgctgaccctcatctctcttttatcaagggtggcgtgataggaattaatattgaatggaactgtgatcttgataaagctgcctctgagtgccaccctcactattcttttagccgtctggacaataaactttcaaagtctgtctcctccgggtacaacttcaggtaaccgctgccttgtgcccacttgtgacctgaccatgatcagtggcactcactcatctgggtgccagcactattgaggccccttcctgggggtgggtgtcagagcgggaggtgcagggacagatggcccaggagaggtgtggaccccagcagagtggccagcgactgaagctgggggtgcctctgggagaggagagcgcgtgttcttgcctgtttctctccgtgaagccgagtcttgcggcctctgccgcatcctttccatccgcgctttggcgacccaagggttgctcagagtagggtggggaagcccttgctcctcagggaatgtctggcagggatttcaaatagctggatgcctctttgtttttggctcagtgagaaggtctgcaagccactcctggggctgctgagagtcagggttccgggagtccttctaagtccccagagcagccacatcagtgctgcctaaagagggaaggccaggcaggctgaggcctcccctgggccctgtctccctcagatttgccagatattaccgagacgcagccggggtggagttccgcaccctgatgaaagcctacgggatccgctttgacgtgatggtgaacggcaaggtgcgtgtgccttctcctgttctgaggctgggcggggggcgggggctgggagggggacgttgggagggtccctgggggcccagctgtgtgttctcctgttctgaggctgggcggggggcgggggacgttgggagggtccctgggggcccagctgtgtgttctcctgttctgaggctgggcggggggcgggggacgttgggagggtccctgggggcccagctgtgtgttctcctgttctcaggctgggagggggacgttgggagggtccctgggggtcccgctgtgcgttctcctgttctgaggctgggcggggggcgggggacgttgggagggtccctgggggtcccgctgtgtgttctcctgttctgaggctgggcggggggcgggggacgttgggagggtccctgggggcccagctgtgtgttctcctgttctcaggctgggagggggacgttgggagggtccctgggggcccagctgtgtgttctcctgttctgaggctgggcggggggcgggggacgttgggagggtccctgggggcccagctgtgtgttctcctgttctgaggctgggcggggggcgggggacgttgggagggtccctgggggcccagctgtgtgttctcctgttctcaggctgggagggggacgttgggagggtccctgggggcccagctgtgcgttctcctgttctgaggctgggcggggggcgggggacgttgggagggtccctgggggcccagctgtgtgttctcctgttctgaggctgggcggggggcgggggacgttgggagggtccctgggggtcccgctgtgcgttctcctgttctgaggctgggcgggggggcgggggacgttgggagggtccctgggggccccgctgtgtgttctcctgttctcaggctgggagggggacgttgggagggtccctgggggccccgctgtgcgttctcctgttctgaggctgggcgggagggggggagagccgggggacgctgggagggtccctgggggccccgctgtccaacctgcctcgctcactggccttgtctctatcttccaggcagggaagttcagcatcattcccaccatcatcaacgtgggctctggggtggcgctcatgggtgctgggagtacctcccctccctccccgcgtcccaccctctccccggcggccgcactggcagggagggggaggctgctgttcaggaggaccgtgtcccagtgcccccagaaagaaccagagctggcaagatcagaataggcgtgggaaaagagggctttctgggatttcacgctctgccagctgtcctcaggtagcagtgacagcccgagtctctttccagagccagggaggcatgtgctggtagctctgcagctgtgcatgggtttaggtcagtccccagccgaggcgtggctgggatatccctgggatcccaggtgagtccctgaacttctaaagtctctatctctacttctgctaaaagagggcaggattaggccgggcgcagtgactcacacctgtaatcccagtgctttgggagggtgaggtggcggatcacctgaggttgtgagttcgagaccagcctgaccaacatggagaaaccctgcctctactaaaaatacaaaaattagccaggtgtggtggcacatgcttgtaatcccagctgctcaggaggctgaggcaggagaatcgcttgaacccgggaggaggaggttgcggtgagcccagatcacacaactgcaccccagcctggacaacaagagcaaaactccatctccaaaaaaaaaaaaaaaaaaaaaagggggcaggattaggctgcagacagtttcttagcctgggtgctgctgactttttgggtgggagaattctgtgttgtggtcttacacacatccttggacatgcccttaaacattccacaatgcacagagggctgtgctgggtgtcgtaggaggtttttgtttgttttctatttcatatttcacacttttctggtcgatactatattttcccagaccctgaggatgttgatttcagagacagggtttttgctctgttgcccaggctggagtgcagtggcatgatcatggctcactgcagtcttgaactcctgggctcaagcgatcctcccacctcagcctccccactagccagggctgcaggtgcaccaccacctgtggctaatttttaaattttttgtagaaatggggtctcactatgttggccaggctgatcttgaacccctgggctcaggcaatcctccggcattggcctccccaagtgctgggattaggggcgtgagccaccgcgcccagcccattgtaggatgtttaagagcattcccggtttctacccactagatgttaggggcaccctcccctgcagttgtgatggagcaaaatcccagctggctgagaaccacccgactgaaaggctgagaggcagggaaggcagccctgtgactcttccttagaggtggcccttcagtggggccgggagcggctcacaggggaggagacacagggactgagggcagggaaaggcgtcctgagtctacactgccccgtggtccttctggagtttttgagagccatgggagtggtcagtgcccatcccggcaggtccctttcccaggtttctggcagcctcttccctcattcctctccctgtgcacacaagacagccccactggaggagtccattgggacccaggggtgacttttgttaaaacctggaaaattgtgtcccataccaggaccacgttcctgggagggggtcaagaaaagtgagctccacatggatccctacctgcagacagtcactgggagggtcctggatgtttgcgcctgttactttcttacagaaggcccaccttcagctatcacttttctttttttttttttttttttgagatggagtctcactctgtcgcccaggctggagtgcaatggcatgatcttggctcactgcagcctctgcctcccaggctcaagcaattcttctgcctcagcctcctgagtagctgggattacaggcgtgcgccaccgcgcccggttaattttcgtatttttgtagagacagggtttcaccatgttggccaggctggtctccaactcctgacctcaggtgatccgcccacctcggcctcccagtgctgggatcacaggcgtgagccactgcgcccagcccattcatcactttcttgtgatgtgggtaaaatcagagcaccctctggggacagacctgtgaactggaagtaatggcgcaggaagaggtggtggtcaaggttaggtttggggttggtctctggggagcagcgaattggtaagcaacatttttggcatctaggggatggatgtgcagcacccagggtcaggggaccaagattccttgttggcccctccaccaacccttcccacctccactctcctctatcattcaggccccaaccctgccctgtgctgtgggtggagtctccctctgctggaggagaggggcaattgcatcgctctggtccgtagggcacgttttgggtgtgaggggctgagctggggtcgtccacctcatcatcttccttttttgtttgtttttgcttttgtttttgtctcttttgagatggagttttgctcttgttgcccaggctggagtgcagtggtgcgatcttggctcactgcaacctccacctcccgagttcaggcgattttcctgcctcagcgtcctgagtagctgggattacagacacccgccaccacgcccagctaatttttgtattttttagtagagacagggtttcaccatgttggccaggctggtctcgaactcctggcctcaggtgatccgcctgactcggcttcccaaagtgctgggattacaggcgtgagccactgcacctggcacccatcatctttctttgactagcaccatagcgtccttgttggttagaacccttccaacctatctcacactgactaccacagggatctttctaaatgccaaaattcgggctgtggtgcctccgcctcacctaaaggatgaggaccaatgcctcggaaacattctaagaagcctaacaggccagtccccatccccttctccagaagcgcatctccctcttcccgcacaggccctgcggcatttcccagatgtgacaggcttgttcctccctccgtaatgtccttccgcctctttgtcttgtataaactcctctttagtccttaaggactgaatagggaccctccccaggctgagtgaagtcctatgtgggtcgtcatcgacacgcctgtctcctgcaccagagggagagtccccaggaggtctctcttgtccagatcctctccgtacttcggtgcagacactggcacgtgctgggtgcccagcaaatgtgttgaaggaacgattggatggggtccgggtggtgcggggtcggggagtgcctggcctgtgggatcgggggagctccagtccagcttgagctccaccatggaccagctctgtggtgtcggacaagggtgccccttgctgagcccagtttcctcatctgttaaatggggacagtgatgccacctttaggggctgttgcaggatggaaggggcaaagtgccctaaatgaacagtgctctcagaggtctaggattctgaatcaggaacccctgttttgcagggtgctttcttctgcgacctggtactcatctacctcatcaaaaagagagagttttaccgtgacaagaagtacgaggaagtgaggtcagttccgcttccaggccggcggcccgagggcagccctgtggagcacccccgtggcttcgagcctttgccctgatgtgatattgatggctggggtgggaggcaggggctggagggcccggggaggagaagtgttctgagtacatgctctacagaaccggattcggcctcggcagcagtgggaggagagggcgctgtgggccacagggcgggagacggagttcacaggctccgcctgattctggacaagtcccaggcctccccgggcctcggtttctctatctgggagatgagagagttggtttaccaatcgagtggtgtctgcagcacttctgttttgggattcttggacttggtggtcctggtgcgccggggctgagggaagctggagtagtaaaggaaagaaaagcggatattttcttccatgcagaggctgtttccggagtttcctgggccctgggttcggtggggtgtgcgtgttcacagcggcagagcacagcgtgggtggggaaccctgatgactgtgggagggcgggaaggggaaggggctgtggcttcggcctttggggaaggccttctggagaagcagggatcagaatgggaattgggacagacaccttagtactccctcagcacccccacagcctgggacagtgggtgcagggtctgcctgggtcattcgccttactgcactccagctacggcctgaaccccagccctgggttatagccctgcgccctgaccctggccacaggctgaaccccaaccacagtcctgactgtgctgctgaaggaagcagggtagaggaagccgggtggaggacgctgggtggaggatgcagggtggaggacgctgggtggaggacgcagggtggaggatgcagggtggaggatgcagggtggaggacactgggtggaggatgcagggtggaggacgctgggtggaggacgcagggtggaggatgcagggtggaggatgcagggtggaggacgctgggtggaggatgcagggtggaggacactaggtggaggactcagggtggaggatgcagggtggaggacgctgggtggaggatgcagggtggaggatgcagggtggaggatgcagggtggaggacactgggtggaggatgcagggtggaggacgctgggtggaggacgcagggtggaggatgcagggtggaggatgcagggtggaggacccaggatggaggaagcagggtggtggcctgcagggtggaggacccaggatggaggaagcagggtagaggaagccgggtggaggaagcagggtggaggacgccgggtggaggacgctgggtggaggacgcagggtggaggatgcagggtggaggatgcagggtggaggacactgggtggaggatgcagggtggaggacactgggtggaggactcagggtggaggatgcagggtggaggatgcagggtggaggacgctgggtggaggatgcagggtggaggatgcagggtggaggacgcagggtggaggacactgggtggaggacgcagggtggaggatgcagggtggaggacactgggtggaggatgcagggtggaggacactgggtggaggatgcagggtggaggacgctgggtggaggacgcagggtggaggatgcagggtggaggatgcagggtggaggacactgggtggaggacgcagggtggaggatgcagggtggaggatgcagggtggaggacgctgggtggaggacgtaggatggaggaagccaggtggaggatgcagggtggaggatgtagggtggagggagctgggtggaggactcagggtggaggacgccacgtggaggaagcagggtggaggactcagggtggagagagcagggtggaggatgcagggtggagggagccgcatggaggaagcagggtggaggacaccggctggaggaagcagggtggcggcctgcagggcgagggattcttcaaggcccactccgcccgtctaggaggggaggcaccctgcagggccgtcccaggtgaacagcttgtatcttgtccaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggtgaggccactgctaggcagagagcccgacagctgggtcctgcagagaggggtccccagttggggcttctcatgcctggcagctccagcggacccctctgctctggtgtgagctggccacaaggcaggacatctaggaactgggagagcctctgtgggaaggggctggtgctttaccccgcaaggtcccccttagctcccgagaccctggatggccatgggtgcctgctgtgccatgccggcgctcagatgataacagcgcgctgctccacagcactgactctctgcccggaacccctctgtactctccgtatttgttaactcatgtaagcaactgaatcagatagacaccgatcttccccattttacaaatgaggaagctgaggcacagaaaggctcggtaatttgctcaagtcacacagccggtgaatggcagcgctgagatttgaatcccggcagtgtctgtaggatgaggttctcctgagttactctgcctttgccgaacgtctctgtgctcagatgaccccccctcagcccctcttctgtgtgcgattctggggctgccccggcctcaggagggtgctggccgtgctgccaggggggtccttgggccgcgattcctgggggcgctggcttctctgcagacgaggctcagcctgcgtggggagggcgtctggctgggtgggggacctgtctcgggcctgctctgcgtctgccttgcagagtacctgtgcggtgagcaggtgcctggccctttctgtgccttgttttcccttttttcccctcccagtgggggctggacacctcctgctgtcagactggggttctgtgactctcttgcaaaccacaccccaggtactcactgaccttggtggcctttctcctggcccagctttcattccttgctgactcaggaattggcagcgttcagctgggagctgggcctgggcagggaaggagcaagaaatagactgggctggataagagtgaggagagagagaggcaggggctgcagcagtggggcaaggaggctggaggctaggggtccgtatggggtaggcccagagcctggcagccctcctgtgctccctgagctgactcttacttcctgggtgctcacttgagctcccattctgagcaagcgggaagcccgacggcctggcttgtcttggctgagcctcgctgaggcttgtgggaggctgtggactcacaggcccacgctccagctgccaccgcaattgctgctgctccttgccggggcaactccagaggcttctgcctgagcatctatgcgtgctgggcttccgcaggaaccctggcaggctgtgctctctctgaatgctctgcctgcctgcagtgctgccaggagcgttgctgcctctggtgaggctggcccacccaccggctcccgacagtcctctctgccctgtgcgccccctcccgcccacacacaggtctggccatttgcagaatgcacaggtgaatttggagcagctgcagacagtggagatgtagccagggctgctggctaccagcagtgtcgctgaaaactttggggccagaacaacccgcagctctgaactgggtagaggagtctgtgcctgcatgagacaggggcttccaggcacagccatctctcctgaactttgggatcttgctgcaagctttttgctgagtgaggaggggagcctcccaatggtcagaggggctcggacctagaagaggagtccctggagcaggtgtccagggaaagggacaggccagggtgctgagcagaagtggagtgtttggattttccctcaacctggctgcaccttcactcattcatatgagctgtaaacatgtattgacgcatgctgtgtgctgggcccaccaagaggtgcttaaatgagatgctgacctaacctcagggagaggggcccgcgtgtaattcctccaaagccaacagagacatcacagccaggcccagccactccagctggccttcctctagcctctagcagggtttccgaaatccctgccgagaatgatggttgctcagagaaagctcttggacaacacccaaggggacatttgggcttgccccaaggataaaatttaaaggtggccatggaggcaaccaggaaaggactggagcagtcaggaggcagctggctcttagtggggaagccagctcctggggagtctaggtaagatggggaaggggaggcaagaggcctctgctccatctgactccaccagcctcgggacgcccggggaatatggacctgcccagatgggagatacagtcgccttgaccctgccgagctcctgccctccccacccctcctcagaggctgggcctgaagtgctaatgagatcaaggatggcgccactcagcaggtgtaaacgggctgagttagggaggccctcattcccctccctccgtccccacctgtcttatgccacggccacacccacctaccgcaccctcagctgctctctgcctccatcgctgtagggccttgctttttatttatttatttttttgaaatagagtctcgctctgtcacccaggctggagtgcagtggcgtgatcttggcttactggaacctccgcctcccaggttcaatcgattctcctgtctcagcctcctaagtagctgggattacaggtgcccaccaccatgcccggctaatttttgtagttttagcagagatggggtttcaccatgttggccaggctggtctccaactcctgacttcaggtgatccgccagccttggcctcccaaagtgctgggattacatgcgtgagccaccaaacccggccaagccttgctatttaaagtggggtccagggaccggagcctgctagaaatgcaggtcccagctcccccgccccccacccaaatcagaacctgtgtttcaacaagattccaaggtgatctgtgtgcacagtgacatttaagaagccctggttctcaggggaaaaaggccagctttggtggatggagccaatttctaggtcagacttacacgcatgctgcctagagaccaagaggcttcctcccccaccctgaaagcagcagtatgctcagctgatttaagttacaatattttgactgggtaatacttaaatgattcaaagtttagaaggtgcaaaaggatagtcagtgaaaagcaacctccgtcctcccggttccccagaggcagccagtgttactaatgcaggaggctccctgattttgccgagaactcgtgtggtttcttacacattcactcaggtaatgaacttctcctgacgctggcgcttaagacccagtctcccctgtcaaaaatggacatgaagtacgtttcgatgttgggcttgggagctgactagctctcttctcctaccccgttgtatgtgagttgtctccccgtaaacccaaggtgagaaacctggagctcagccctcgccattgcccgagccacctggcagaaaagtcctccagcgccgccctcacacaaccagtcccagtgctgtctgggcggctccctggaagcatcctctttggaggggttctctctgcacacagaaaggcgggggtggtgagagcatccctccactgaggctttggagagggatgtcaggggcccagggacatggtctccagaacaggaaccctcctagagcaaagcaacttcctcgctttgggttttctgggaagggaacctgcaacaagcctatactgctctctgattagaaagtaaagatccaggctgggcgcagtggctcacacctgtaatcccagcactttgggaggccgaggcgggtggatcacgaggtcaggagttcgagaccagcctggccaatatggcaaaaccccatctctactaaaaatacaaaaattagccgggcatggtgtccacatgcctgtagtcccagctactcgggaggcggaggcaggagaatcgcttgaacctgggaggcagaggttgcagtgagctgagatcataccactgcactctggcctgggcgacagtgagactcagtctcaaaaaaaaaaaaagaaagtgaagatccaggtgatccacttaggtgtgtcacttcttcactgacgcaaagccttgcatttttataacttggtgacttttaggtttgggaggaagcaaaaaaggcaggggtcatggctgctgattttaaccagacttcgaaatggctggcagaagccacagaacctgaggatagtcatactatttgtttcatattgcaacaaaaatgtcttcctagccgggcacggtggctcacgcctgtaatcctagcactttgggaggccgaggcgggcagattgcctgagttcaggagtttgagaacagcctgggcaacatggtgaaaccctgtctctactaaaatacaaaaaaatagctgggcgtggcggcgtgcacttgtagtcccagctactcaggaggctgaggcaggagaattgcttgaacccgggagacggaggttgcagtgatccaagatcgtgccactgcactccagcctgggcgacggagcgagactccgtctccagaaaaaggaaaatgtcttcctacagttagtcattccttcagccaggaaatatttatggagtccctgtgacatgtcaggtgttggaccagatgctgctgagacagagatgagcaacacagacacgatccctgcccccgagggtttccagtctaatggggcattgaacccttatcaaatgatcacacccgtcatcacagacggaatggggtgtcggagaggtcagcgaggagtagccagagaaggtttccccaaggaagtgacctatgagttgaaatctgaaaggttatagcagcctaactaggtgagggggaagcattccaggtaagagaagcacaggtgtgaagagacgctttgatatgggaaggagcaacggagaacctgggtgaaggcggcagacaggagccaggtttggtgaggcttttgtttaatgaagttgacggtctttagctgcaaggttgcccctttagactttgcttccttagaggatttaacctcattgtttcttcaaggccggccaagccttccagtgacctcttgactgcccatcaggggccccgtgctcagaagagccagggatcgcctgacagcttccagacagtgtcacactcttccagtttccttgctttttgcacagcccccagctcccaccatttttctgcataatcttggtgcaagagtgggagctcattactctgatggaaactggcttttttttttgtattttttttttttaattttttgagacggagtctcgctttatcgcccaggctggatgggagtgccgtggcgcgatctcggctcactgcaagctccgcctcccgggttcacgccattcccctgcctgagcctcccgagtagctgggactacaggcgctcgcctcgcccggctaattttttgtatttttagtagagacggggtttcactgtgttaatcaggatggtctcgatctcctgacctcgtgatccgcccacctcggcctcccaaagtgctgcgattacaggcatgggcatgagccaccgcgcctggccggaaactggcttttaaatggggagaagtgaagcatgaactgtagctcttttcagacttgggaaggcccttctccctgggcactggttgcctcactgggaagatgagagtgccagcctctcaagagctcctttctgttctgatattccaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaacgtgtcctgatttttttctcttcatgtttacccatctttttttttgagatggagtctcgctctgtagcccaggctggagtgcagtggcacgacctcggctcattgcagcttctgcctcccaggctcaagtgattcttctgcctcagcctcctgagtagcggggattacaggcgtgcaccaccatgcacggctaattttttttgtatttttagtagagacggggtttcaccatgttggtcaggctggtcttgaactcctgaccttgtgatccgcccacctcagcctcccaaagtactgggattacaggcaacagccaccgcacctggcccatttttacccgtattttaaaggaaaatgtaagaaggcaagatcaaaagaggcagacacaagaaacaattagtaagcaatatattcctcatcttgcaaagaaattcaaattatggaaatgctttaaatgagcaactattaaaattatagactaggaaggaactgataaaactggtacttttcattcaagtagtgtaatctaacacaactctggaagtaacttggaaccaaatttttatcctctgctgtaggaacttattaattttctcaaaacaatataaacgcagacattcattgcagtattttttatagtagtgaacatttcaaacttactgcccaacaatagggaaatggttaagtacatcagctcgcttatccctcttccttttttctcctctcccaccaggctgaggactccctctgcttctcccttacaccaggaatgaacctttccttcccactcagaggaggttctgagaggactgaggtgggcaaaccactgaggatcttcagtgggggcagagaaagggctcactgagatggggggcaacgctatggcctcagcttctccttggcgtcgtgtgcatgtgttcctgaagccgaaacggaatttaacaggtctgggtcccagatccatttccatgactggccatgggctatctatgatctgtcaaaaggggacttggattcaagctctcagatccccttccaatctaaaacagattctttttttaaaaaaaatccaaatgtgattacgtcacttcagactaaaaacttccaaaggcttcccccatttgctctgaggatcaaggccagggcaaatgggagctcactgcagcctcaacctcctgggctcaagtgatcttgatcttcccattccagcctcctgagtagctggactacaggcgcatgtccccacacccattactgccctccatgatctggtctgggtctaccctgtggcctcttctctcactctctaaatacagtcacattccttcctgcccaatggcctggaaacatgcgctttcctgaaggtaactccttccccacacttgcctatgttattcaacttttgggtttcagatgtaatgttatttcctcagagaagacttccttgacctccatataccccaacttgggctaggtctgctatgtcctcttcatagtactcaccatgatttaagtatttctgaagttaggtgatgctggtttccccagttaaccataaatccaatgagcaccatcattttcattactgtaatttcttttttttttagacagggtctcgctgttgcctaggttggagtgtagtggcaaaatcgtggcttactgtggcctcaacctcccgggcccaggtgatcctgatcctcccacctcagcctcctgagtagctgggactacaggcacatgccaccacatctggctaattaaatgtttttttgtagagatgggcatctcactatgttgcccaggctggtcttgatctcctgggctcaagccttggcctcccaaagtgctgagatcacagcaggagccactacactcaggcaattaccgtcattctaatgcaatatttattcctcaattaaacaaatgcattttattcttttttttttgagagggagtttcgctcttgttgcccaggccggagtgcaatggcatgatct

SEQ ID NO: 12110 - DNA, 19152 bp, Human
aggccagaggacaggctctccgggccacactcaggggcgactgagccaactcttcacgccattcctttccttccctgcctaggacgaccttacagcccatgatcgcttttcttcttcttcttctttttgttttttcttcctgttttctttttaagtactacagtgaccccttatttattcagcaaagaaatggactactccacagtagtgaattttcaaaataatgcccttcaagcactaaaactttaaacaacacatcttcaaaacagctttgctgaggtataactgacacactataaacggcatggatttaaagtgtacaacttgatatgttttgatatatggacacacccatgaaaccatcaccacaatcaagataatgaacatgtccatcattcccaaaagtttcctcccgcccctccctgcccccttccccaagcaagcactgatctgttttccaaatacgtctttaatgctacaagggctcacacacctccccaccttagaaaatggagtatgatcaacatgattgatcctttccttgattcagcattatcaccaacacgatggaaagtgatctcagatgtcatgaggatgcatgattgtttgccctgatcactaaacggcccattgttgtgctggcatactgggcagtttcaagtttgggagttttctccctcactgctagctgtctcagagcttagttcccagcagacaactcttgctgcctcgaaccctggcacactaaccaccatcctgtgacgttcccactcctcattctgcgacagtggttctttgctgggagagatttttgtctcccaagggacatttggcaatacctggagatctttttggttgtcatcatgggagcgggaatgctactagcagctaatgtttagtgactagggatgcgactgaacatcctgcaatgtagagtgcagtgtcccctacagagaattatccgacccaagatgttgataatgccaaggttgagaaaccctgttcaggatgacaaactgattgaaaactcaacaaggggaccgggcgtggtggctcacgcctaataatcccagcacttagggaggccgaggtgggtgtatcacttaaggtcaggagtgcgagaccagcctggccaacatggcaaaaccccatctctactaaaaatacaaaaaaaaaaaaaaaaaatacgagtggcgtaagcctgtaatcccagctacttgggaggctgaagcatgagaatcgcctgaacccagaaggcagaggttgcagtgagctgtgatcaggccattgcattccagcctgggcaacagagcgagactcttgtctagaaaaaaaaaaaacaaacccataaaacaaacaaacaaaaaaaactatgaggattgagtgattcacatttctgaatcgagagagagaaggatgggcagcaggcttgttgaagctggaaggccagggaggtcgcagactgaggaagaccctggtgtgtcccaggtacctccatgcaaccctactagagaggtggtctctggcttcctatggacaagctctaagggacccagctatggggcaccagagcccagcgttcagcagctgctcaatgaatgtctgccaggcgagactgcacccaaagcatttattaggtacataattgtggcagcactggctggccatggaaggcaaggcagaacacaaggagctggagctggcggaaggaagtcattaagtcagccagtggctgggatgcagcaaagccaggcagaaggtaagtgcagacccaccccaataaatgaggaaaatgagaagggctggctggccatgttaggatccagttccagtgcgaccagatatgtcaccaccacatcacttttagctcctccccccacccacagacaccctgtttgcctgtcatataaagaaggttttcccaaagtggtttagccagaactggaagggccccgccctgtgaagggataggagcctgactgttgcagctgcagtgagtggcggggaagcagcagcggccaggatgaatcccaggtgctctggagctggatggtgaagtatggacatgctttattcgattttgcattgacttaaaggtttaattattttaggagttcttgtagacattcctgaaaaatgcaggtaggcaaaaagaagaaaacaaagatcgcaaatgtgaccctttcattcggagagaacaccaatggaattttgttgtgcacccttctatgcacgtctgaatgttgtgtagacattctgcttacaactaggtgtgggtgctgctgccgaaggctttatttgctgtgcctgaggtggaccagagatttcagagaagactcccagagcaccccaaggagacaacaggagtgcttggagtcaggatgactgggtggatttaggactatgtgattctcaggagcctctctggattagccccaaatcaaggataaagagaggcctagctggactcttcctcccagagccctgctgggaaaatggagcccctttacagcccccacttacccatcaggccctgctcctctcactcatctccagacttctgtcacatgcccaagtcctgctaactgctgtgtaaaactggtaaggtgggatccagaggaccttgggcccctagggccccaggtcaggagacctgggctccagggccagttgagagtgataaagagaacaatacctgcccacaggacttgttgcaatgagataaaggcagaagtcaccagttgtggtcaaatgggatttttttccagagaagtctcacagagagtggctttcaaattctttttagcagcagaattgttgtaaaatacaatctcatgtgaaaccctaaaatgtgagacactctgggtgaagcagagagaggtgctcaactgcccaatcctgtcctcattcctccctctcagggaggcacctctgagaacccactttaaagaattttgccttatgcagattgaagaggcaagctggctggaagaaactgggaagctccacttcccaccgcctctgcctgggtggcagtcatctgagcctaggctagcccctccccctccaaagacccactgcgggctcccctggggccagcctccaggatgggtggggcacctgaagcagcaagtattgctatttttctgggctgacctttcttctaggcctgaggacaagtgggtaggtggggccagccctgtccctgtttcccctcaatggagttctcttgctcacagcctaaggaagaagcgtgagtcacttcctgcctcagtctgactgctggagtattgttctcccaactgtggctggcgctacccagtgtggcccctacaagtcttagttccttggcggaggggaagtccccactttgggacaaggccaactggacttatcttcccgctcaactttgaggacccagcattgttcctccagtttccagttcttgcagtgtttgtaaaggtgcccgaatcgtacctgatcccattcactaaatattatctccattttatagaggggtaaattgaggaagtccctgagaaattaacttgtctaaggtgtcccagcaaaaaatagtgccccagggatttgaaccggtttgctgattgatttttcaccagttgccttaagaattatcatgatttaacctctctgggcctcagtttcctcctctataaaatgcagacagtgatacatcaaaggtacttaaaggaaaatgtactgtacccacctcatggggcatgtggtgaggataaaacgggttgacacaggaaaagagctctcaatggtgcctggctcatagaaaacactcagtggattttttttttcccattacccgggaacctgtgttaaggaggccacaggctgatcctgtgcagccaggttatctcacagggagcgagaagagatgggcacaggctactctgcgaccttggaataacccagcctgggaagctcctggccacattttccttcttttctttctcagctcaagcagcgtcggcctcagccaagtagcacaaacgttttctagggcccagggagggagaggctccggctggtatattgcaagtagcttggattcaggctctgccaaacaccccagtctcttgcaggatctgaggtctgctggttgtgggactttgcgcaaattatttaaacgttgtgcgcctcagtttccttatctgtaaaatgggattaataatctcagcctgaaaggattatgtggattaaatcatgtacataagaaggagataatgtaaagtgactggcctggtgcctggcaagcggttggtgtctaaaaagaaaaaaaagctaaaaatattaaaaggaggtgggctacttctgctcatatatccacctgtctatacaaatgcagacgaagtcgtgactcctctaacagtaggccaagaggaggctggtcctgccgccgtgcagtcctccctcgacctgggagtggaggaccccaggtccgccgtccctgggcacttaacccggtcaggctcaaattcgtcgcccaggagtggggaagcgggggacggagagggccagtcccccaagagtccggctgaggcagggctcggagtgcctcccccaagcctttccctttggttccgagttcgggtctccgcggccgtcttcccggggagctcgcggggcgaagagccgagcccgggggcgggggcacggcagcggggcctgagggacgcgccgggcggccgcgaggactttgggatcgcctgccccacttcctacctgcccctaccaggagccggaggcacgcgggcgccccagaaggccccgcagggcagccgcgcggggccggacgcgctggggcccacggcgctgggaacgcgggcccgcagtcgggcccgggcggcatgggcggcgggcggacgagccggagccggcggtggtggcggcggcggcggccggggaagcgcggaggtggcgccgcgagggggaggggcgcggcggcggaggaggaggtgcccgggccgctgccgccgccgccgccgccgccgctgacagcggcccgagtaaacaagccgcgccgccgcggcccggccgctgcccccgcccgcgccggagctggagcccaggccgagccctgccctggtcgccggccgggccgaggccgcgccgccgcgcctccccgcctccgcgccgtgacgctgccgccgggcgcggggaccgccgccgagcccaggcccccgccgccgggctctccgctcggccgaggggcgcccgagccgccgcggcggtcgcctggaaaagtttccccgccagggctccccagggtaagtagcgagggcgcggggcccggggcccggggaaggcaagcgcgtctgggagccgggcccgaggggagccggccgggccgggccgtggagctctgccccaggagcgggctccgcggcccgggtgctcgggccggggagggtcggggcactggcgccggtgcagccctgacccgggtcccccggggcccggctgcccgccggctttccggaactggccccggggccggccccgagggtggagctgccgggagcagacagggcgctccgcagcccacctgagcgcgccgggcccgtctcggccccccggccgtggctggtacttttccgcgtggggccagggcgagccctctgacctcaggaagcgcctgcggggcccctgctgggggcgggatggggagaaaattccgcaggcgccgggtgctccagcctccccgccgccaccggggctgccgccggctcgcccactccgcggccgaggagggcctgcgttccgcccggggaggggaggagcggccgggggcgaggcgggggctccttcgcttgggcctcgcccccgcccgcacacctgtgcggccaggactcgggtgcgggatccgcgggcgccggcggccggcgcaggtaggtccctgggctgccttctgccgcggcctggccgaggcccctgtgcccccgctgtgtggctggaccaaggggcggcctgcttgccagacaggtctgacggcagtcacttgtctggtcagaacccgctttcccatcatcctctaccccctggcccctggggtgcagaccctcatccaccggagagtgttgggattcctattctgacttgggaagtgcgaggagaacccgggtgatatggcctggtgagggcgggtgctgagcaggtgtggacacagcataggagattagccaagcctgacctcttctcaagcagggcagccctcgttttactatttcctatattgggcttctacggagcatttgatttttaaaaaggattctgtggctttttaaaaagtttgaaagccgctggtccagcagtttttaccaccaaggaaactgaggcccagggagaggaagtgacttgttaagatcatccagcaaatagtgggcagggactgggagcgataaattcacgggagcctcccagggctggtaacaggaccccgcgtggtgtctctgctagagggagagactgattgggtgtccgagtggccctcccgtggcctgctctgtggctgtgtcagagccagacccccagtgtctgggaaacagcagtcggtcctggggtgaggcgcaatttgagtggcccagagtggctctctgtgtcaggaggttctggtgctggagaaaagggctttgcccaagaacacagccaggaagagcacccacagctctctctggccacagcctggaacagagtcccatgtgaaacaagaccatgagaaatacagcaagcctccaggtttgagacaaactgggactagagggtgagtcagagtctgggatgggggtggggagaaacccattcattcattgttttcagttcttactcttttcggggatcctcccttgtcccacatgctgtggcagagccgtctgtgggggtctcattttctggaagccatccccacccctcaccatggctggggttgttggatagagggaggctggccctctttctttggggggactgttcagttgcgcctgacgcctgctttctttccgagtgctgcaaggtaattaaatagttggttaatcacttttaacgccaaacagctgcggctccatctacagtgtgctggaatctgggctagacccagatgaacccagcctcgatttgggggctccagcaggactcacagcacggtggttggtggtggtgggggcaggggggtggttgcatgacatctggacccaagaggcagctgttgtggcagcaagagagaggagagagatgaggccccgttcctatatggctctgctcccagggtcccacatcctctgttaaatgagggacttggggtggggggggcggtccttccatcccctagggctggggcgcctagctgcccagccattgatcaggccagctttctggaaccaaccacccaaagcaccatggggctgtggttccgaggcctgccctggaagtcctgtggagtctgcccgcagggatgtgcaggagctgtattgtagatgtctcctgccatcagctgtcaggttattttggtccaaactgaaaatactccaggaattgtgtgtggagtacccccagcctgcagggtgggactgcagcagtcagggaggccggttgtgtctaagggcagcttctggagaagcaaggagttttctgtggtgagcctgcctctctagctccccagggcctacgtgagctggggtgccttccttttggtatccggcagagtggccttggctatggaagtgctaagggcatccagggccctgctgctgctcagggagcttggcactgatatgggatacccccagcagcactgctgggacctcccctagcttcccccccttcctccagggccttggcttctggctagtcaggggcactatgtggggacagttatgtggccccgggcagagagaggtcccgccgtctgtttgctgaaggaggaaaaacaacactcggactattgattcagtctcaccttggcgctcctggctcagcagccagtgtttgccctggctgcctgggctcggattacgcaaggctggtgggcgtggagcaagcaagggggcagctgggggcctccaggcccaggcagggcagggcttggcggccccagcgttccccaggaaactgtaaaaacgagtctggggccctgactttgctgatagcggccatctcagccatagagggaggtgaagcctctgtgatctccacccccgcaccccctcaggacatggcccctaaaagcaccatcccatttagggtcacccattttcttcctaggagctgtggggctttgcgaataactccctatggctgaatctgctttgctgaactaggaaaccctagtgagttgtatagatgccattcatttaagaaccttgaaaagccaacatcttattcccatgtaaaacatacctaggtgatttggagaatacagtgacacaaagaagaaaataacaattacttgtaattctcaccatcttgagagaaccaccgttaacattttttagcgtgtgtatccttccagatttcgctttagtttgtataaatatacatgtataaatagtttttaaaaaataaaatgggattatgtgtacatactgctttataatgcatcttctttaccttgatcatggtgaacatttattcatttgttgtttctgattttgagtgactcagggcttgatagtcttcatcctgcttcttctgttacacttttttttttttttttttttttgagagggagtatcgttctgtcgcacagactgggaatgcagtggcgcgatcttggctcactgcaacctccacctcctgggctcaagcaattcttgtgcctcagcctcccaagtcgctggcactacaagcacccgccaccacacttggctcatgtttgtatttttagtagagacgaggttgcaccatgttggccaggctggcctcgaactcctgacctcaggtgatccacccgcctcagcctcccaaagtgctggatgacagaagtgagccaccatgcctggcccttctgttacatttcttatattcttgcatggagaaaggattgggggggattgtgagggcatccatctgtccatctatgtggctggccttgggggctagatttcttctggggaggactaatttttttacccttctcccccagatctcatttcaggccccaattgaaacttggggtgggcagggcagctttagtgcgtagcaggggaggaactgaccctctctccccttttcccctcttgttcctctcagggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccaggtaggtgttcccccacaggacactgccagggggtgggaccagagaagacagggattctgggagcaggagctgttggccttgtttgctcaggggcatctgggtagccggcatgttctgggtggccatgagcaaagcacaggtggttcaggcaagcagcatatcccagtgagagtgagtcctcatggtccccgcattttgctgggtcccggacagggagcagatgccccgcacccccgaccgtggcgagcctcccatgaagccgttgtccacccccgtcccccgcctcccggggactgacagatggaaagcccagctcagtctccctgctctattgcagatcttcggggactattaccacttctggcatcgaggagtgacgaagcggtccctgtcgcctcaccgcccgcggcacagccggctgcagagggagcctcaagtgagtgtggccccagccccctcctgctgccaccctccccctcctgctctcaggagcccctctcgcctcctgctccacccacaccatctctccctcactcccccacaggtacagtggctggaacagcaggtggcaaagcgacggactaaacgggacgtgtaccaggagcccacagaccccaagtttcctcagcagtggtacctggtacgtggccttcttcgctgctgggacctcctccccagatgcaccatccacccactatgagctcttggatggaggaggctgtcttcgaggcctcctctgattcgtttcctttcctcctgctgggcagtctctccttggcccatcctaataagcaagcctgggggtggccctcccagagtcctctacattcccatggagtccagacagccagtggcggcctttcaggagcagggatggtacaggaggaggttttacgggggcaaagggattcttcaagatgctcctagcctcacaaaaccaatcatgtctcataagtgatggggtgggtgtctccacagtctggtgtcactcagcgggacctgaatgtgaaggcggcctgggcgcagggctacacagggcacggcattgtggtctccattctggacgatggcatcgagaagaaccacccggacttggcaggcaattatgtgaggaagtcggggagggaggccgtgatccctgctgaggtgtgtctagaggctgtcttgttctatcagtgaggtcagccttctcctgatggtggccaaatccttcttaggatcctggggccagttttgatgtcaatgaccaggaccctgacccccagcctcggtacacacagatgaatgacaacaggtaagaagtggcaggccccggtctctgcctcccttctcctttcttccactaaggaacagggctgagcctgggtgagatgtgccttgcctaaaaggctgaggcttttcccatagtcctggcccacctggggctctgagggagggctcggtcagagtggagatggccacaggcccagtggagtgtgggagatgggggctgggtactcaggggatgatgggtgtcggatgtgcggatccctcgtgctcctcaggccacatctgccgggccctgttcaccccatttgttctactcatgctacgtgcttggccctggcaggcacggcacacggtgtgcgggggaagtggctgcggtggccaacaacggtgtctgtggtgtaggtgtggcctacaacgcccgcattggaggtgagtgtgggcctgggccaccctgtcttcaggagggcccttcagtggaatttttcccgcccacttcccatctggccaatgcctgccactttcccactgtggatcctttgatcacgtggctgttccatggagggttcccaaagggtcaaagactgaaagagctggacccctgtggagtgagggtttcctagcaggagtctcctgaaatcctcacgacccactgtgagtcctcacgtggcagatccttgatcaccaggctcttttgggaaccagagactctttctagtcctgaatgtgtggttgggggcaggaggtgttctctttttccttctctgggtcttgtctttgaaaggcagaggcaaacaggtagttgggggttcagggtttctcagcatcagcctccacccttcccttactcatcccctggggtgcagggctgggtgtgctccttggggtgggggccctgacagctggacccatgcagcatccctcttcgtgcccccccttcacggccaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccaggtgaggtggggatctgtccagcccctgcgggcaggttgggtgctgtcttccgtacctatcttgtgttttttggtttgttttatttattctcatgtttaactttacacaaagcatgtttattgaaacattaagggacagaagaagagtagagtgcatataccacttggacttgcctaattaaaaaacacattttttttagaaatgaggtcttgctgtgttacccaggctggtctcaaactcctggcctcaagcgatcctcccgccttggcctcttggtctgattttttgtgtgcctagatagacatatttggatacatacttgatccaccagggatctcacaggggacaggaggttcccagagaatgaggctccagccttcccagttttccagcagtgtcctcctgccagccctccctcaagtcccaatcttgaatgaccccagcccactctgtccacagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgagtcttacctgggggtgggggctggggagatggggctgctggctggctctgtccagcaccctcttttggaggctgtctgcctccacccccatgtggctgggtgatagtggctcaggcatcatgcaacatgaactctggggctctgtaggttcttggaggccatggagccatctctgaagactttgaaaagcctagactctctctaaaaacatactttgttcttattcatctccaccctctagttgaacccccttattcctttggaaaatgaggcccaggaggggctcgtcattagcatgtccacggcaagttagcaaggcagcagctgggacctggggttcttggccctggctccccataccatctgtggtgcccagggcctgtatgcagagggagggtaggcaggtggctcctctagccccctccacccatcacaggccccaatatgattctcttcctggcaggtgacgactgacttgcggcagaagtgcacggagtctcacacgggcacctcagcctctgcccccttagcagccggcatcattgctctcaccctggaggccaagtaagtgggtgggggccagcggcaaccctgtccctaccagcactctctgtagggcagcccttagggcagctggagagctgctcccaaaaaagactgatccccagcctctcccttccttctttgcagtaagaacctcacatggcgggacatgcaacacctggtggtacagacctcgaagccagcccacctcaatgccaacgactgggccaccaatggtgtgggccggaaaggtgagggcaggctggcccggcaggctggatgtggagttaggtagaaggcactctgtgcctgacagctgaccctaccttccctgtccccacagtgagccactcatatggctacgggcttttggacgcaggcgccatggtggccctggcccagaattggaccacagtggccccccagcggaagtgcatcatcgacatcctcaccgagcccaagtgagggctggacccaggctgggagggggccagtgggacctgagagtcgcagggggtgcccgctggtccctctgggccaggctgaccatcatggtgctctcctgcacagagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggtgcttgctctgtccctgcccgccctgcccagcgccgccgcctctcacagcccgcgtgcttgcctttgctcgctcacacggcccagggggcactgagtgctactcagtggggcactcttggcattttgggagggacaattttgtcctgtgggactgtcccatgttgcaggaatccctggcttgcaaccatttaatgtcagtagtgtgccccaccttgtgcggtgcctgtgtacctttctagaatcccccagttgagcacgtctggctcactgagaaacagccaagccagcaggcacttctggccccatggggttggtctgcgtgggggaagggtgtgtggcccatgtgctgtgggttagatgtccctggcttggggtcccgcagaggcctcagggctgtgtgcactcccctccccaggccacatgactactccgcagatgggtttaatgactgggccttcatgacaactcattcctgggatgaggatccctctggcgagtgggtcctagagattgaaaacaccagcgaagccaacaactatggtactgggggcacttgaggggtaggggtacgaggtggagggctggcaggatctcgagcactgggtgtggtgccagcactgtcttaactcttgcctcctccccgctctggaacagggacgctgaccaagttcaccctcgtactctatggcaccgcccctgaggggctgcccgtacctccagaaagcagtggctgcaagaccctcacgtccagtcaggcctgtgtgggtcagtagtgggtgctgttgggctttgggggcctgagtctgggggtaaggcgggtgcctgtcctgaagcccagctctaacagaaaaaagtctcaagagacctagggcccctggggctcttgggatgaccacagtcctggggctggaggatcctggggatgtggtgacttggcttggggctgctgtggtcctggggctacagtctgtttagctgacacacacttgccctctctcccacgccggcagtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgcttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccaggcccagtctccagtgtggtaccgttgctcctgcatcgcagctgaggatagggggccagttaggcctacacagtggcctgcctgcctggatgtgggcccaagtcagaaggccaaagtcctccaaggggcgggaggatgcgccagcccctagtggaggagctggtgcccctggggtggggctggtgacccctggtcctcaggagctgagcactaaactcccaaagtcctggtttccagcagtgtgaagaactgggcctattgtgtcttcctgggctgaagtgatctggtcgccacaggctatagggctgaggcctaaggtggagggaggcctgactgaatcaagatgacttcttgtggggagcctgagtcccaaatggaaaactccacgcctgtccgctccccaacccctgccccttgatttccccaggtctcccttgggacaggaagcccctgcctgggggtaggaggatggggacaaaaccactaggatctgtatccgagaagcagtctctgttcgggatatttacttggaaattttattcaaatggaagctggcgcctgagcctctccttagggaattccgtgaggtggggagggctgggaccagggttccctctttctcttctgcggtggccctggcctggtgctaggactgcgcgcctcccctcagtacccgcggacaccctgggcttccctgggcccagcatctgcctggggcctcgccctgggctccccctcctgacccccaccttgcgccccttcccggtgttcccggggcgctgccgggccctggggcctgcggggcgcgggcggctcttggctgggccattctttcccggccccctcctcccttccgtttccgtggccgtgcggccggctagaggctgcggcccagcgcggagcaggggggctggcaggcgtcgggacggtcgggccggtcccgcccgccccttcccctccacaggcccgccccggggcctgggccaactgaaaccgcgggaggaggaagcgcggaatcaggaactggccggggtccgcaccgggcctgagtcggtccgaggccgtcccaggagcagctgcccgtgcgggtacctctagccccggggcctggaggagcggtgggagctgggggcgcggcaggcaggggcagagcaggcgttccgagggccagagacccacccaggtcggggtaggggccgcggaagggcggggatggccgcaggggcagggctcaggctgtgggcgcctgaggcttcagctggggcaggcttggcctgtcgaggacctgggcaagggtgtccctgtaaggggtggtgggtggaagggcctggggagggaggctccaggttggctcctgttcccgaacgtgcggaggagaccctgacgctaaggaagcaatgagggccagtccccaggccaggctgctgctgggtacccatggctgcgtgtgagcgaggcaggaccccacctcctccccgtctgcagtccatcctgaccctacagtccccagcctcctcgtcccatgcctccgtctccagctgctgccttgcctccagggatggccccttttctgtccccagaacagcactatgggcttctcttctgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcaggtgggtctctatgggactctggtgggtgctggcgtatctgccttctccttcctctcctgggggccctctggggcagtggctggagatctggcaggccaatgcttgggagccattgtgcccccctccctgcctcccccatctgtgctgtatagtcctgggctgagatcaccagccaaactgagggcctgagccgcttgct

SEQ ID NO: 12111 - DNA, 187848 bp, Human
  misc_feature (1)...(187848): n = A,T,C or G
agcaagcacttgatctgccgtgtgaagaaacatcctcattcttcaactgaagtcttttgagttgttgaattgccaccacgcggatagttacaatgaaagcaagctgtttgcatgcaggaagcccatctcataagcatgctctgagaagagacggggaccgtggatttcttggtcttctttccatgaggccttccaagaattaataaagcagattcttaatggttagaactaaggcagagtcgaaataggagacttaatctgtgttttgactacatcctctgttgttggtgactatattttaaaacttttaaaggtactcaggtcgactgctcatcccttccttccaaaaatattaatggtgcacctgctgagtgcaggaccctgtgcctgagtaatgcagagctgcccagcaggtctctgtgttgctgagttctcggtgaagatggggatgggagacctgtgcatgagcaaggcaggctgaggcagcagagacagactctgtggggggcttgagggccaccataccctggacctgcctcctctctgcagcacctgagctgcttgattgacccattttaggtgtgttaaaagtcctatattcagtttgggtctgagggcaaagcattcccaggcattagttgtctcctcgaagtcagcagaaggaaggatagagacttcctaggcaaaggctaacgtagcagttaaattttttcaaataaaaatctccttctcacagagcttcttaataagctcctggcaaggcttctatcaatgcatcctgccagtaaagaagaaaggaagaaaggtaaacagcctgggcatcccaggccttcctggaactttcctaggattggctgattgtttctcatagttctaattaaattgttagccccagggaaagcacacagacatctgaaccgattatgaattcagaatcgcaactgaaatacctctgtttaaatttgtctagctttaatgcaaaccaaatcaattagctgtcagtctgactaatatttactccacccagtcattacaattaaacacttggtgaaattagctgttttatggaagtatttagtgttatcttttattgcagtgcatcagaacgtttccctacgttggcaaagcatttttatgataccttcacatctggagagttgtgtaattaatattattaacaaaaggaaaagatgatttaatattattcagagacttcggaatgcgaggctgccattgtgttcaaatgaccaaactggaaatgaatgttatggggcttaggataaagttccatcaaatgcagacggtatcttattttaattagttccagtccctattgtataggagtgctttgataagtgatggaatgtacagtccaccccatgtcacataaaagcagatagaatgtacatttgggaaagcaaaacaaaactcaagggggtgtcagcagcaggactctgttaagcacgcgtgtgcacgcacacttattaggcatcttcttcgcactgatcctgtaccggaatggtacagtcattttccttgcattcttaattacctttacttgatgtttttcttaccgtctttgaaaagggccattttgctcagattgctttgttactcagccctgtccttggaggaacagcccaagtgttcgcagtgtgcagttatcggtcgctgggtttttccaaggcttgtcatttaagcaaactgaaagcatttgtttttaacttgttcttttgccaaaagtctggagaagggtggatattacagaagcgtcgaccaatcactgaaagggctcacaaatttttttaaaattacttgttctgattatgttccaagctggcttatagttagtcgttgctgcctgtgtcttccagaccttacattttagcatgatgacttgggttcagctcttttccttccctacagatctcagccagattggtgatggaaatggaaggataaagatgttcagagggagccttggtggctccttctagggccgtaggaggcttgggttcaatgcttcatttcagtgctttaaagcttagaagttgcaaaatgattgcaaggaccagaggaggcattctgttttgtaggatgggactttgcccccggagtttaatcaaagctcgggtttccttccagcagtgatgcaatgttgaagcagatctttccattaaccacagatggaattttatctaacagttttgtgtgctagagcaattcaaagtgcaaacaaacagaaagttcctgacaagagcacatagacagtaagtgaccacattggtctcaggggttgatgaactgtgtcatgggctgagggcagggccaggcagctgcccagggcccagaggatttgcccacgtggggacggtggactgctcccccatgagggtgatcgaatgacagtgacaagttggctgttcacattttcagcaccacccagctggttctagtggcatggctgctaggaattggtaaaaagtttgaatgtgtaaatttaccttaaaagacagcattttattctttcacgacatgctctgcccttccgcttagatatctcaaagacaatccaaagtcagtatgtcccaaacccagctcactgtctctgaccctagtctgtctcagagggaagcgctcatccgcattccactgcagtgccagcggcctctccttcccccctacacttgttccacctcccgtacaacctggccctgccatgtcctgtgtctcctgccctaggcccagctcctgtcatctcttgcctgcaccactgcactgccctccttgctggcctcatgtgggcatccttgccccggccagtcacctcccatgctcctgagggatcctctgaaatacggccaccactggcctttaagatcctcctcgggtgactttcgctctttttccctctgcagagcttttgcacagacggctccccaccttcccctgctgttgctctcttccccaccttcccctctgggctccaatatccctgccaccaggaagcctgctcagaggctgcggacttggcctgctcttctagcagtcgtatgtttgtattctagatctggccctagagtaggagcacacagcagtgtttgttgggaacgatgactagttcagtttgtttgggatctgtcagggacagacagagtcggcaggggagctgcaggtggttcctgggggacctggattgtcaggcttgggagggcgttcagtgttccagaaccagaggagaggcgatgggaaggcggactgacgctgctgtgcggatgcctcgggagagaggaacttggagttcaaagcatgcaagcccatctcttgccaatgcaacaggaggttatcgagggtcaaggccacatatcatttgcttttactcccttacaagtccagcagcaacccagagaacagtagacaatgcttcctgaagcatatctcaagttccagagatgtgactcctataagcaagttgtgtgtaacataagcaacttctttctatgtaaatactttagaagtaaattctgacccaccttggctaaattatggaaaaatcctaaatatagttttcagttgacaaagctgtatcctgtattgctgaagctaaaataacagaggtactgacagtgactgcatgtcagacacgttgagcagtgttggacctcatagtttgttagtctgcgggggcagttgtaacaaagtcccacaggatgcggggacttcaaccgcagaaccgtattgtctcacacttaggaaggttggaagactgagattacggcgttggcagggttggtttcttctgaggtctcttgatcctcacgtggttgtccctctctgcgagtggctctgtcctaatctcctcttctcatgggacactggccagattggattagggtcccccgcatcatgacctcatattaacgtaactacctctttaaggcccttatctcccattacagtcacgttctgagctaccccgggttaagatttcaacataagaatttaggggttcacaggtcagcccctaacaataggtgaagctgggctccagctgcctcttctgttgtcagtgagtggaggtgggtggcgggcggtggggagaggggcaccttctgtcccctttcagcaaaataagaactaacttacaaatgagtagctttactttcccaaagagctttcacacgcactgtcccatttccgtcatcggcagagcgaggacttccctctctcatgactgttaagcaggggtcttctggcacctgtagtttaacttcaatggaaagaattcaagaaatggtctctacgctgttgcagttatggctgcaggggaggcagtggggagggagctgggctcgcagctgcctggatgacacgggaggtggtggtgggggtggctttctaggctgagttagaatgtcctttattttctggttcctcctccccctcctctactgcccgggcttactcactgggttcccgctgtgtgtttgccatggcagcctggggtttcccggccccacccctaggtgagccagtgctgcgccggaggtgggcctgggcatctcgccatgatgggctctcacgaaaccatgtaatcgtctctcacttgtcgcgatggccctcttgccctgctggaagatgacagccacaggaccaatccctcactcggagaacttggatctgctttctgcctctgtctagcttggttcagtggttcttagccatttgggggaatcacaggcccctttgaaaagctgttggaagttgtggggcctctcgctctccagaggaaaaaagacatcatgctcatgccggcaccattttgcatacagttctggggtttctgggactcgagcctgtccttccactccttgagggactgtgggatccagggcaagatggctccagtgtgctgcatgaatcgtcgcctgtcagtgagagaagggccacgttgcacattatgcagtgacgggcacttgtcggggagtgggatttttctttctttaaattcaccagtcagctttctcactgagctctttagctggttggatgttggcccagcgaggtgctcagagcagtcaaggttgatgggaatcaagatctaagcgccacagactgttgagtgcacaagctctgagagagggaccggtcccagcccctgctttacagtgtggagggagaggcccaggcagggtgcccacctcccacacagagagaataacaggcttattttctacggtgccctgattgttctctcctggaggaggctttggagcttggtggctcctgggtgccgaggtatggcctccgactccctcccttgatatgccctggtggacagtcaggtctggcttgcagtccccttgttctttcacagttacagaataaagtaaccttcgctttgatgaaaccagggagaaaagagaaaagaaagagctggccgagctgtctcccttgcgttggctacaactgtgcagaacctgtgtgaacctggtgtccgcagccctgccggtgcgtacttcaaagaacctcagcagcttgactcccttgatgctgtgtgggacccctggaccgctgggggagggtgcctgtgtatgcccttcgtggccttccctccatctcagagcaaagactgaagcccctctccttttaggactctccagctcccaagaacttctaggggccttcctgagccacagcagggcccctctgaataggcacaggcttgaagttagggcagaggacatggtggctttgggtggacgtgcaagtgggagggatttcatgctctctttggtgacactggctcatgagtgaaagtttcgaaacaccctcccctgtcgcttgtcacacctgggaatgatatgtcagcaagcttctggcccacctgtggcccacagggaagaagacagggccaaggctgcccatggctgctcgctgaaaggacgcttggacaaggatcacaactcggtggcatggacagcctgcagcatggcaagccatttactggaacgcgggcagggcacccttctgggtctctgcttgtttatgttaccctttaggaacatccttagattttacctcgtcttatcaacagagggacagtcaacggatgcctcattttaacttggcttctcgagaaggaagctggaggaagcacacactacaaaagaaagtgttgctgcgcacctgtcttgagaagacgatgaagccttcttcatgattagaactccctgccccagagcgtagcttatctataactgtgctgcatgtttagcaggaaacatacatttggaaaatagagaaaaggataaaaaggtcagagtgaagttctatcttcaaagtatgacgttaaagaaatcctggcactttctacagatttgcagagaaagacggtttctgtttgggctagaagtggcatttggcaaaccttgcctttgccccaaatcacttatagttgattttccacaaaaaaagtcaacagatgtcatctagcagtcatttagacctaatcacattttctttctttctttctttctttttttttttgagacagagtctcactctgtcgcccaggctggagtgcaatggtgcaatctctgctcactgcaacctgtgagggttgcttccattcgatgggagggctggagttttagtcgcttggtttggggctggtgacacacctctgacctccacagagtgtccaggtggctcctggtttcaccccgagggggcattgaaggcagagctttgcatcccagctggggatgggagggggaggcactttggtcctggccgggaaccaggtatgttcatgctgatcttcccagaacctagcgccagacacacaggaagactcagtgcatttttgttgagtgagccacagaataagtgaccccaggatgcctgctctccggagacactggggaaggtgaacctggaaaatggctttctctttgtggtgggtaggaggtgggatccgggatccccttgtgctgtcctggagctgggtgagaagcaagggagtgactggaacccagaggaagggacacagtgggtgccgggagaatcagcctctgccaccgcgctgtctgcctgcatcccgtctccacggagaagcccccacgcctggtcagtcatctgttgtacagtgttcggttccattggcctgacagcacctcacttgccgtcagagacttacaatgagcaggtgtgttagcagagagagggctgcccctgcgaccacgacagagagagagccccaaactgtgctgcgggccgcaggctatcacagtccccctcagaactgtgtgccagtgttgtggggttttgcccagagcccagcaaggaccaagggccgggatgcccaggctcttccatcctgctgaggaaccctcttatgacttctggctctacgctttcccacatctcccagctgattagtggggtgtcacccacttgggcttggaagggcagagtgtgcctcctcctctgactggaagtgtggtctggtgggcacagcaattggaaggggctggatgttgttagaacagagagttcagggccccttagcacaaacagggctcagcctggcaggagggcgggacatccctgggagctttgggctgtgcgggatctacataccactgtattttgtaatagcgtgctgaacagattatgaaatattgtttgcggcatcttagaccaggtaaaaagccttctagttcaggcagtaatatatggggacattgcaaaatgccatcagccggtgttaggaacaaaatatctcattttatagttttattttctgtggaagtatctgtcagcggccattataaattatctaggacttggtgctgaggattttttaagtgtgtgacgtgaaactggttttgagccctttgcagtgtttctaaggcgtctggtctgctggtgttttatagacgaattacatcggggtgggacgggctgggatgcctctcttccggcattttgccctgtacaccaaggatgtcttggaggccatccccagccctaaatttgagctgtgtatgcaggtgctccgctctccttgctcagggtgatgtggggaggccacggctcagggaggaggaagagaaatcttgtccctttgctcttggggactgttactccctgcccactcagcctcaggtagctctgttctagcttccagcacgaccctgggtcgccagccttgggtcaccttggggccccgcccccttctcttgttcctcccctgcctctagctgcctcctccaggcagcctgccctgtttggaactcacatcatcctctgattggtgggatcccctgaatgtagtgcagactcctcgagagcacggccctggcgcccatccttatcccacccatgtcaggccccagagccaggctgaaccccagctttgagcattattcaatcaggtggagctgccgtggtaagaccaaagaaaacattcccactcagggtccaagaagtctttaccccaagatccttttaaaatgaaaaagtttttccagcttgaaaagaatgtgtacacgggatgataagagcaggaatgctccaggcactggtctgagggctttatatgtgttgtttcttatattaaccctgtggcaacccatgactgtccccactgtgtgggtggacaccaccctgaggccatggatgtccactgtcagctccaagtcacacagctggtgagcacggggctgggttttattgcaggtggcctggtgccttgatccttggtcttaaatatcagtgatacagccttgtgaacttttttccttgatcgtgaaaacaaatcatgctgattgaaagacatttatgacatcctgaaagtaattgtaaaattttaaattagcaataatgtcaccacccaggaactgatgctactactattttgctgtattcctttctagatttttctctgtgcatgttttggtaccatattgctggtggctgccaaatattccaatatatggcttaccatatttacttatgtccttactgtaaagcaaattccaataccagttaaccaaacactttcttcattcactgctttcccatgtgtgtatttcctttttcttcaggacaaggatcaccagataatttattggcaatttcacaaggctggcttccttccttctctccctctctccctcccttccttcttgtctttctgtctctctctctctctgtctttttttttttttgacagggtcttgctgtgttgcccagactggagtgcagtggcaccaatcatggctcactgcagccttgacttcccaggctcaagcaatcctttcacctcagtctcctgaggagctgggactacaggcatgcgccatcatgcccagctagatttttttttttttttttttggagaggtggggtttcaccatgttgcccaggctggtctcaaactcctgggctcaggcgatcttcctgcctcggcctcccaacgtgctgggatgacaggcgtgagcactttctttcttttagtacaacgacttcaaaatctatcagagtggtgttatttcttcctctgtatacacaaacaacttctcatctttcaaatgtagtcactttgaagtgaaaatgtccccaggaacttaccatctaaaatatctgctatgacacagatattcacgcacaaggaaggctgtagcacctgcaaagaggctacataaaatcaagaaatcatttctaatataaacagtaattgcatttcttctggtaggtgaaatggctccagcaacaggaagtgaaacgaagggtgaagagacaggtgcgaagtgacccgcaggccctttacttcaacgaccccatttggtccaacatgtggtacctggtgagtaggacaggacctctgtctgccccaggacacttgcactgccaggtctctgaaatgggttaatttccctcaacaaagctaaattcaaacaacatctccagacagacacacttcaccttgagggtgtaaaaccactaccgcaaggctgtgcagtaccggctttcctgtggattttttctgaaactttgtgcagcacactctgggatgggggctctttgagaagggaagtgatttgatgcaggctgtatgactaaatggcaaagcccagcccatggacagagctcctgctgggaggcgatgccctgggaaaatatagattgcaggtgcagaaaaagcaagggagccgtctgcatgattctcgatccgagtgggaaagaggagctctgctatgtaaggcagggataggtgttccctccttttttacttgcaagcctaagcgcctccctgtggggtgtgcaccgagtgtcagttctgcatctggaatgtccatgtcggggggactttgtgtctttcgtgcttacagcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgtaagtcaatcctcggaactgacatgcaaatatattcaactgtgctggtcattaagtaaatgcaagtttaaaaacagtaaggtcccgatctcccccagcccccattaagttaggcagtaaagaaaactatgctggagagaattaggaagatgaatattctgctacttgctactgtcaggggcaagggttttgcagagggattcatccacatgcttgcacagtcacatacacttttaggaatggagcctaaagaactaagaaatgcatggagggggatcatcagcgtacagatagtagcaacacgaacagtgacagggtgacagtgtgaaaacacgggctctaggcccagagtgcctgggttcctatcctgggtctgcaaatgattagctctgagatcttgagtaagttacttaacttctctgtgcctcatctgtaaacattttaccgtctgtaaaatggttcataagagaacgactctctcacggagttattgtaaggactaaattagttaaatgtaaggacacaagcttggcatatcgtaaatatcatagatgcaagaaatactctaagggacttgggcacctaccggtgattaagtaaaccatattgtatccatctgacagatcgttatgcagcccttagaaatgaattttgcagactacgtgtcaacaacactggaaaccttttatcatatattttaaaaggagaatgtaaaattatgtgaatactgctgttacagtcatataaacaaaagcatacctattgaaaatataaaatgaaggaaatcctgacccacgtggaaacgtggataaaccttggacgttatgcgaagtgaaataagccagtcacaaaaggacaaatactgcctgattccacttacacgagtgactcggagtagccaaactcttagacaaaaaggtggagtgggggttgccagggcctgggagaggggagtggggagttagtgttgagtgggtgtggggttttgcaggttgaaagggttctggagatgggtagcagcgatggcctcacagcactgtgaattaatgccactgagccgcacactcgagaatggttaaggtcgtgtatttcccgtcacatatattttaccacgataaaaacgtatatgagattatagctatagtaagagaggagccccgcgtgtggtttctctatttgccaacggaacataaaatccatttcaaacagagctgtcatatgccatttctcctcactcaccacgattccatttcttaggattcctacgccagctacgacgtgaacggcaatgattatgacccatctccacgatatgatgccagcaatgaaaataagtacgtcacctcgcctcatctccccggcttctcttcccctccctgcagcgtcactattgaatgtgtgtgcgagggagctggagaggcggtggctgccggcgtatcttccctgcctgggcgcgaggcaggcttctccaggagtcacaggccatgccaggcacagcccttcaggcacggccagcttctgtggagtcagcctgttcctctggggtgtcaccgctgccgggcagctagaaatgggtgtttgacagacatcgttcctgtttccaactttcttgaaatattttaaaagagaaacccttaagtctaaccgtctccatgacctgctgtgtgaagacagcagtttggtctgtttgagcacacaggtcacgtgcctgagcttttgtgactctgtgaccttaggaatgaggtggaaggggcatgagtaatgctggatagacccaggttcagatcgcagctctcccacttactggctgcgtgcatgccgggtgagctggttgaaacttcatgtcttagtgtcttagaggctcgtccaggccagtgatgtcccctacctcacagggtcacaggaggggtcagtgagatgatgcatgaggaatgcacccagcagattcttccgaaatggtgggcgtttttgtgtcactgtcattttgcaagtggaggcagtggggtccggagagcccaggtgactttgcagtgtaaacggcagccctggggtcagtcctgggaattcatttgctgtctctttccttctccatcagcatgccccataccctgagctcttatcattcctctaaaaatatttagagggaaataataaaagctttttcttcctccccactgttgacaagactcttgctgaggggcgtctcccgattatagtcttttagtttgtggtcgctttgattctgagattcacaaacgggtgcgcaggcaatgctgtgcaggaagcctcggccactggagttccacacagcaggctgcagagctcccgcgagcctgcagcagcccagcctcatgcacgtcccaaggtgcccttcctgctgccagtgaggatgcctggggcaaaggaggaatgacccacataccacgcagtgacccttgaagggcaggattcaatcccatcccgagccatccatcgagctctgtgaccccgggaacagccctggccttgaagctgtgtggcttccagggaaggacagatgactctcttccagagggctgctgcctggggcgatttttaaaggcagctttaaatttgaatcaatgattcccatcctctgtggactcttctcaaagatgtgctatttcaagttgctcctattttggcccccgctggaggaactgacccgacgtggcacatcagagaatggggtcattactgaggaaaacgcatttgtttttctggtcatttcttcatagtctcccagctgctgagtgtttaatttagagcgttcttcctcagctccagcttaaatggccttagaagcacaggaagggctgcctcagggtaagcatggtgttgtaggtgcataggggatgaggcaggtgacatcagcaccagactgttccttctttcatcctgccaggcagcaggtgtccctgctgccagccacaggagacacgaggccgaggtggcgcagcacccaccctacacagcagtggccatgtgccaattacacgtgctgggaggaggaaggtataggaccacgggcactggggcaggcaccttcctcccacatgggggtcaggggaggcatgctggaagaggtgaccatgcgtgagcacttgccacattcaggatgccaggaagggctgtacccaggctgacttggtgccttctcccagagtggggttggtgatgagaggggatgcaggaaatgggctttaatgacatctctgggcttcggacaactgactctcttgttgcattgaactgagccaggcactgaattcactgaaacttgctgggctgcgtcctcacttggttttttcctttgtttcagacacggcactcgttgtgcgggagaagttgctgcttcagcaaacaattcctactgcatcgtgggcatagcgtacaatgccaaaataggaggtaaggccgggcatggcagcctgcgagccgaggggcctggggcaggggcagctgggagctccctgtccgctggtctcagcagcctcctgttttttggctttggccatgtcagcagacccctgggccagacgcagcagtgccgtctgtatcatggcccaggcagctgacccacagggattggggcctcaagacagaggaactgcttactgttttgcctgaaaagccattgcagttcccatcagaaaggtaccctctctcctctggtcctgctggcctggctgctgactcctagaagtctgcgttgattccccgctgcccatagccctcagtggctccgtcacttcccagacagagtgacagcttttacccgggaccagagctttccctgggttctgactcccactcaagcctgctggcccacttctcctgcccctgctctgaccttagaggacatttttcatagtgccccttagacacatctggtcttcccgattgatgcctgggcttgaaccattcccatccccgcctcccccgtctttccacttggctctgtccacctgtgccttatggcagcctcatgcctgctctgttctgtgaagtgctccctggatccagctgtcccccgtctcattcaccagggaatcagctcttcttggtccctttacggagcagcagccgcccccgccccgcgtgcgtctggtcttgccatttagcttctcacactgctcagtcaagctgcccttgctaggatgaggctttggagtaaagtattgaatgtcttcctattccccacgggagcccggcagtgtgacagctcagtcacccaagtgctctgaaggcccctctaggtgcatgtcactgacccgggaactgagcaagtgggggcagcagagaggagtgccagagggcctccagggactgcggcctcacccaggaggcctgtctgcttctcagtccgaaggtgctcctgctcactcaggtggctgcagtgggaaaccaccttcccgggggggcactgccatcctgccactgagccttggtgagggtgcctgcagccgctttctgccgttctgccaccgagccttggtgagggtggctgcagccgctttggctccacttatgagcagtaccaggcagggaggttgggccacggttccctggatcaccagtccttgggggaatttcttgtgtttcgaaaagagggtccttagcttttacttaattaggactctgcctgccttttcccgtggaaatcttgaaggtggcttggattttcattttatagcagaattaacccccaagggcgcgttctgcagaacaaatcaggagactctgtcaactggcctggctcctttgtggatagttcttgcaaactgagatatataagttctccctggagcctttgatgatgggtgcagagccctgagacgtctctccaggatctgtagaatcgggccaacctgggtgccagttccattcccaccactcactgtctgtgtgtccttgaacaacttacataacctctctgagccaaggtttctttacctgtggggtgaaatgaccaccaggcagctgcctccccagttttgttatgaggatgaagtcagataccatgtgtgaaaccatcggcttgggctaagtctgcaggggatagctgagctcctccttccctcttgctgagactctcagtgggagaataaaaaccatttgtgttgctttgagtgaggggtggaccccacctttggagttgcttgagccttgctcccccaagtccctagactttgagcatggcatcctctgggagccgttagaaatgcagaatccccaccccaggcctacggagtcagggtttgcattataacaagatcgcaggggatttgtctccacgtcacaatgtgagaagcgctggtttagaggactccctggggtctcacaggtaggtaacacctgcatcatggattgcggggaggagtcagtggaagtaacatgcataaagatcctcccagatgaggtgcacagtaaatacagcattaccgttagatagctctacactcatcgccaaactctttccctacgtttcccgagtcctgcaagtgaaggtgctccctccagatctggaaaatgtagggatagaatttggcatgtgtttaaaacaagaataatagcaatgcactgtgggtttataacgtatgaagcaatatatatatatatgtatataaacaacagcaggaatggtaacagtcatggtgaatggaaacgctctatcttagatttatacattatacagaaaatagtatactattaattccagatagactgggataagttaggatatgcattatagtctcttgagtgacaactaacaataaagacatgaaaaggaagagctctatggtcagctccagggacatcccagggaaattccctgttgtgtgccagcacacacagagagggagctgtgttagagcacctcacccagaggtgggcttggagggagaaccaggaggaagcgggttggctgcctgtgtggagaggctaaagctgtttgcagcagctttggagccagtggctatcactggatccttgggtcaaggccagcctcaaccccacacctaccttccagagaggtgtgagctccacctcatgtcctcgatctttatgtggcctgctcaccccagccccacgccgcagacgtaattgtctcctcagcactctcacgggtagtcaagtcctgccgtgtcaagctcagccacaccctcatgccctgctctcatggggtgcctgctctgccacccctggggctcctacctgcccctttaacttcaataggtggttctgtgccatcttccttgttggttccctccaaagacatgctgagctcctagaggcccagaactgtgaccctcatctctttcgtctctctgtcagcggcatatccagtattatacatgcagcatgtgctcaaccatattcaatgcgttaattaaaaaatatccctgttatcatgcatatcccaacttatcccagtctatctggaattaatagtgtactttctatataatgtgtaaatctaagattgtttccattcaccatcactgtcattgtttgtgctgttgtttttatagattctacttcacatgttataaacccacagtgcatttcttgttttaaacatgtagttgaccgcaaactacttatgacaagaaatacatttacctgcctgtgtaccattccactgactggtcttccttactttttctagcttcagatttccatctttccatttatcttcagcctgtcgccaggctctttggtatttattgaggttatctctcacctcttttggtatttgttgaggttcaggtatgctagtgaaaaattctctccaattttatctgaaagtggcttctcttcatttttcttaaaagaaattatgctgaacacgaccttctaactttttttttgtctttcaacactttaaaggtgttattctgttgtcttctggtatccattgtttccgacgatgagtcgattgttaattgccatccttattgttgttcccttttaagaaacgtgatttgttcctatggctcctttttttttttttgaagagatggggtcttgctctgtcacccaggttggagtgcagtggcataatcatagctcactgcagccttaaactcctggcctcaagtgatcctcccacccgagcctcccaagtatctgggactgcaggtgaacacaacctttcccagctaattaaaaaaaacacacacctttttccttgtaggatgagatactgctgtgttgcccaggctggactcaaactcctggcctcaagcgatcctcccacctcagcctcccaaagtgctgggattacaggcatgagccaccatggcccttccctgtagctgctttcataatgttatttttaaaaatatctgtgctttgcctgtggctctaacattcttttatgtagttttcttcgtattaattccatcttgggttttctgtgcttcttagtgggttattctttttaaagaaaatttggaaaaaaaattgtcaatatttcttcaaatttttttaagttccattttctttctactctctgtgggcacagttatagttgttagattgcttaatacgcctcacaggttactgaggcactgttcatttttttaacccttttttctctgcttcgaatggaatgatttttattgaacttcaagttaactaatccttccttttgttgtgttcagtctggtctttaaaaaaaatttcagggctgggcatggtggctcacacctgtaatctcagcagtttgggtggctgaggtgagtggatcacctgagatcaggagttcaagaccagactggccaacatgctaaaaccccgtctctactaaaaatacaaaaaatcagccaggtgtggtggcacatgcctgtaatcccagctactcaggaggctgaggcaagagaattggcttagacctgggaggcggaggttgcagtgagctgagatcataccactgcattccagcctgggtgacagagcaagactccatctcaaaaaaaaaaaaaaaaaattcagatatttacttttctgtcttatgatttccatttgactctttttttactgtttccgaatccctcatgtgtctccatctcttcagtcatgatatctatcttttattctagactctttaacatgtttgtaagaaatactttaaagtcttttgcacttaattccaacatctaggccattttaggagtatgtttataatgactgatttttctctttacagtgggtcatgtatttctctttctttgcatatgtctagtaattttttattgtatggtagatattgttacattgtagagactctggattctgttgtctttgaatatcattaagtttctttcttggccaggcgcggtggctcacgcctgtaatcccagcactgtgggaggctgaggcgggtggatcccgagatcaggagattgagaccatcctggctaacacagtgaaaccccatctctactaaaaatgcaaaaaattagccgggcgcggtggcgggcgcctgcagtcccagctacttgggaggctgaggcaggagaatggcgtgaacccgggaggcagagcttgcagtgagctgagatcgcgccaactgcactccagcctgggcgacagagcgagactccgtctcaaaaaaaaaaaaaagtttcgttctagcagttggttaaatgtgagcttgtggagacctgattattcttttttttaatgtttgctatctttctgattttcgcatagccttagggaaaatccattagccctagcatatggtctttactcctagaccatgacccttttggtatttcagtggaaagcctgcaatgtttaaacccagacctctaacttagcaagtctgaaactccagatggactgccctgtagtgggcagcagctgaaatacctgctcagctcctccagcctctcagctgctgttttcctactggacttcttagtgggttgcccatgtatacttcagggttcagccaagtggttgtgaggagtttatatgttctcttctgtagatctctcctttctgaaatttctcctctcaatttccagcagctctgacagtcccaactctatcccctgactcctctggagaataagatgacattttactgtacttcagtatttgagttctagcctctctgcaccaaaagaaatggaaagttccctcaagaggaaaagtcatgtcaacttggagcatacccagtatggtttgtcaagaattgaaccccctgcctacctctgcccttttctggttgttcttcagtggtcttaaaaagttaattttttctaagtaaatattttttcagagtttataattattatctttaataagaagagttagtctgatataagcaactctgtcattgttgaacttaaaacttgtggtttatagttatcaattagattgtgtattagttatctattgctgagtggcagtcattctaaaaatgcagctgcttaaaacaacaaacacttgttttccagcacagatagtggctttgctgaatgtttctgattcagggtcactggtgaagttccagtcaagctgttggctgtgattgtagtctgaagacttgactgagtctggaggattcacttccaagatgggttacttatggggctgttggctggagtccctgattcctcactgtgtgtacctttccagagggttgcttgagtgtccccataacatggtagctggctttctttataacaagtgattcaagagaaaaagcaaaaccaaaccagcaatgtcttttatgacctcatctcagaagtcatgtaccatctcttcagccatactctgtgcattagaaatggatcactaagtttaacaatacactcaaggggaaagaaatttggtcgcaccttttgagtagaaaggtgtcaaaaaacctgtggacatagtttaaccaattttctttgtaaaactgcacattccttataaatgttgtcacataaaaataattaaatcaactgaaagaaacaggaactgtccaaattatatcttaagaaatagccaggcgtggtggctcatgcctgtaatcccagcactttgagaggcggaggtgagcagatcacctgaggtcaggagttcccgaacagcctgccaacatggtgaaaccctgtctctactaaaaatataaaaatcagctggatgtggtggtaggggcctgtagtcccagctacttgggaggctgaggcaggagaattgcttgaacctgtaaggtggaggtttcagtgagccaagatcgtgccactgcactccagcctgggcaacagagcgagactccatctcaaaaataataaaaaagaaacaaaactccttcaacccccagtttccctaggtgtgttgccttcaggtgcattagcacctaccctggggagaaattttacactgtcaggaatccacagaggcatgtgccatcttcattgtttccagagaggagagtggggtacccctgtgcggtcactggtccctgatgtctttcattttagagagactttaattttatattaagttgtcaagctgtacattgatgatttgtgcccccttttcatatataattttttaataaaaatctgtttaaagtttttatgggctgggcatagtggttcacacttgtaatcccagcactttgggggttgaggcaggaagaccttttgagcccagaaatttgagaccaacctggtcaacatagtgataccctgtctctacaaaaaattttgaaaaatttagccgggcatggtggcatgtgcttgtagtcccagctacttgggaggctgaggtgagaggaccacataagcctaggaggtcgaggccgcagtgagccatgattgcgtcattatactccagctgggtgacagagtgagaccctgtctcaaaaaaacaaagtaaagttcttatgatgtcacatttgttcatcttccttcatgactcttgagtttgggatcttgcccaagatagtaaacctgttttgtatttcctctaaaaacttagttttaggacaataattggtcttaaaatttttatggttttctctttcctgtttagctttttttttttttttttgagacagaatctcactctgtcacccaggctggagtgcagtagcatgatctcagctcactgcaacctccacctcctgggttcaagcaattctcctgcctcagcctcccgagtacctgggattacaggtgcccaccaccatgcctggctaatttttttgtattttttatgtaaagacggtgtttcactatgttggccaggctgatctcggactcctgacctcaggtgatccacctgcctcagctgcccaaagtactgggattacaggtgtgagccactacaaccagcctttctgttcagctttttgatccatatggaatttatttctgtgagtagtgtgaaagagagatccccccaaatcaatatttggtgattgccacacgtggccctcatcacatcctagatccccatatggacactgggtctgcccttacgtttccttagtcagttccttcataagccctaacaataccacgctttgaattattacagtttaggagagttttggggttttgtttttgtttttttggtaactgatagggcaaattttctcttatggttccttttcaaaaattacttggctattcttgcacattttctctttcagatgaacttgagaatctgcttgtcaagttccattaaaaaaaaaaaaagccctgttgggattttgattgggattgcttggaaattatagattaattgggggagaatgacatctttacaatattgagtcttcccacccaggagcatggtatgtttttatttattcaggtcttcttttacattgttttttaaagttttatcactttctccatatcgattttatacatttcttattagatttatatctagattttttaaaaatttgtatttctaattggtcattattgaaacggatataggaaagctattgatttttgtatgttgggttttgtttctggtcaccttattgatctctgtgggtgctgttgtttttccgttggattctcttggcttttctggagagatgttaaataatagctatctgtaaatataatggtggttttatctctttaatattaataactctctttttcttgccttatttgaatatgtagcagttcctgatgaatattgaatagtggtggtttataggttctgtttgatttctgacttatacaggaatacttctaattttatgccatttgtaaatgtcttccctgtagttaccctttatcaagttgagaaaattttattatattcctagatttctaagagatttaatcaggaatggatgttgaatatttaaaagtatctattgagattattatattgtttttcaactttattgtttaatctgtgtagtgtaataagttacattaatagatttcctaaactgggctaggcacagtggctcacgcctgtaatcccagcactttgggaggtcaaagtgggtggatcacctgatgtcgggagctcgagaccggcctggccaaaatgttgaaaccctgtttgtactaaaaatacaaaaattagctgggcatggtggcaggcacctgtaatcccagctactcgggaggctgaggcaggagaatcgcttgaacctgggagacaaaggctgcagtgagtcgagatgacaccactgcactgcagccctgtaagactttgcctcaaaaaaaaaaaaaaaaaaatcctaaattggaaactttttctttcatttttgaaataagttccatttgctcatgagtattgttgttttgatacatctgcattcaactgctgatgtcttcttatagttttacaacttcatttataaaatggatagaatcacagtttctgtgttttgtgatgtttctctctaacttgtttatcagagtcaggccagtctcgtagaaagagttaggaaactttcttttcctgtgctctgaaatagttaatatattgtggatagtgcatgatttctgaagtgttggtagagctgattaactagtctgattggatatggtgactttcaaaaggactagacctattcaggttttctgtttcttcttgaggagatttttgtaattaaatcttcctagaaaatcatcaatttttcaagattttcaaatatatgacataaattcaatatcatatgctcgtaatttaaaagtacatcctccatgtttatagttataattgtttctaatcttatttgtgacatctcctcttttttccttgattgatgaaaaatttctatttttaataaaataggttttttcacctcagtgtcatacaatatacccatgtaataaatttgcacatataacccctgaatctaaagtaaaagttaaaattataaaaaatagtgtacgtaaaaataaaaaaaaacaggcttttgcagagaactaggttttttttaattgagttcctttattttctgcatcataaatttctgcttttacttatttattaattccttcagcttttaaatttgttgttgctgtgttctaattccttgaatggaatgtgtatttagttctttattttcaggattttatgtgttctaataaataaataaataatcatacattctcctttcatcacctcttactagtttaattatatggtgcttttcttgctatatatttctgaataattgtacgtttcagcttagatttttctctttaacccaggagttatttagaagagatttataaaatttttcaactgcgtagattttctgatgctccttttgttgttaatttttaagtttcttatattgggttcacagaatgttctgtatattttctgccttttggaatttctggagaatatctttgtgtcctaatacacgttcagtttttgtgaatatgccaatgggtgtttgcattagtccgttttcacactgctgataaagacatacccaagactgggaacaaaaagaaatttaattgaacttatagttccacatggctggggaggcgtcagaatcatggtgggaggtgaaaggcacttcttaacatggcggtggcaagagaaaaatgaggaggaagcaaaagcagaaacccctgataaacccatcagatctcataagacttattcactatcacgagaatagcacaggatataatataatatagtagcttttccaggcacatggtacaagctgccagtggatctactattctggggtctggaggatggtggccctcttctcacaggtccactaggcagtaccccagtagggactctttgtgggggttctgaccccacaattcccttctgcactgccctagcagaggttcttcatgagggccccacccctgcagcaaagttctgcctgggcatccaggtgtttccctacagcttctgaaatctaggtggaggttcccaaacctcagttcttgacttctgtgcacctgcaggctcaacacacaagtggaagttgccaaagcttggggctcccaccctctgaagccacagcccaagctgtacgttggctcctttcagccacgactgacgtggctaggacacagtgcaccaagtccttaggctgcatacagtacgaggaccctgggcgtggcccatgaaaccactttttcctcctgggcctctgggcctctgatgggaggggctgctgtgaaggtctctgacatggcctggagacattttcccatggtcttggggattaatgttagattccttgttacttatgcagatttctgcagccggcttgaatttctcctcagaaaatgggattttcttttctactgcatcatcaggctgcagattttctgaacttttatgctctgcttcccttttaaaacagaatggctttaacagcacccaagtcaccttttaaatgctttgctacttagaaatttcttctgccagatactctaaatcatctttctcaagttcaaagttccacagatctctggggcaggggcaaaattctgccagtctctttgctaaaacataacaagagtcacctttgctccagttcccaatgagttcctcatctccatctgagaccacctgaccatggaccttactgttcatatcactatcagcatttttgtcaaagccattcaacaaatctctaggaggttccaaactttcccacattttcctgtcttcttctgagccctccaaactgttccagcctctgcctgttacccagttccaaagttgcttccacattttggggtatcttttcagcaatgcccactctatgggcaccaatttactgtattagtccattttcatgctgctgatgaagacattcccgagactgggaagaaaaagagatttaattggacttacagttccacgtggctgggaaggcctcagaatcatggtgggaggcgaaagccacttcttatatggtggtggcaagagaaaaatgaggaggaagcaaaagcagaaacccgtgataaacctgtcagatctcatgagacttactctctatcacaaaaatagcacaggaaagactggcacccatgattcaattacctccccctgagtccctcccacaacatgtgggaattctgggagattcaattctagttgagatttgggtggggacacagccaaaccatatcagtgtttgaagagtatttttattctatgctcattgagtaaaaaaaatctgtatcagattagggattgcaactggtagcccataagctgcctttggcctgcagacatgttttgtttgactcacacaagtgtatttttgaaaacttgagtaaacatttacaaatcacagtattttatgtaaaaatatggatttggggctttctatgaaagcttagaagctctggctgtgctgggccctcattccttaatggcaacagtcggctacgattgctcctaactcaaagggcagtctacccgtccccgggtggccttcacagacctggctgcttcagccatttaccctgcctgcctgatacctttaggcatcagcctctatcacctgtgtgttctatcaagttcattcagaagttctggagtctttcttactttttgtctacctgatctgtttctgagaaggaatgctggtttccatgatgattatggatgtgtcagtttctttccgttttcgctgtacacattttatagctatttacaaggtacattacaaggtataatgaatcttcatcaatataaaatcctctctatctcatttttgccctttaattgtactttggctgatataacacctgtactttgattgataaaagtagcacacttgcgaatttattttatcatccttcttctcatatattctttatttctaatgttggttttataagcagcatgtatctggatttatattttaacacaattgaagagtctctttaaagaaggactttgttatattcatacatgtgctgatttcagatatctttggatttatttctattgtatttgtttttatctattcatccatccatccatccatccatctgtccgtccatctgtctaccaatctgtctttaccttccttttgctggttagatgtagtttcttctcttttctttcattctaatgggttgaaatttttacattctaaatctgtttttctgttactctttaaacacagttattgggacttatgtttctctacagtgtttagcgctaatcagtacttaactctttcacctgagcaacataagaaacttaccatagctccactcctctgccatcttctgtctgtcgtcacctccttgaattgggataattcaaaaatttaactccatattatttttaacaagtttacatcatgcatcaacaattgtgtgagcttaagtataaagtctaattaatttctttggtcaccattgtttcttttttcttacatctttgtatgtgatttttttattttactagattttctcatctattaaattattcattctcttaaaagatattttgagtgcttgctataggtatgaatggttatatagatagtaaattttctgagtccttgaagtctaaaaatgtcattattttctccctacaaatttggctaggttttgactttaagttcaagataattttcactcataatttaaaaggtattaccccatggtctttggtattcagtgttgctgacaaggggcgtctctttgtctcaggtgaatttttttgctctgaagtctactttatctgatattaatatagctacttctactttcctttgattaatggttgtacagtatacgtttttccatccttttactttcaacttgcctatattgttatatttgaattgagtctcctgtagataacatatatttgggccattttttaaaatttatttttcttttataaaaatttttattaatttgaagagtacaatacagtagaaattgcctcttttttcttttattgataaatgacatttcacatatttaagaggtacctgtgaatgttttctacatgcatggaatgcagaatgatcaagtcaaggcatttggggtatccgtcatcttgggtatttatcatgtctatgtgttggtaacatttcaagtcctctcttctacactgaaatatttaacatattgttgctaactgtagccccccggtctgctgtcaaacgtgggccatgtttttagattcacttgccaatctcttttagttactatatttagatggttaatatttaatgtaattattgatacattaggggttaagtctgccattttaacttctctattattttcctctgtatttagtttctctgttttttttttcctgccttcctgtgggttacttgaacactttttaaaatctcacttggtttataatgtttttgagtatgtcttcttgtatagcttttttagtggctacccttggtattacattatgcacatgtaacttctcacaatcaattttatgggtgttgtcactttaccagcgtgaggtacagaaaccttaccttcctttatatcccattattctctcccatttatatttgtaatatacatacatattaaacatacattcatttagaaccacatcagacagtgttgtaatttttgcttcaaccatcaaatgtaatttagaaaacttgaaagtaaacttggtgaatctgtaggtttatatctcttgccaaatttggagagcgtttagccattatttcttcgagaacttttccagcccccactactttttttcctcctcctcctcctcctcctcctcctcctcctcctcactcctcctccattattagagacagggtctcgctgtgttgctcaggctggagtgcagtggggcagtcatagctcactgtaacctcgaactcctgggcacaagcaatcctccggccttggcctcccaaagggctgggattacaggtgtgagccaccactcctggccctttttcctctcctcctgtccactctagtgacatgaagtttaggtctttgttatagtctcacaagtccctaatgctctgttcatatttttaaatttttttctttatgttgttcagattgggtaattttatatatatatatatatatataattttccagttcactctttcttctgtcctgtgggttctattactgagcccatcactgagctttttgattattgtatttccagttctaataattctacttggttcctctttatatcgtgtatttctttgctgagactttcagtttctttattgagactttctattttttcatttgttttaggcatatttgtaattgctcacctaggtgtttttttcatggcctctttaaaatctttattaatatacaactagtatatccttaaaaattaaaaataattttaaaaggtaaacctaaaaagaggaagaaaatgaataaaatgtctgtcagatggttccagcatccgtttcctccatgttggcatcggtgattgtctgtctttatgcatttgagatcttcctattcgttcttggaatgacatgtgatattcctttgaaacctgtacatttttgcattatgttatgaggctatacctgacttcagccttctgtttcagctggcttctctggccctgttgctgcagaggacaaggggtaccatttcattattgtcaggggtaggttgtccagggcccccattcagcctccgctgatacccaagcgtgggaagtctccttatcagtgctgagaaggggcagtggttcccactccctgtgtgcctcccatgaccccacagtgcaggtcccctcattactgtgagcagcagtgagcctcctgactctccaccaggcatcctgacacaactccaggggatggaggggacacgttgttactgctgggtgtggttggaagaccaggctcatggcatggtatctgctggcacaatgcaagtgggccccttttgaggttgctggaggtaaaagcgctgcttcctacctgctgtttcctgacatgccccagcagtgaggtcgggcacctcatttcgtcctcgcatgggtggaggtctaggctcgccactcaggctgtgctgccacaggtcggggtggtgccacggttccttgctgtggtatttggcctacttattgtgtatggttttttccatttgttctactggccctgtctcgtcgggtccctctggtcttgttcatgttgctttttaattgggtgcccctctttcttgggatgggttttcctcaaacatgggctgcttcttggtcgtccacccctgcatgtgctcacagattcccatgtggctgtgggtggttgtctggtctgacggcaggggtctttctgtgatgtggagtggagggagctgttgcttgatagcatttcttctgagaagggtgcgaggcggactccccgctcccagggcattgtcctggtgctctggccttaggaccctgtctcactgcaccagcctcaagatgactctgctgctgtccccactcagcctggaggctgagacctgccaccctagctccttactccgaggcctgtttggggctcctcctgtccttgcatgcccagcctggcaccttcctcagctctggaattgttccccactcagaagtcctcgcgccaggaccccgcctcctgctgctacctgatgccctctgcttcccgtctttcctcagtgcctcaagacagctcgtctgtgctgatcttgtttcccaaggctggttcagatttgttcgttctaagttttattcctagggatccaggccctggggagaggtaggctgcgtgctcagtcttcctcctgggttgggtctcttgagtcttttcactgtggtgcagatggtgacacctcttgccgattgctgttggttgccaagcacttgtagtcatctttgcatccagttcttagtgtgcctctgtgcgctggacatgatcatggccgtttcccaccaggggagactaacagagagatgaattgccacatctgggttcacacagctgccaagaggcagcgcagaggcttgagctcaggcctgttgccctgaagcctggattccacctttgcaatcatagccttctgatgctaggacatcgcggtgaccagatgagaacagctgccaccaagcccagtggccagaaacagaagcagaaggggaagccttcgcagtgtataactgtatacttcttgactgaattctgattccttccaagcatattttggcctcgcctcttcctcctggcctaaaaaggtatgataatgggaacagcacaggagggagcgagagagggcagcaggcatttcctagcccctcttcttattcatcctttctttgctctcttgctctgttcacctttttgtctttttaattttgacctggcacatagttctccttctctctctctctaatgctccttccctcccagcccttctgcttcagggtggcattggtggtggggggctccagacttggctgcctccactgccatcagctcacctccaaggtgagtgcaggctgagcttcatggcaagcccttcctgctggggcctgcagaattctaaaggccctggccaagcacagtggctcacacaaaatccctgcagtttgggaggccaaggcaggaggatcacttgaggccaggagtttgaaaccagcctcaacaacatagtgagaccctgtgtctacaaacaatttaaaaattagccaggcatggtggcttatgcctgtaatcccagccactcaggaggctgaggcaggaagatctcttaagcctagatgtttgaagctgcagtgagcaatgattgtggcactgcactccagcctgggcaacagagcaagactcaaactcaaaaaaacaaacaaacaaaaaagtgtgaaggcccctcccagaatgcaggctgaggatgtgatcccatccactgcaccaggtcctcctggcttcgtgccccatgcggcatcctttgagaaaagcttgctggggagccaggtgtgctggcttggccggagtggaacctgctctctcagggaggcttgcaatatgcaggggaggtgagtggagccctcacccctttaactttaccaggcttctaccctttagcaagttcctcacgtgtgctgatacttaaccagattcagacactttcctaaggcaggaggggtgtcatgagggacactgcattatggtacactttccctgcattttttttttttttttgagacggagtcttactctgtcgcccaggctggagtgcagtggcacgatctcggctcactgcaagctccgcctcccgggttcacgccattctcctgcctcagcctcccgagtagctgggactacaggcgcccgccaccgcgcccggctaattttctgcctttttagtagagacggggtttcactgtgttagccaggatggtctcgatctcctgacctcgtgatccgcccgcctcggccgcccaaagtgctgggattacaggcgtgagccactgcgcctggccttgtatttttaatagagacagggtttcaccatgttggccaggatggtctcgatctcctgacctcgtgatccgcccgcctcggccgcccaaagtgctgggattacaggcatgagcccccgcgctcagcctccctgcttttcagaagcatcgccagtccacagggcaggatccctgaggctggtctggagtaggctgcatttggggcctgcagcaagggcagctggagaccgcagggagccctcccacctgacaaacagaaaagctcccctgctccggcccccggatataggtgcatcttttcagaccatgtttgccctgtttctgggaaggaaaagtaaacggcagcgaccagattcctgttggtgtttttgctccatattttgattggggaactgaatcatgtttttcctttcataaacacgaaaatgttaagtacataacagctaaattaatccatgcccataaattggttaattatgttaattctgagtcacagaattcagtctcgttagtgtttccattaagcagtttaggcctgtgagcattttaagagaacagtttaagctgtagattaatcttcaaaggttcccagcgcattttcaactgcaagaggattttaaatgcactggggggcttggggggatttggtgaatgttaggagctgctgctgtcagggagcgggtgttccccacttcctcgtccctcacctcccccaacacatccaaggcccctgcctgctagatctgagcatcgccaggctaagcaggagccataggaaggaggagatgggcaagaactggcatagccccttctgccctgtgtctccctggtggccatgccctcctcaggccgccctgctgcagacacccgcagagaatgggtgaggctagctctcgaatgctgtgggctgcatagccctgggttcctgagagggctgctgaggggctttcttcctgggtgtacataagaaagaagcagagagacaggaagagagcacgctgagtcttagaaacaagctcctgggtggcctttgttcatggcggcatgaacgtctccttttcgccgtccgtgtccccttcagaggtccgttcaggatatgggtttgctttcttggcacgtgcgcctcctctagggttccttgccgtacttgcgtgtggtgcagatgtacgggtgctccatctggctcagaagcctgctgtcctgtcctgcatcccaagctgccggctctcactggcttcctgtgtgtgcctgggccatgcacttctgttctccagccctcattccctagcggggagaccgtgaaagggtcagcctcgatgtcaaacctctagaccatggctaaggcttttccaggttttgtattgttctttgaagaatcaacaggacccgattatcaaagagagacctgtttaaatatgtacaatcattttcggtattatttaggtttggcaaggccagcagatgaggagaccactgccatgcattgaaaaggtggtttgttccagttcccaagaggatgcgtcccagtaccgtatgtggggccacacagagaagcagcgggttctgtcaggaggcaggagagaggggaagacacgggccagaggccttgtggtggtttctgtgggaaggagtgggtgaggcagagaaggcaagttcagaatcagctaggctgaataatttcagcagactcaggggaataggggctgtccctagctgcctgacacctggccttgggtggttaggttaagggagtagtgacctggtgtgtgagagcccatgatggaggtggctggggtgtagactctggattggttggcttgcatgtgaaaagcacactcctgatgggtagtttactatcccgagaccctgggtagcgcctgaaggaacagtctccccagggtcagcaagccccagatgtcaaagcatcagatactgaaaatacaagaggaaggggagaagatggatgataccaaagttatcccagacgcagtaccagggccagggcctcaacttagcttttcattaatcttctcaactgccttggcagataaatattgtagaaaacatgatttagagaggctgagactatggcccaaggtcatgcagagccgacattccgctccaggactctctgaccccagctgtcttccccctaccatgagctgctctgtatcttgccaggggccatacccttgccacaccacactgccagcctcccacgctggtcacggcccttctcttggaggtcgctggctgagagagctgcgcacctgtgtccgtgacacagctgtggagatgggacgccagacacatggaccacagactggggaaccagtctcagttatcacgggacctgacctgggacagacctcatctcctggatccagggctgcatgcaggacatgcccataaggagcgtcgctggctacagctgtgtttccactgtagaaggaggtggagtggctccatcagggcatcaggaacagaacaggaagcaggaagagatttggcttggtgatcccccgcgcgtccccacacacttcatgtcacgatggcgaacgtaggtctgccttgacaactcggcagaccacagctccctggagctcctagaacaaggctgtcctgtgggggcatagttagcaatttgaaagccgtgtctattgtcttaggtgataatgagggttgacagaaaccttttaggattgtagcatttctaagtaactgttgaaaccttacttggcccggaatggctgctcatagaacagaatgtgctatagttttactgaaaaaaacaaaacaaaaacaaaacataattctctgtggacttactaaaataaacccagggctaatgagcaaaatgtgttggggaggcctatttgtcacactcaggaagcgacagtctaattttatttgctcctgttcattgcttctgcattgccattcattcgctgaaggcaaaatacattacttctcaataaacaaaagtgggcccagcgtgtcccgctccctgccttcctccagccgttatccccccgggcaggagggctgacttgtattgatgtgcatgtgcgcgtgtgtgtgtgggtgtgtgggcttgtgggtgtgttcttcccattgctcttaatgttgagcttcctagaaagttttcaggggaaatgctgtgtctcgtgctgactggggccggctgcatgttgataggttcaccttgccttatacaaacctgctatttggaaagtcgagatataaattagaagcaggcggccgggtacggtggttcatacctgtaatcccagcactttgggaggccgaggtgggcagatcacttgaggtcaggggtttgagaccagcctggccagcatggcgaagccccatctctactaaaaatataaaaattagccaggcgtggtggtgtgtgcctgtaatcccagctactccagtggctgaggcaggagaatcgctcgaacctgggaggcgaggttgcagtgagctgagatcacgccactgcactccagcctgggcgacagagggagactctgtctgaaaaaaaaaattagaagcaggggaaatggaggaaagacaggtcactacggaaaaaaagtggctttgtttttttttttagcttcactaagtgagttgtaaaatcattcatttcatcaagttctcccagggcatttaaaatattattgggtttaggagattttataggaatgcacgtattatttaaagcaaggcaaactggtgtgattccttcctggatggagcttctgtgggcagctgcaattgtcagtggggggattggttcccatagcaccccgagttcttccctcaaacacaaaggcaccaggttctccaaagcaaccatcttccttccactcaacactcctcccgcctcacacccacagactcgtccttagagtggactgggcaggcgggttcattgtgccacgctgtgctctgaacccagcatgcccaaaagcagtccgttagcaagctgaccatggggagttcattgccatcaatgccatcaaaacaatttgcccaaatcaaatttatacctgacattttatagtaaatgggcctttcttttctcattagagaaatcattactgtttttcttctccttggcatttccagagagccattcacatttaaagctcatgttggaacagcaggcttctactgaaaatatttaccttttctttgttggcaacttgtcagtgttggggaaaatagatgcttcattaagatctaagcgcgtgatgcttgctttcccacacatcagtcagtctttttccaagatgaaaagcatggtgagaggtgttgggaaatcattctggtcatatgtttttatgtatttttggatgtcttctggcatcccgttcttcttgttcaaaaataggcatttcaacacctataacttgtagagagaatcctagaacaggatcagcttcaccacttagagcatcagaattggtcttgacccccgggtggccagtgaggtctcctgccctggagatccatggctgaaagtaagggcaaagagaaccctgctgccatttatccagcagttccggggccagggcctcaacttagcttttcgttaatcttcttaactgccccggtagataaaaattgtaagaaacatgatttagagaggttgagaccatggcccaaggtcatgtggaagcgagattacaccccaggactctctgaccccactctcttcccctaccgtgagctgctctgtatcttgccggcggccacgatcttgccagcctcttgcactgggcctggccctgacccttctcttggaggttcctggctgagagagctggacacttgggcccagtgtccctgacacagccatggagatgggatggcaggcacatggaccacagatttgggaaagaccccacttcatgtccacccgacccctcctctccacccagaaaggacaaaatacagtgagctgatgccacagcccatgtgagctgggcctagaggtggctctgccctgcctataaaagggggaaaggaacttacaatagatgccagcaaacccagaaacccagagaaggttggcccctgttacgactcctttgatcttcacagggaggtgagctcttgctctattaaaattaagaacctctgtttgtctagagctaccataaacacagtgagaagaccaggcatacactgggagaagatttttataacctgcattaccaacaaaggattaattctcagtacaagcaaaattaaacaatgtatcacttaagcatatatacaattgtattaaactagtagtatttaaaaagcaatggcctgcgaggtgggcggatcacctgaagtcaggagttcaagaccagcctggccaacgtggtgaaaccccgtttctactaaaaagcacaaaaattagccgtgtgtggtggcgggcgcctgtaatcccagctacttggttggctgaggcaggagaatcacttgaacccgggaggcggaggttgcagtgagccgaaatggcgccactgtcctccaacctgggcaacagagcgagacgccatctcaaaataaataaataaataaataaataaaggcaatggcatgaataatccaaaaattctgatcattttcctctgagaagctgggggtgacagggaggacacagaagtagaggcccccagtgggtcacgttcttgttcttgcattgggctgcagggttcatgggtatccgtttttttattaggctttataactaacgtgtatgtgacatacaatcttttgtgcttatcaagtcatgtgtttttagaaaacaaaaagaaaaaccaatcagttattgttactacctccatttttttttctctctcttttttttaattattattatactttaagttttagggtacatgtgcacaatgtgcaggttagttacatatgtgtacatgtgccatgctggtgtgctgcacccattaactggtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatagtttactgagaatgatgatttccagtttcatccatgtccctacaaaggacatgaactcatcattttttatggctgcatagtattccatggcgtatatgtgccacacttttcttaatccagtctatcattgttggacatttgggttggttccaagtctttgctattgtgaatagtgccacaataaacatatgtgtgcgtgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatgatatctcattgtggttttgttttggatttctctgatgaccagtgatgatgagcattttttcatgtgtcttttggctgcataaatgtcttcttttgagaagtgtctgttcatatcctttgcccactttttgatggggttgtttgtttctttcttgtaaatttgtttgagttcattgtagattctggatactagccctttgtcagatgagtaggttgcgaaaattttctcccgttttgtaggttgcctgttcactctgatggtagtttcttttgctgtgcagaagctctttagtttaattagatcccatttgtcaattttgtcttttggtgccattgcttttggtgttttagacatgaagtccttgcccatgcctatgtcctgaatggtaatgcctaggttttcttctagggtttttatggttttaggtctaacgtttaagtctttaatccatcttgaattaacttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtcgtatagtttgaagtcaggtagcgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacaatattgatactacctccatttttacagatgggaaaactgaggctcagtggggtcaaactagcagcaaacacacacgttgaatgcttactgtgtgccagaccctttacacggatcatccgatttcatttgtttgacatccctctacatatgataagtgtcatcattgcagtgtgcagaagactgaggctcagcgagacgggagaacttcagagtcactacctggtcacagttgatggtgaaggcaaggtcttcacctgtggcatgccccacgtccctcctgctggctccgaggctcactgtgagtgacagctccactctgtggacctccccttgggagcaggcgtcgaggcatctaagtccacttgccttgtgccatctcagtgcctggacactggtggctaccctgggccgtcctgcagccagctcgctgaggtaggaaagagaggaagggaaacaggtggagtgagaagagaagatagataacactgaagttacatttattcctactgctcatagtaggctttcaagctatgaagagatggctcttcccgtgacttcagccccatcctccatcgctgcccatgcccacgtggctgacactgccgaatgtctctagcactgttgttgaacttctgatgtctcctatgcctcaaccttgctattgccttggtgtaaatttctctgacattgattttgaatacaattccaggcttttggagcagaagtttccagttaagcttggtgtcccacctaagtgttaaggtcaacatgccgagccctagagtggtcctccctctcccaccaccaactatcctacctggcctcccaagaactgcctttggtgactcttgtattctctgtcttgcttcatgcctgggaaatttcagggcatatattaaggggaaaaccttagggaaacctgaaccttcaaaactgggtagaatgaatggatggaatggaagaatttactgcagcgaaatcatcttcaaattccttttaggttggaagcttcttaccctggcaagtgaagaagtacatttggttatatgtttataatccatgtgctactgggtgaaagatgataggacaagaacatttgaaatgtatgtgttagggatctctgcccagcagtttccatcaaaagagcacacccatgattatcgtacaaatggatgggacagcaggattctactcacgtaaaatgtttgtccctgagcacctagggagggtgtcacctccagggtctccttcctgttgctcttctgcatgagtcctgcaccacctcttttaacctcagggaaaacttcactattttgttttttaaagtcagtcatatttaaagttgctgcttttgagtatgcactacgtgttgatgtagattctggaatgtagaacaaacaggcgcagactagtatgggtaaggtggggaacccctacttcagaaggtgaaccccagaaggaagctgcctgggccaggggtgtgtgcatgatggcagggagctgcagccactaagccttggaagagtctttaatggcacagggaaatgccctgtataaagctcagtgggggaaaaaaaggatttagaaagaaagtatatgctagaggcaaagaaaaagactagaagaaaataaccagccaggtgcagtggtgtgcacctgtgatcctagctactcgggaggctgaggtgggatgattgcttgagcccaggtgtttgaggctgcagtgagctatgatctgtgtcactgcattccagcctgggtgacagagtgagaccccatctgtaaagcaaaaaaagaaaagaaaatagccaaaatattattggttatttctctttttcccaaagtttgggcaagagcatatactattcttacaatcagaagaagtcctcttttccattacgtcttaaatagctctaagatttagaattcgtcttgatgaaggcatggtcatcgcacacacagagctgggccccgtgggtgaggggctcccgggggcctctgagtggggagctgtgggtgtcaagtggccatgaagagagttgacccagggtcgggtggcaagattctctgagccccagagaagtcgactttctgtatctactagaatccaggaagagtgtgtccatggccgtcattaccccctgcttccccgtttcatgccaggtttttctcagatgccttctctgggggaggcactgttgctggggcaactttctggctgcagagggcacccagtaataaaggcaaatgccaagtatgaggcaagaagggacgcccctggctgggatggcaggcattgggagaggcttatgggagcccctcacccctctctttttggggtgctctcgaggaagctggactctccacctctaaagacccctccagggaacatagaacccaaacccaaatggagatgagctggccagcgaagtccaagaccccagtcccctccattgcaacctggggtgcgggcttctgtcttccaggttgaaagctcatcatttggttcatcataagttatacgtcggagtggaattataaaggagagagaaacagatgtgaactctcaacagctgggagaggtggaaagcctctggagttccattatagaaatgtgccttttggccaggagtggtggctcacgcctgtaagcccagcactttgggaggctgaggcaggtggatcacttgaggtcaggagttcgagaccagcctggccaacatggccaaaccctgtctctattaaaaataaaagttagccaggcatggtggtatgtgcctgtagtcccagctactcgggaggctgaggcaggagaatcacttgaacccgggaggtggagcttgcagtgagccgagattgcaccactgccctccagcctgggtgacagagtgagactctgtctcaaaataataataataaataataataataataataataggtcttgttttttaaaataaaaaacagaaatatgcatttttagataccagcaggacatcatagcactgagggaagctgaaccctctctttgggacgtagcttgctttcttttgttgccctggcctgagttctttcacatcagccagcatggagaagaggagccagttttgcagaatgactgggaacagcccctgctggggagggactctgtgatgcggtgtcctcatccgagcctcctgggcccgggttcccgtcgctgtgtgcccggagcctgggcgccgacaccgagcctcctctgtgctttcaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaaggtgtgagtaaccagggctacaggggagcgctctgggacaagggtgacagtaaacattttaacaagtatcagagtgacactggccacagccctgaaacaagacagggaagactctgctgtgacaggtgccagggccagtgtggaggagtcactcggggagtctgagaagtggctcttgaccggcgagagcagaagtgtttttgcctcgttccagaacagctgttccagtgacagccaggtggccactgctagcacgaccctctctgccttggagtttgcccatccctggctgaagggggtacacaggtgggtgacgggggtctaaggcagctcacctggcctgttacttggactctgcaggggcctcggcccacctgcgcttagaaacacccagctgtggaactctgtgcattcatcgcggggtatgtgctcacccaggccccgctgcagcaggaagcagtggtcggggtgtcccccaccagcgcacagcccagcccactttgaacttctccaggggaacctcacaaggggctaagcagggcaaagatgcttctctgccgatgggccaaggggaggctggcaggctcctgcgaggccacccgccagccactctgtggtctttggttccggatccttgtgtgtcaggaaggctgaggaagggggaggaggtggctgcagatgagccagttcttacaaacagggtggcaaggcagatttctgggtgaggacagcttcttggagcaggcagacagagctgtggtcagcgtccaggaggccctgggtggccgaacaggtcccagcccaacgtacaatgtgtggtcagtgactgctgtagggagtggggaccgggggagttccagcaggaagtccaggcttctctgactcctcctgtgggggatgggagaatgggagggggtggcaggagtcaagcccattaaatttatatcgtttaaaatatttttacagttctcatcgtattataacccatgcatagtgattgcagtgtggctcataaacagctagtaagtcagtcggatagtaggaagagattatactgcaaacagcctctctctgtctctgtctgcccacccccgagtcctgccccacggaggaggaatctgttttcaaaccgtgttcatgatttcctttctctaagtaatatcatttgatggctttcctgggtgcgttgagtttggtcaccatctgttaatttcctcttatcagaatgagcgtttttctctcaggagacccctagccctgctgccctgccgaaaccctggagtttcctccacttcttacctttcccgggcgtcaggcctacactgcatcctctgcctcctgccagctgcacctgcctgcacctcctccgaaggacttggtgtcactctgcaagtgtgaggcggaagcttcctcctctactgcccccaccccccaaccactcaggtcttgaatgcctgagaaaccaatgaccaaatacagggtatctacccgcctgtccctccgagtttagtactcacccagacactaaatgtgagaaggaaaattaaggaagaggggcggtgtagacacacacacgcacgcacacagcatggggtcttgcgggcatccttgggacactggacagcttcctttatctccattcccccaagaaaacaccgaggcagcttcaatgaggctgctgagcacctaagccaggcccaaggctgggctgagtgagtgctggcacactcgggtatgaccaagtcagctgctgcccaccaagaactgccgaatacataaatcacccttccattacttagctcccagctccaacccactagatcgcttggatctcagtcttgatgacaagcgagacatcctaaaaattaagctgaatttaagcttcggagagggtgggtaagctggagggcgggtttcctgcatagaacatattgctttggatggtgttcctgctgagcgtctgtcatttctacgggatgatttccaaagatggagctcctaggatgaggcaccctccgtccaggaggggtcctggttgtttggcagtgatcgttcgggctctctggttcactgagcctatgggaggcttggggaggttggagctgcagagagggatctttgcattcggaattctgagcagtgttggtttcatccagctgtcaggggagtggggaagttgcagaggggaccacgtggtttcccctcattcttgtcacagttttgtgaaatactgaggtcatttgattttttttcgtcatttggaagtaaaatatgtcatacagagaaccttaaatcgcaactgtctcgatctgtcactgaaaatcctcctagaaatttgatgatctcaaaccaaaccacattcccccatctgcttttcctccttgtggccctatttgtcgcctacagtcttctgtaaaatctgactttatctttggtagatgatgtggcccggcggtgagagactgtagaagctgtaacttggcacaaagatctgtttaacgttggtccttaggaagcctggctcctctcacacctagctattcagaagggaccattagacattgctgtggctaaagacactggccgcgtccaggtggccggtgtttgctggccctcagtcgcggtgcttctgagctcatgaaatgaactctccctccccagggaagacatcgaaatacgatttgattgggttgaagttgtgagtttactgaaaagaagtgcaagttcatggctagggttgaaatgtcccctacagcttctgtcccatggcttccatgaagccactggaagatctgggaagtgaaaataaagtcgtcagagacagttaaaacatctctacactcctcagacctggctgtttcctcgcctcatttccacgtctccttcccagaaaccgttttaaggaggggaaaggttgttggtaccttgatgcctatgaggatgggttggtctcatagtaaatgcatgctgcatgctgtaaatgcaaaccttgagcatttcagcctcttggtattcaaagtggggtccagagccagcagcactggcgtcccctgggagctcattagggatgcacactctcaggcccaccctggactttggggcacaagtctgcattgtaacaggttcccaggtgactccagggtgtgcacattcaagtttggggagcgctgtttttggccattctctgctcctggagcagtaaggttgcatgctccaccttgcaaaaggacaacattttataagtcatttcaagtggggtggggagttaggagtggcagtgtctaggactaattctcacctggaataaggacaggctctgatgggttaaataccttttgatttgcattgtagttgctttaaaccggcttcagctgaatctcttcctgcaggtaatcacgtgcacacacacaccaccttcctgagctctttgtgcctttctctcagaaggttagcttttctgggagggacctttctgttgagctcttggccaccccgacaggttcaccttgcagatgcagaaagcagagtggacgcggcagccttaagcagcggggctgcgtgagctccaagaactttcctgtgggctttcttgggagcctcaagttggagctggagtctccttggtttacaaacccccgtggtgtgagcgtacagagcaggcgggtccactcattgtgctccaaaagtgagtgtgacatgtttggtcagcagcaggcttcaatttggctctacggggattgcagaattggtgtgtaagttatctttaaattggccgattgttgagcataagtataaatttcctctgtttgtttgggaaggacggtccttagtaaggatgtgatggccagccagtggctccagtttcccgtggaggtggatgctggcccttctctcgggccagctgtgcaccaccagcccatccagccatctggactatatccgtcagttcagtcttccactcgctaatctttagctggtacttgtggctggaatgattctcagtgtggtcagaaatcatccatcctgtgggtatgggatagagcggagctgcaggaatctgccctgactggctgctgtctttcaaagacttgctttcatgtgtacgttcttaacaatgaacaccggtgcacagctgggcatggcggcacacttctataggcacagctactctgaaggctaaggcaggaggatcacctgagcccgggagttccagaccagcctgggtaacgtagcaagacccctgtctcaaaaaaaaaaaaaacaaaaaacaaaaaaaaggaaagaaaacctacacacaaatgaggccctggccttggctagtgatgtaaatcagaccaccctgatacttacccactgcagagaccacagggagctctgacaggacacccacaagctgctaccagcttcctggacgtaaccctttccacctattctgtcttcacgcagagttcatggtcctatccctctttgcaaatttagctcgctctgcaagaagggtacctcttcaagtatgttttccagaaaaatcattcttttccccaccagaccagctctttcaacccagaaaaattaaagttgtaaattcctccatcatctgtaatctcagtgtcatttgcagcactgctagctctctttgatcctaggccattgcgatggaaatgacaggcatggctctggaatagagcagcttgtgttgggacccttgattttcctgtgaagaacagaggagtctttctggcccctttccctcgtatgatcctgtgattctgcaattttaaggctgcttccacaggcaaaggcacaccattaaaatccaaacagagcccccaaaaccatgctctcagcagcatccagatggtctgaatgcaaccttcttatccctttgaaggaacatttgggagatgggactctaggttcggggggagacccaccctacgaggttctgctgcggggctaagccttgttcctcttgtccctccagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtaagttctcttggcaagttggagtgcttacagtgagtgcctcagccctctgggaatgagtttcttctccctttctcagaaagatggcttagattgaggccagattgttccggatcccagggtcccagcctcacccatcggcgaacaatttgagcctgaaggtaaaccccagtcccttggcagccttccttggacactggctttctaatctttgcacagaaatagcagttaaacccctctctggctttagagatctaaaaatattatttaagaacgaggttccttctcatgatgtcttgttttaactctgaaattctgtggtcacatgtcttggaatccaatgaacccatccagttccagcgtgtacaacagagtaagagaaagacttggttttatactgagacattctagaaatccaggagttcttctaggcattctgttgctacagaagcactttttctggacactttaagtcgagcagtggtttctgtctgttccgcttacttaagtgaacataagcatgatttgtcttttaaaaggtaactgttttagtactcaggtagaatttgtgctttttccttccctacatactttcctacttaaaaaaaaaaaaaaaaaaaaaagaggaagggagggtttccagttcaaattaatgcagaattgaagtgcaaagtcattacgttgacttgtagacattttaaaaatgagactgtggagctggccagacatggttaaattttaaagctcactagcatcttttcatttctgcggctgctcagccacatctttcgaagttatttgcaaatttatttttacacttttctgtgggagcatacaggcttcctgttctcggctttgctccgcaccagtgaaaggtcagctgccatcgttctgtcgccagcctggtagcagctcggcctggttaactaaggtattaatttgttattttccttttctgctggagtacgcacccctgggacgggcagctgagatgctgaatggtgtcctgtttatgtagaaatccagctcatttgagcacggacctgctagggtcttattagacagacagttggccaaaacccaacatagtcttgctggccgaatggatgcaggttcgaatttgctaagttatgggacagtttataacatggactgcgtgcaggcaggatggtgtctctcaaccctggaagtaggacttgcagctttatttgcattacgaatcacgtcagcgtgtgatctgtatgccatgcatgtgtgtgtgccttggctataaaatgctttttctttcttattttaaaattctcttccctgagcaataatatgtgggtaagaagggtatagtttggagaacggtaaaagagaaaatatactttgtcttggtcactgcccgggaagtctgctctgacagtaggaggggtgttattttcagctctactagagcccagcttttgttctgagtcctcttagacgtcctccagggagacgagtgctgctcaggatagtcgacatatcacagtcccagcattcaggcaggcctgtgatggcgatcacaaccctgtccgcctgcattctctgtccctctgagtctgaggaatgtgagcaggtgtgtccacctggagcgagggatgtcctgtggtgacacatgactctttatagaggagtaaaacctaaagaaagcatctctcaccagaacaagagggtatgttcgttcactgaacacgagctgtgtcccaggcgtggcactaggactcaggaggggctgtccaccttgattcagccatccctcccagggtaggcccctctgctcgctccccaggacccccttctctgaagctggagaaccagctgtgagcctcacatgctcttgggagcgtggcctcctgcccagccacccctagtttctcctcctggccaccatttaccaagcccaagtacattcaggtgcctggctgtgatctgccgagaacccctgaaatctatatcatggtgtccatttgcatatgaagatgctggagtcagagagggagcatttttgtcccttttcccatgccctcagctgccctccccatgttgaggtaccccagccccactgaaacgaacaaggaggaaactggtctctgttggccttcccgtcacatcttcctgtgtgtgacacagaccagacccccaccttccctagacagttggcccagctcaaacgtgtgcaaggaaggtgctgagttcggaagaggatctggattgctctcactgtgaaattgattctcaaaggttaggcaaatcggctactggagtcctgtggtgggtgggtgggtgtgactttactattcctgccataacaaattatcacaaacttagcagcttaaaacagcacaaattgatatctcatggtcctgtaggccagaagtccaggagcctcagccgagtctctgctttgagtctcacaaggccaagaccaaggtgctggcagggccgtggttccttccggaggctcccgggagaatctgtttccttgcccactcgggctgttggcaaaactcaggtccctgtggttctgggactgagtttcccatttccttgtgggctgtcagctggggcccgttctcagcctctggaggccacccacattcattggcttactcctcagctccctcttcaatgccagcagcggtgggtccagtccttctaatgcttcctctctcaaacagccttgctgccttcctcttccaaggtggagggccctgtggtggcagcaggtctactcagataatccaggataatcttcctgctttaaggtcggctggctaccgaccttaactccatctgcaaagctcattggaataacaccaggggacaaagatgatgggggcgacaatcccacctagcacacctgaacccacacaggctgaacccccagcacccacttcccgtttgagtccaacgggagatacacgtcagcctgagtggtagtgaggtccagaatccatcccacacccagcctgggccagtgcctccgaggagggcaggcagagccccagctagcggtacctgccttgttgccctgtgcagtaggccttgggcggtcaagaacatgccaggttgatctgcttcttcaggaggacgtcctggtggagaacccagcttatgacctactggctaaaggcagaaactctctctgagccacctgggtacctctagctgctctgaagtcagggggtgacttaggggtagctagtgtggactctgatggttttgccgtgggtactcttggctgttggtgataggccacaaagtccagcagacccagggatgagggcttgtggggtgcgtcttggtttcatgttgttttaccattttttccacatgcgcttctgcagtagagagggaaccagctgatctattattatcaaagcgtacggtctgtgctcccagctggccttcttgcccctgcctgtcttcctacaaagtgatttagcagggagcaccagatgttgtggaaacctgtggttgccgagatgcatttgcctaacaccttatttgttcccgagacccagggtcacgcttgccagttagtggcacctgaagtagcccagccttctccagagagtgagttagcctgtctgccatcactgcctcactgtgcttctctctcccccaggtcaccacggatctgcgtcagcgctgtaccgatggccacactgggacctcagtctctgcccccatggtggcgggcatcatcgccttggctctagaagcaaagtaagttcccacttacctttttctaaaaaaaaaaatgtttagattgtggtaaaatacacatgacattggccattttcaccctattgaagtggacagctcagcggcattaagcacattcagtgagtcgtgcacctgcaccaccatccctctcccagagcttcgtcttcttcccaggctggaaccctctgcccgttaaacagcagctgcccaggttagtcagctcaggctgccgtaacagagtcccacggactgggcagctcaaacaacagaaatttagtttctcaaagttctggagcctggaattcctggatcaaggtgtcagcagggttggtgtcttcttggcttgcagaaagctgacttctccccttctgctgtgtcctctttttataaggacactggtcatattggattagagcccaccctaataatctcattttatgttaattacctttttaaaggccttatctccaaatataatcatattctgaggtactggggcctaagacttcgatgaatacattttggaggggacatagttcagcctataacactccccattgaccccccgccctagcctctggcaaccaccattctactttctgtctctatgaatttcattgctttaggtgcctcatgtaagtggaatcacacaggatttgtccttttgtgcctggcttatttcacttcacataacgtctttaaggttcacccgtttgtagaacgtatcaaaatttccttcctttttttaggccatcctgatgggcgtgaagtggtttcttcctttcttaaagcccaagtctcctgccctttgtaggacacgggggctggctgggccagagtccaaggcctgcctctgattctgcacctcacagcaaatccacactttaggttgcgctggcttccttttaggaactttcatttataaattaacagtcaagaaaaactcttgagttgcgtatgtgttgttggttcagaaagaaaagcaagttaaccgcacatggagtcatagagtcaaaaccaaattgtactttagtcaccaaaactggcagagaacaaaccagccctctgcagtagtcatctgttgtagatgagttttcaaataactcaaaaagaatggttgggatgcctcaatgcttgtaattacgtgtgtttgcatgtggatttgcacaagacaaactgagcgtaacactcaaatgctaccaatgtaacaaaggaacagtttgatatttttgatttccaggccaaaatgttagcttctgtgtcctgaggctctttttaaaaattcttcataatgagttgcttgtgtggaaactcacattcgcatactttacccttccttgcgctgtattttcctccattccttattggaaacatgcaaagagctaaatggaaaacaaaccctgctccggggcgcattgtccccttaaacttggtcagtgggcacgtgaaagctcagacggtcatcttcctcatcatgttagctcctcctcagacacatacaggggacggatcaggcaaacatcatttggaacaatgtcagtctagagcgctcgacacttacaggattggtcaaggaaggaacggttgatgtctgggaatttgaaaacctgtgttgagcagacctgtagcctgggatagctctcgcctgtgcaggttggccccaggccgccttctctctctgttcactactgctgtggaaggaactggggcaaagccagatggttctgggtggagatgctccctgagagtctggggagggcccccagacagcgtggggccagaatgaaggaaaacccatacgtgttggaattctctaaagggagtcccatggttttgggacagtcttggtacttttcaaacatccgttcttcatcaaaaaacattttcaacatcctctcttagacatattttccatgcggttatatttgtgattttattgctagagtcaaaaataaaatagattttttcataagaaaatggttcctaactttctcactccctggacccattctgtcctccactccaaaggtcatcccggcacctaaattcaagatttccaggaggactggctgtagccgtcttcgagtacgccctgctgacacacagcagtaacttgccaggttgcacgggcagcatggggtgtggccatgtcagcacttgtctaaactccaaagcctgcacctgtgacctctctaccagggtgcacggccatgggctactcgaggcctcagaatctcccctaacagtgaggttggcgtgtgggccgcaggaaggccagtggatgcaggaggagaacaggtgtgcctggcagggaaagtcctggagactgagccactggacacagacggggagagacggtgaggaagccagtgaccagccaggagcagcaagaacacattggagaagtcaggggaggccagggctggagcctggagagtgtgagcccagggaaggagtatacccaagacttaacgccatgggtgagcttctcgtaggaaaacaggcaaagagggggccgagggtgggagtgtgcagagcagccgccatacaaaacagtgtagcgcgtccttgaaaaaattaaacagactccccagacgatcagcaatcccacttgtgggtgatatccaggattgaaagcagggactcgggtagataccggcccagccatgttcatggcagcatggttcacaacagctgaacggcgggagcaacccgagtgtccatgatggacgaagagatcagcgaagtgtgctctgtacacacgtggaacattcagccttgaaaggaaggagattcggatacagattatgatgaggtccctcaaggacgttgtgctaagggaaataagacaaatcctgtgtggttccacttacacgaagacctggagccatcaaactcatagagacagaaagtagcgtggtgcctgccaggggctgcagaaggagcgatggggactgagtgtcccgtgggacagagtttcagtctggaggtggtgaaaagttctggaggtgggtgtggtggtaccagagcaatgtgaacgtccttaatgctactgagctgtacctttacaaatggttgaaatgggaaagtttgtgttctgtacgtcttcgcacacccacacacagagtgggccactggagagacgcctgtgacatcccagcaggtgccactggggaggccggggcagctgggtacttcagctctctctcttctgcgtctccaggccccctcagctgcagcagctcccccgattttacttagtccgtgttcctagggtcacattccctgaggcagcacctgtggcgcggcgtgcgttcctagtaaacacgcaccgagagcacggtgtgcgttcctagtaaacgtgcaccgagacaaggctggggcttgtgcttctggtcacctgcatcccaacgagccctgggaagatggtctggaaggaaagagtatgtgtttgtgatattagggagtgagagtcttggactcgagagatgttcgtttattcttggttaattttctgattgaatagaaagtcctaggtaggcatcaatttaaccgactaaaaaaggaataaaagatctataaatatttatctgtcaaatggcggccggaaccatgagcccatacatctttcttttcactcagctgtttgatagggcaaaaatatattcctttcattactgattcacatgtaggtgttatctttaccatgttttaaagcagccttgcagaaagcttgtatgttcaaatatccaggttgcatagcatttaatactgattagaagaaaggaacaatgctcttattttatactattctctgtgtacagatagtatgaaaaatactatatttcatcgaatccaagatgccataaagttgtaagatgcacctttttatgtaccacagaaaccagaagtgctgccattatacaatgcatccatatctcttagaatttttgtaactattgaagagttcttttaggctgagagttatttagacctggaaatgacgctgtgaatagacaggaccaagttcagcacctccaggcaatgtaacccgttcctggttgctgtgggcagaggggcttataagaggtatcagatcataagatggatctggatttcagaggtgttaaaaaaaagaaaaaggtgggccaggtgtggtggctcacacctgtaatcctaacactttgggaagccaatgcaggaggattgcttgaacccaggaattcaagaccagcctgggcaatatagcaagacctcgtctctacaaaaaatgtaaaaattagccgggtgtggtggtgcacacctgtagtcttagccacttgggaggctgaggtaggaagactgcttgagcccaggaggtcggggttgcagtgagccaagatcacaccaccgcactccagcctgggcaacagggcgagaccctgtcttacacacaaaaagcaggggtgagcaaatgtgtcttagaaattttaaaaaatcatctgtgtatttagttacattagtggcatgttgtattcttttgatgaaatgtttctacttccccaaaaagaatattttgcaaatttagaatcatatataaaatcttgaattataatctacagccagtgggtccacacaggatggaatctcggccaatcgtggtttgaatgtactcttatgcactgttgtatttgcttaggatgaagaataaccccaagtatttaataaacatttactattatgttaagtgtcttgtattttcagaatttcccatatggctctgggcaaactcaggcagagcttggcagcaaggctaggctttaatgcttatgaattttgggtcacccattgaacctttttttccctcaggatttagttgccggaaacttgtttacaaagaggtggtgaaataaacccttgccaaggaatgcagtccttagcctgaggggcttgctgaagttcagacgtgggttggctgccgaccccctgcctctgagtggcctgtgtggctgccgttgttgagctgtgtggactctagggtgtgttgtgtcattgcagcagccagttaacctggagggacgtccagcacctgctagtgaagacatcccggccggcccacctgaaagcgagcgactggaaagtgaacggcgcgggtcataaaggtgcggcagtggcgttctggtggaccattgggtggccctggaatgtgtaggaaggggtgtcatgaattccttaaaaggactctccaaatagcattagttgttattattaattgtgtgtcacaagaatttaaaacgcatgtgcagctatttaagaaaagtatcccggaagctcacagtgacattacggaagaaccctcaggtcacaagagtctggggtctcctatactctataactttggccacaccgagacaccacctataccaatatttactcatagttctctttaagccaggagcaatgacgtgtgcctatagtcgcagctactagggaagttgaggcaggaggattgcttgagcccaggaatttgagtctagcctggacaacacagcaggactccatctcttaaaaaaaaaattacttcccccactacttttttttgacataaaaaatatattttaaaaggaaactgtactacatctagttaatcataggtttgatatgtagttacgtattttttctaatgtgcattaaaacaaatccataattattaaaataaatgttgtttgtgtgccacctgagggcagcttgcatccttagccctgagtagctctgtgattttgaaacttgccttcagtttcctcatctgtacaatgaggacattgagatagttttgtaagttactttctaactgtaaaacttcttttggccagtccctgtgttataaaagtaaatcataggacagtggggcctctaccctcagcccagcctggtacagacctaggtaccatgaaatcaacccagggtcagggcttcgttaggctggctgtctgcggcctttgaagcaggtaattttaggacagtgctactggctttgtttgcctgacttcttttttttttttttttttttttttgagacagagtctcgtcttgttgcccaagctggagtgcaatggcacgatctcggctcactgcaacctttgcctcctgcgttcaaacgattttccttcaaataatccctcccgagtagctgggattacaggtgcctgctaccacgcccagctaatttttgtatttttagtggagacggggtttcaccgtgttgcccaggctggtctcgaactcctgaccttgtgatccacctgccttggcctcccaaagtgctgggattacaggtgtgagccactgtgcccgacctgtttgcctgacttcttatcaggtatactgaaaaatatttcatttggccgtagtatttatgttagggaggaatttttttttaaccttttctgaagctcaggtctaactaatttgacactaagtctgatactactatctgtaaaatataggtcaagcatagttaccctaagtgccgagggacattccttttaataaggaggccatcgattgggctagttcatctttgttttgcaggaatgtcggtggtagtggtgtactgtaacaagagctgacccacattttaattctggcctaattaaataggagaatagattgtatgcagttcttgaccttgcctcttaaattaaactttgaaagtctcctgccctggccaaattaaatactggaccgggccagttcgcaagcctgtctctgtgctgtgctgttttcccggaatgctctgggaactcagcagggaaagaaaatggcaaaaaagatgagtacagccttgtgttattgcatttcgggcacgtggtaattgtgtgaactgagaggtctcagattttgtttctcttgtctggtcttagattcagggagcatagatgctgacaagcccttttaatgtaaaggaacctgtctttgtctcaaaaaaagaaactcctagaccttctcagcacttctactctgtaccaaagcgggacgtgtttcctgacccacactcctaaatttagcagaaggagttgggttcagagagagagaggcagctgggacctttgagcagccctcagggggacccgtcctgcagcctggggcccccaggagacctcgagtcttacggtccctctgtcctccatggggcccggcagatgcaagagccagccttgctcccttcctgggagaggcaggagagcctggctctgaagggcctgtcttttcagttagccatttctatggatttggtttggtggacgcagaagctctcgttgtggaggcaaagaagtggacagcagtgccatcgcagcacatgtgtgtggccgcctcggacaagagacccaggtaaggctctgctgtggcatcggtgacttctcaggcacgtgggtttggagctgactctgttgtaaggtgtggctgggggaggtgttcacacatgcattctgtgcacatgtgcgtgtgcacgatgcatgcctgcacacgtctgcgttttctcttgtggattgtacagctgggaaaggaatcacttcttaagccaccactgttttgaggcctcttccccttttgtagcagattgctccatgataggggatcagttcctcagcctgaaccactcagcctagtattggaaattcttacccgtgtttagcatgtcagcccaagtcaggaatctgctcctcccagaaagtgaaatggggagtagctgcaggtgtcctttctgtcaccaccggctagagattggagctgtagccccagcccagcctaactggccctgggagtctgcagtgtgaatccaccaggcctgagcaggagcagctgggtcagcctcttctctgttgcaggttgtggggtactgcttattattcacagagcatagcagctttgtgtggcttttatctggctccgtacaaccttcttaaggcttaagcgctgggatttttttaacaaggctcgagcagaagggccctggcttcatctctctcccgtgagcagggcacacccggaactgctctttggagtaagtgtttctaaatctgttatatttgttcattgattgattgattgattgattgagaccgagttttgctcttgttgcccaggctggagtgcagtggcatgatcccggctcactgcaacctctgcctcctgagttcaagccatcttcctgcctcagcctcccgagtagctgggattataggcacccaccaccatgcccagctaggttttttgtatttttagtagagacggggtttcaccatgttggccaggctggtctcaaactcttgacctcaggtgatccacccgccttggcctcccaaagtgcttggattacagatgtgagctaccgtgcctggccaaaatttttatttaaaaaaaaaaaagcagccataaagtaaatcagaaagcaagaaccctagcccactaggagaggaaatcagattattccaattctgccatcgcagctgtttttaaggagaacggtgtttctctgggccttgtatctgatacagaacggagtgtgtttttcccataactacttgttccctttggaaaacgtgtttgaaaaagaaacagtgtgatgactgaaagtgatatatttctttatcaacaaatacaggtcactctctttagatgctcttccttgaatatgcctctactcttgtaatacactcttgccacaaatagttgagaaaaatgtgtctggtggagggctcgcatatggtaggagtgcagagagtgtgtgttggctgagcagctggatgaatagccacagaaggatcttttgaaaaatcacctttttctcccgtggctaattgcacactgaccgctgagtggtcactgcaggccccgacaggtcggccagacacctgacaagcctcagtcttgacttcttaaggcgtcggtttctctgaggagccttagactgtcaaatttgaaacaacgtgggagagtctctgagataaaggaggttttgccttctctgtctttgctggaaaacgcctgcagcctggaccctcagaggctaggtgagggaggtgggctcctgggtctggttcctgacctgggggctgccctctgccccggcgcctccgctcgtgtccccgtcagggcggctcctgaatgaagcattcttctcctgccagaaatcgttttaagatggcagagtggtgcctaggtggcgagtggttgtttttatttttattttattttgttttttaagtgaaagcacacggagtctagacagcacaggttgagggagcccgccgtcacatacagtgtaacattgttcctgtcctttgaggaaagtaaggaccctccaaactccaagaggagaagaatcagacttctgtttctaaagaaaagtcatctttacctttagcagtttcagactctttctgggatattcagccagcctaccgtctcacaccacttgcttatcagatcacttgcttaactctgtaacgtggttgttgcagaggacatacgggcctccagagagaggggtgttaccaagcagagttccatgcctcacgtccacctgtgggtctcccctcctggcagggagctccagccagctctgccactgagcctgcctgcaggtcggggtcatctgcacctgagccgcgagtatccccacagctatgcgagttttccccatcggggttcccagctgctaggatcacgtggccgaaaatgaaaaggaagcgttcccacacagccattttcccgtcttcttctaactgccccctctccgtgcacgtttgtgggtccagctgtctactctcttggcctcattctgatttcttcctctcatggtggaatcctaggacttcctgaatgtcctgaacctgccctaagctgcttcccatggtgaagagcagagcaagagggaagacagagtgtgtgtatgcctctttatacacccctctcgtgtgcatccgtgtgcactgcgtgggatatggtgactgtcttttctcttgaacaggagaggatgctaccctggtgtgaccaaaggtcagacagctgtgttcactggatgttaagcacgggagtcctctagctggggcatgtgtccacacctgtcaggtctatggtgacgtcacacatggtcctgagggagaggggctggggtgttcatacatccacccctctggtcacgggcaggggcaggaaacctctgtctacccccagccgtgggctggaatatggccatggttcagggagactgtcctcatggcggtgactgacaggaagagtcaaatgggctaccccttctgcatgtccctcctgtgcacccagcctgtgctcccaaactagcattgcatccagggccccgaatgactgcacagagctggtgccccgtcacccatggtgtccccctgcggagctgctgtctccaacgctgccccagtggctggcatcacagccccgcctgcccgagtcatgctcgggcccaaaggcgcggaaaggccaccagcacagcacaatgcgggctgcagaggaaggagctggggcggtgatgccagacccaccagacgcagtccccttcaggaggcagctccgtcatttgaaaaaaggccatccatggtgtgaaaaggactagccaagaggggaccccaagtgatacgttggcatttctcacctggacactgcacatctggggactggggggtttgagcctgtctgtgtatggatccacccgaaagataagaagaagtccctggaagggtagagaacatcagggaagaggggacctcaggtagggctgggcctgggtgagaatcaaggagccaggccccctgctccaaggcaccacgggatcgtgctgggcagtctctttactgcctggtgtttaccctgccctagagcagtctgagccccagaactgaggtattgatgtctgagccacctctccaggagcccacacggggtagggcccatcataggctttcaggaaatgctaaagctaaatgcagaggcgagaggaaatcacttaaactgaatggcagctgctgttagcaaaagagagtgacttgctagagtcctccaggatagcactggatgaaagtgccagctgtgcctgggcctctgttgtgatcgtcagaccgtagaccagaggcacgtcgacctactcctgggcacaaatggtttccatctgtttagaacctttgtcaattaaacgaaggtacataggatcatgaccaggggcatctgcctgtgcaaaatgattttaaaatctgtgtgtattaaatagaaagataaagttgatatttttatatcttttcttcaaatgaaaaagaaaattaagcttagtattattccaacgaatgaaatagaggcccagctattaaatattctatttgactcttgatttttctagccagtgcttctgtcgctgctttgaaaatccaggcttctgggaaacagtgtatgatatgcatgactcccacctcagtgctggggacactcacaacaacagggtcttttaaaccaacacaaagcgataacttacctgcacgtctttagtttctgctggtttggaaggttactgtccagacagagcttacagtttaccttggcctgtcttttaatgaactcttcacacacccacaacccacacaagacacttcagacccaaaagccaatgtgttgctttgactatcaaggcttatctgtagagcagataatctttttatagatgttcaggaattaactctggattagccgcatatcacctgcttttctggaatttcgtgaaactagactgcgtatggcggtcattttaaaacaactctatttatgaagacatatggctgtggatgagagataatggattgtgattataaaggcacttactgtgtgccaggcattgctctaagcactttatataaaaatccccaataaacatgtgaggttggagttctatctttatcctcattttatggaggaagaaatggaggcagaaaggagttaggaacttaggcccagaggtggggtgctgtggggctgagctgctcccgcaggctgcttgtctccagagtccaccttgcccccctaggtaggagctcaggcggtactgagccaatgagagcgacctgcccacccgttagaagacctcacctctgtgacctctgtgccaggagctagctgggcgcaccacctccagggatgataaagtacctgaccctggctgcccagagcttcctccggccttggccagacgccagctgctggcgtctcatctgcggcaggtcagctgggcaagctggtgaggccaggagcccagcggcctggtggagtgccgtgcggatcagacacaggtcaacccagctctactgtgctcaagcacacagcctgatgtgacgtctttttaggaagccaagagccctcgttttctttgggctgtctcagaactatgcaggtgtctgccaccctcccatcccctcctcaccttacccagcctctccctccagggcatctgacctctgtgtatacctgggtaccacaggaggcccttacttctggtttctcctcttgggctgttgttatacagagcatgcctgggtgtcctcagaagatctgtggggtgctgtgcagtcccgccctgggggtaaccacagtggacccacaacacttttcctgcctgctgctaccccttgtagctgcgagcaaacttaaccagctggttatgttcttgcaaccctttcccttcctggcttagttttgaagcaaacttcttttccccaaattgtaaaggctacttatttctaaaattaggatttggaatttgaatacagttgattctccctatttgtggtactgttccacaaagtcaccacgaacactgaagcgttattcctaggagagatacagggttaagttcctgtgagcctccggtcacatttttgccagcctgtccatatagaccgagctttatgtgtatgggtttaaagacagcttatttaacatagatcattggttcattcactttagactcacagcggacagcactagtgctcgttgctggaaccaagcttgtcttacccgtgtgttttctccttaaggcaggtctctgctttctcatgctgtttgacactagacagtgtttcagcactgcacttggggccatttcaaacagtgaattcaccaacagaaaagcacagagccaggcatggtggtttgcacctacagtcctagctactcgggaggctgaggtgggaggatcgcttgagcccaggaggtcaaggctccagtgagctaggattgcaccactgcacctcagcctgggtgacagagtgagaccctgtctctaaaaaacaaaaaacagcacaaaaatgtgaaaaatgtggcactaaatacactgtgaaacagacacttgtttttatttgagatggagtctcactctgttacccaggctggagtgcagtggcgcgatctcggctcactgcaacctccacctcccaggttcaagcagtggtcttgcctcagcctcctgagtagttgggatgataggcacatgccatcacacctggctaattttgtatttttagtagagacgggctttcaccatgttggccaggctggtctcgaactcctgacctcaagtgattcacccacctcagcctctcaaagtgctgggattgcagccgtgagccaccacacctggccagaaatggacacttatttatggcatgagagctgcaccaacaggcggtgttgccttgtttgacctcagctgggagtgtgctcgttgggggactcattatgttaccactctgcacacatctacacatgacaccaaagtgccgcaggtgttagtttgggggatacaaataaatgtcagccactaggtgaatatgcagatacagcatatgtgaataatgaggattgactgtatattttattttctcttttactccccttcaggttgaattgtagactgttagaattggaaggcatctttaaagccagctaattcagtcccctcatttaacgtagaggaaaaagtgtgctataaatttaagcatgacatattaaagcaccttctgacccaattaactgtggacggcattgtgtaagttaatgtactggattagctttttttttgaggttaaattttatttctcacctaagtgatgtgctatggtttgatcatcaaaagtaattttggccgggcgccgtggctcacgcctgtaatctcaacagtttgggaggccgaggcgggcggatcacctgaggtcaggagtttgagaccagcgtggccaacatggggaaaccccatctctactaaaaatacaaacattggccgggcgtggtggcgcatgcctgtagtcccagctactcaggagtctgaggcgggagaattgcttgaacccgggaggcagaggttaccgtaagctgagatagcaccactgcactccagcctgcggacagagtgagactccatctcaaaaaaaaaaaaaaagtaatttcatgtgaggaaaattctcagtctgaactcatatgaataaggaagcccacagatgaatgaagcagcttacctcagagcctaacgacagtcttgttgagagcgtgcatcctggaacacaggtctgagaagtgacctagaagcctcttgccaccttcacacgggcactgtgtgccctccgacctgctgttttcctattgcttaatttagcaagtctgtcccaattaactcttgccattccattcactcccgttagcgggtctgtgaaagggtttcctggatgaccttctgctgtaatgggcctcagttctttagcctctcctccccaagccaggtgccagcacagcagctggcaggatgctgctggctcctgattctggagggtctctcaacatggccctagaacattcatgggcccagtgaggaacaaagcaagtgcgttgtgcaaggatccaggttggtccaggaagccaacctggggagagggcttcaaggagggagtgagaaatactgacatggagtagcttcccaggtagaacaggaaaagtggagagcttgaggcggagggtttcagcctgtggcccgtcttcctgcttcccctggcactcggttacttgaaaatatttatttttgctattagatagtattatgcattggaaaaaaaaataggaggaggccaacatatctgtggtctggagttcctagggagtcagcagggtggctactgttggtgggccttcgcctcctcaggagaagggagcgggtggagagcatttgggatgaatggagaacatctgaagtaccagagtaattaacgttgaaatgtggctgcgtggcacgtggcatttgctgtcattagagatcttttccaagtctggccgtctccctggcttcaacaacgcacggtctccaggcaggttttgcgggatcatttaactccgtggactcccttagcgtcctcggaagatggctttatgtacatagaccacagtttcagaagttaatagcagaagacacttttcagttactttggggactttaagatctttctaaatcagttttcatcattaaagtacaatgtaggtgtattcacgtgacagtgataatctctgcacattgtttaacttgaaagataaattacttggcagtcgacttgcattttcagtgttaccttagaaataactgtagggtggagaaccacttctgtttttttcattgactgttctactttctgtcttggagttaattttttaaagtgatgacttttgatagatggcttccttattttcttcctggagtttctatctgaaatacagaaaaatttgagcacaatgatcatgaaacattttgaagcctcctcttttatttctcttcttaataaaagcactctaattggggatgttaggttaatggtttcaatagcaaccacagaagtaaaatgtgtggggagctaactgcatgtcaggaaggtggcagcgtgccctcctatagtagctgtcctgggctcccgcgctgccccagaacttacaggaatgaggagtcctggtggcctgtaactgagtgatttagcagttaagagctttcacataaaaactaattgttacagttagccttgttccaggaggctgctgggctcctagcccccaggtgaaggtaagggcatggctttgaaaaccaaacgaagtgaggccattaactcctgcaggagctgggtgctcccgcccccagccagcctccctgcaggcagcagcagcggggctggcggaggatcacacccaacccagccttctttatgcagcggctggagtcccttagcaggaataaaaaagtcagatgcaagagactttcatactctgaaatgattttttttttctaggtgttcgctctgtgggtggggctcagagtggcggggcaggtgagaggtggggcttggttgtctttcacttgtaattaccctgctcccgttctctcatccctgtgccttatcaatgggattaaagcttcttcacaaggattccaggtctatttctagagcagattgatcacttcccctaccgatgagcaattggttggagtgtggggaccgtgtcttcaacttggttaaggcttttgtgtctgtttccccttgatcttgctattcagcactggaaaggtgttgaagtgtgagagtgtagggttattcctggtttttggggttgactgggagctacattttgaagccccaggggagcactgagtaagtctgccggcatagacgtttctccgtctccacaccttgcttctccctaacgtacccaccttacattcttagtgtggggtgaaggtgggggatgggggacactcacctggagagacacatgggccctgcaggtcctggaactccccagagccttctcttgtgttcggcatctaccgcagcgggggctgctggccagtaaacactagcagtaaagcttgggagaaggcaatgaaggaagtcagcatctctagatcaatttatggtgcatgcaaagcgtgttttcaaatacttacagagtctccgagggaattacatcactgtttataactgttttgattgttttttatgactcagggcccagtagagccaagcagtgtaactcctgagaggctctgagcagaacgcctcatgcctcccgggaggagagtccaggcataatgggaaaagcgctccccgtaataagccaagcaccggtcgtgtggtggggagttattaatgtgctgctgggcggcggtgggtctgcactgaagaatgccatgtttcttcagctgcagatcactggggtgggtcgggggctgagttcaaagaggcatgaaccctaatggcctggaattggcaggatggtccagcctggacacagaaacagccttggggtacagattttggatctgcttggtctggggagtctgcttggtctggggagtgtgtcagaaaattctagcaggaaggagtcttgaatgattgaggctttgtttttaccctcagactccatcccatatggtaaagctgccctgagtttgtaaagggaaccatcgtccatttccatgacagggcaggaaagtgaggggaccctgctttctgcaggagatttgggagcacacaagcttggcaccctcgatcagcatgagagggcagcctccgaactccgagctgtgtccttgactgtgggtccacgcgagcttccattcgaggcagcgaggcctggaggcggaggcagtgaggcctggaggcggaggcgtgggctctggggccccaaatcccagctcctccccgcattagctacaccttgggtacagtccttaatttccctctggattaaatgggttaatccttggaaattctcaggccagtgccttatgctcagtgcacagtcagcttgggaaatgtttgctgattgctgttatttagcattgtgacttctattttcaatgctagtcttcggaacaaagtagtgggattttttatttgtttgtttgttaaaacatttaattatttttatatatttagggggtccaaggacaggtttcttacatgcacatattgcagtgtggtgaggtctggccttttagtgtacctgtcaccatggaggtcatactagggcaactgagaaacgagctggccaaatgccaccgaggagaagccgccttctggtcaccaaagggagcccatccctggggacattcacccaagtctgcccaagaacccatcttttattttattttatttttgagttggagccttgctctgtctcccaggctggagtgcagtggtgcgacctcggctcgctgcaacctccacctcctgggttcaagagattctcctgcctcaggctcccgagtagctgggattacagacacccgccaccatgcccagctaatttttgtatttttagtagacagggtttcaccgtattggccaggctggtctcaaactcctgaccttgtgatctgccctccccctccccccactttgtataagacaaaataattgactcagcagcaatgcaaggcagacagggccatcgtccagaggaatggggcctgtgctgtgcaccccacagcactgcccagcagcctggtctctccactgtaggcaagttggagcggtggcagcaggcggtgcctcggcctcccaaagagctgggatcagaggcgtgagccacagtgcccagccgaaccgtctttcaaatctctgtaagcaaattccagaggcataaacgtcttcaggacaggtgataaagttcacagtggagcatccacgtgaggcagtcagaggctgctgcggctccccggggcccgcagggccctgaggctgcagtggggatagagtggacgggcgctggagctcctggctgtgtgggtgagacttcatgcttccggtgccaagtgctgagccctcccttctcccccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggtaaggcgaggcaggcgtggggatgggggctgggctcactgagattgaccctgcacaagagcttctgtccagtcttgggcccacagtgtctctgcaaggccctctggcgttggggactcccactggttctgctggcagcttcctttctcttggagacccttgcatgtaggccccaaaaaccttaaaagttgctccctgaaaccttgccttccaaaaggtcctggaaaactttccttttcagagagaagtgacaaaagagttgttgtttcgttttttgttgtttagcggagggatttgtggaattctggctatgccttctttgcttagaagtgcattaaaggtcatttaatcctattcagttggcttttgaatcgagcatgtgtaccacagggagcactgtttgtccccccaccagctctcccacccagtcgtgggctgccctgcagaacctgcaccagcaggggcctgtcccgggaatacagacaggctcgggtggtatgtggggaaggtgctcccaggctgctctctgccaacttctcttgcgctcaggggctgggaattaattccaaagcttcgcacatggtttttgggaggctatggagtcatttctttaacaaacttagaaacaaggggaaatacattgatgcaaatatatgacttacaggtaattagaatgaaggtgtttatgggaacttaagaggggccagggtattctggtaccttctgtctctttctagctaagaggtagagagagtaaagagatttcatggacaaatcagcatttccagcttctctcaaaaaccaggactggcactgtgcccacatcatctgcaggaagccccccaggaccaggcctgctctgtcttctggggtgtggtccccttgcccactctgggcccacttgactcctttggtgacctgcctgaggctgtggcccttgtgtaggctatagggagctgcagagattcagaaacaggggctagcgaaggctctcagatggaaccaggcagaagttgggggttgccctttgcttaacccttcccctccccaccactttgtatgagacagggtaattgactcagcagcaatgcaaggtagacagggccattgtccagaggattggggcctgtgctgtgccccccacagcactgcccagcagcctggtctctctgcagcaggcaagctggagcggtggcagcaggtggcgggcccggcaccagctttgtcctcggtgcactggaatcaaccctgaggcagaccctggcaccaagctcagcccatcccacattctcctttcatagcacgagtgtcacaggggcacctctccctcctgccgggaggcccggccgtgctgtgcctctgcctgtgggaggtctcacacgggcacgagcagttcggtgtcagcggacgagctgcagcttttgatgctatgttgctccccgtggtgttttttattttatttttttaaccttaaagattttaaaagtcctcatttctggcatttcttggaaagttggaagctgtctgacaccagccccgtgttcctgcgtgcactgggccggagctgagcaggtgggcgagtgtgtgtccatgtgctccatgttttccgtgctggcagccctgaggccagcaacgggctctccgttcactccagccgcacacctagtggcacccaggtttgtgacccctgactcagagccagagctgggtgcaggcccaggtgatggcccaggttgacggagagcctgtggtgaggctgagaggctggggcagcaggtagcaggcaggcgggtggcagtgaccctggagagtcggcccacaccctgctcttccactcctggctgggctcccaggagccagtccctttgcctctctttattcctcatctctgaaaatgccacttcacttatctgtaaacattaggactgttataagacttgagtgtgataatatatgtatccctggcacaggggcctggttgccctacgtgtcctgcttacgtccggctacctgacccacaagaaccttccgctgccccagcctcccctctcccgctcccctggggccctgtttcccttccctggaaactttcctcctcctgctgctgcccagtgttgtgcccttgggataatagagggcaggtcctgccaggcctattgggagccaccccttggctgggtagtgctgtccttgcgccatcaggcattttaaaaactaccctagcccaggaagggtggctcacacctgtagtcccagcactttgaggggccaaggtgggtggatcacctgaggtcaggagttcgagaccaacctggccaactcttgtctctactaaaaatacaaaaattagctgggcgtggtggcacgcacctgtgatcccagctacttgggaggctgaggcaagagaatcacttgaacccaggaggcggaggttgcagtgagctgaggtcacgcctctgcactccagcctgggtgacagaaagagagtctgtctcaaaaacaaaaaacaaacaaaaaaaaactaccctgaggctactccagctgtcatctgagtcttgggactttggtttttttccaaggcagattttgtgattgtatcaagaatttgtgttttaggatcagtgacctcctatcctactgcacatcttacttaatttagcagctttatcagtttgccaggttcttcactaagaagccattgatgtgcctcagcacctcagcccttaaaagacagtttgtccttgttctgtccccagtgtgttgggttcagcttggcatcgagtgtgaaaatcagccttgacctttgccatttcttagaagaaagcacaggatgcttccccctcactcttctccattgcaaagaatgttccctagataaacattttcctacattgagtgttcagagaacccccagattggaaattgaatcttacatcattcaaaacttatgtatttcaatttctgatgaacaataaagatgcctatgttaaaaaaaatgtttattccaaaatcgagatagaaaattagactgtgaagaaagaataagaggaaaaaacctggaattgattccagtacagaaagagtcacttctgaggatggcactgggtgcaggaagagattggatgttgattagttgcttcctgtttctgcctgaaccaagtgtgaggcagaaggcccaggggctcaagggtacagttgggaaagaccttcgagttgggaagggtaaagggaggctcatcaggacttgcaaggagggtactgctgggggtgggggagctgtctcctccccccgctctccacgggcccctcccattcccactgaaaagcaaccaaccctgccattgtcatctccctcaaatgcccctgttgagactggatcagccctgcaggtgaagggacagaactttccccacaagcttgagtagctgctcctctttccttatttgtgtctcccagagaacagtgcacacagctggcttgaaatcaaacatggaagtttcattcttgcacaaacaagcactttcaaaaggcgtccttagtgagcactctctgggcttcggtgaaggtaccccagggggacccccgcccctgtctgctttcgtgcatccgggcactggagttatggtctctgtaagattgttgctgggtgggaaggagccagccaccttctgcaggaaattgtcgggactgggggcttctgttggtgagagcttgtaaacatctttcactgggttatatgaaacctgcctgcctgcctgccttcctctcagaatgttaaggaggttcaaggaggtgatggaggagagagtctgtgtaagagcttaaagacgatcacatttcactgtgccctttgccctcgggttggctggggccagacccccgctaccctgggggtacggtccagccaggtcatacagtcccccgagagccctgcttgtgccagcccctccgcccagccactcagtaccagcaccttcatttctgacaccacacctccaattgcaggttgctggatctttccaatgaagggtttacaaactgggaattcatgactgtccactgctggggagaaaaggctgaagggcagtggaccttggaaatccaagatctgccatcccaggtccgcaacccggagaagcaaggtcagtggctcttgggaatctcatgacagcttttgtatctcaagcctctttttacctctgggccttatttaactacggagtctctgataattctttgttttgtgttttagaggtagaattcccataacagaaaattcaccattttaattatttttaagtggacagttcagtggcttttagtacatccacgatgtcatgtaaacgtcagcactatctaattccagaatgttttcatccccacaaaaagaaaccccatacccatgaagcagccactccccattccctcctcccctcccagctcctggcaacctctaatccacttaccatttctttggatttgcctctcctggacatttcatatagatgaaataatacaacacctggccttttgtgtctggcttctttcacttagcatgatgttttcaaagtttttcaatattgtcgtatgcatcaaaacgtcattactcgtatggctaaacgatattccattgtacggattgatcacattttgtttattcattcacctgtgatggacatttgggttgtttctaccttttagctgttacaaatagtacagctatgaggattcatgtacaagtttttatgtggacctatgtttttgtttctcgtgggcgtatacctaagattggaattgtcaggtcatatggtaactctatgttgaacgttttgaggaacagccaaactgtcttccacattggctgcacccttttacattccggccagcaatatatgagaggtccagctccttcacattctcgttaacacttaatattctctgctttttaaaaaattataagcgttctagtaggtgtgaagtggtatctgtggttcttcaattgcctgatggtgcaccttgatgcacaaaagttttaaattatgatgaaattcaatttattttttcttctgttgcttgtgctcttggtgtcatacctgagaaaccattgcctaacccaaagtcacagagatttactcctgtgtttccttttaagagtgttatagctcttacatgtaggactttgatccattttgaattatttttgtatatggtgtgaagtaggggtccaaactcattcttttgtacccatttgttccagcaccacttgctgaaaaatgcattctttacccattaggtgatcttgagactcctgttgcaaatcaactgaccacagaagagaggttcgtttccacactctcgattctgttccattggtctgtatatctatcttggagtcagtaccatattgttttgatcactgtagctttgtagtaagttttgaaataagaaagtgcgagtcctccaacttggtggttctttctcaagattgttttggctattttgggtcccgtgtaattccatgtgaatttgaagataagcttgtacatttcttttttaaaaggtagttggaattctggtagagattggatatgtagatcattttggggaatatttccacattaacaatattaagtcttccagtccataaacttgggatagttttctgtttatttagctcttctttaattttgtttagcagtgttttttgtagtgttgagtatataagtctttcgcctccttggtgaaagttgttcctaagtattttattatttttatgctattgcaaatggaatggttttcttaatttttcttttggattgtttatttctctggtaattcttgtacctttttaatcccttttacttaatgatcaatcatttatttaactagtctttattaagtaccaaactctgatctaggtaatggggttacaaccaggaaagaaaactggaataatcagcacatcttattttgtagttacccacaaaggtctataaacgcctgtctttgttctctgggtcgaatgcatagtaacgtttacagaatgtgctgggatcttgcttttctatgggcgagtttcctcaaggtttgctttcactgttccgtcgttccctgtgcccttttctgtgaagatgcagtctgcttcttggtcaccctgggagtgcgtgagaaccttcccctgccctggttcttttccagttctccataaacaatccaaaagcaaaattaaaaaaaccattccatttggaatagcacagttttaggagaaaagaagagtgttgacttgccttacgtggaaaattgactttaagtcatcaagtcatctacagggatctgggacctcccccagttgtattctttctggttttaaaatagtaaataactattttaagaaagcgttggctgggcgcggtggctcatgcctgtaatcccagcactttgggaggccgaggcgggtggatcacgaagtcaggagatcgagaccatcctggctaacacggtgaaaccccatctctactaaaaatccaaaaaaaaaaaaaaattagccaggcaaggtggcaggcacctgtagtcccagctcttagggaggctgaggcaggagaatggcttgaacccgggaggcggagcttacagtgagccgagatcgcaccactgcactccagcctgggtgacagagcgagactccgtctcaaaaaaaaaaaaagtgttataacaaatcctaaaagtacaaaaatgtaaaattttaaatgacctgaaatttacacattttaatagtggaagctcctaaattctttcttttaaaagccccaaagtgtattggccgagtattaaaagtcaaggtttactcctcatgccagctgcatcctcaagcattcactgcttcgtgggcacaaggcagagttctcatgccagcctgcatggcctgcttgcctgggaggctggtgctgtatgcaggagagcacatggaggctggggctactgctcttgtgtcctcatggcatagccctggaaaccgggcacaccattcaacactctagacctgtgatctttactctgtatcatgagccgaatacaacgagccctacccatgtcccagggcagctttgaggggacagtcaatcccccatggaactgtgcctctgcaggcagcctttctcatgcatctcacgcattcttctctttccccttcctattaggccaacatgcgtgcactgatgcctctcccctgagtccacatcccctccagccaccacccacttctctgctcccctttatggcaaagccggcagaacaagctgcctgccatggccatcactggctcactcccagcccactcccatccactgcacaaaataccggggctcgtcagggtcccccaccgtttccacattgcccaagcctatggtcccatctctgtcctccccaggttgttaaagccagggtctatggttctaacaaactaagcaccctctctggggaccacagggtgcagtggttaagactgggggctcaggagcccttctacctgggggtagatgctggctctaactcttacaaatacctgtgaccttggcaagtcacttagcttttctaggccttggtcttcttatctagaaaatggggatagtacgcaagttactgggttgcggtgggatgaaatcaggtaagacaggctggataccgagagcagggcccggcacacagcgacgttggcagctcaccccctctagaagtgccctcttgcacagctgcagtgatgccacacctgggggccctctccacctcacaggctgccccttgtgcatctcgttggctgatcctctcgcacatacccctgcacgcactcctgggtcctctgctctttgttcccatccagggatctcatccagccccgtgacactgagcaccttgtacctgctggtggtgcccaaagctgcctctccctgccctcttgcacccagacctgctctgcagcagcctcctgcttctgggcatgggtctaactggctctgagcttgtgcaccttagacaaactcccaaactgcctctttcttgctttccacattaatgtaaatagctttgggctgggcatggtggctcatgcctgtaattccagcactttgggaggccgaggcgggtgaatcacaaggtcaggagatcgagaccatcctggccaacatggtgaaaccccatctctactaacaatacaaaaagttaaccaggcatggtggcgggcgcctgtagtcccagctacttgggaggctgagggaagagaatggtgtgaacctgggaggtggagcttgcagtgagctgagattgcgccactgcactccagcctggatgatagagcaagactccaactcaaaaaaaaaaaaaaaaaaaagcttcaccttgcactccattgcttggccaaatcccaggagtgaacctttaattcttctttgtctccttcaccatctgcttccagaatatatctcagtctgcccactgcctcagttcagtcccctatagtgtcttacctcctcattccactggcccccctgcctcaacccctactggctagagccactctccacccagcatccaatgatccttttaaaatataattcagaaaatgatgcacccctgctaactttaatgacctcccacagctcttagagcaaaacccaaatctcttagcctgacctgcacatcctgctagcacctctccaccgtgaatcatttcctgcgcctcatcattgacctccgttctgttcccctaacatgcctggtcttacctccatggggccttggcacgtgctgctccctccttggggacagctgtccctagggcttcccatggctgcagctcagacctggcctcatggaggggtcttatctgaatgcctgtggtggatgtcctacccactctcccaccttacactcctacagaaacataaaggcaggggatgagaatggggaggaataaaaatttgctgagattctgattccacatttagtgggaggggtgatggattatgtcttactcttagcactgatagagacatataaactcaaatatcttcctataatagagagataatcaagatttaaaacaggatgccaaccttccagatcactagagggaaataagagtgaagagaaattgatcaatatgccaaaaaaaaaaaaaaaagagagagaaagaactataggcaaatttgaatagggatacggaagtcttaaataaaacattaggaagtggaattcatcagtttattcaaagaatactcccctccaagaacacagccttcactcaacagatacttattgagcatttaccaagttctaagcactggggatgcactggtgaacaaaacagatgctaagcttacattctggaaggcagaggaggccgtgaaacaagattaccaggcaggaagctgttgtccattagatgatgagaagctctaaggagaaaaatgaagcagggcagggtgacaagggcatttcagggtgtaccgggaaggcctcagggaagggacatttgagtaaagctcaaagaagatgagggggtgagctctgcagacatctgggaaaagggcattccaagcaaagcgttcaggggatgctgaggcccccgggcaggagtgtgcctggtgtgttccaggggatgctaaggcccccgggcaggagtgtgcctggtgtgttccaggggatgctaaggcccctgggcaggagtgtgcctggtgtgttccaggggatgctaaggcccccgggcaggagtgtgcctggtgtgttccaggggatgctaaggcccccgggcaggagtgtgtctggtgtgttccaggggatgctaaggcccccgggcaggagtgtgtctggtgtgttccaggcacagcagagaggcccccgaggctgcagggggcagtgggaagaggagcagaataggacaggaccaggcattgagagcatagggaccagatcgcactgggctttgtcagccctcacagggacttggttggaagtcactgagagattttaggcagaggacagaggtgatctgaacttctgtgttaataggctgacagctggtcagaatagacggaagtgagggtgggagaggaacaaaggcggggaagccagttagaaggtcattgcaatatcaggtgaaggtgactccgacggggcagcatcagtggagtgtatgaagcagtcagattctgaaagcagggtcgagagatgtgtagatggatcagatgtgggctgtgagaggagagagggggcatggatgacttcagagtttttgtcctgcacagtagaagaatggagtcctagtttcctagatctggaacattgcagggggggaagatgctggagagaagatcaggagcttggatttgggtgggttaaatcaaagatacttacacaagtccaggcagagatatgtacctggaggtgagagggaagactgagctagaaatccaaattcggattaggtatattaagtatcgtcagcctttcaagctgtatgagcaatggaaggagatctgtttatataacagtgattcacacgtttggagcctgttgcgtgtgggtgctgagcgagctttaggcttgcagtggtgcacagcacggaaccgcgtgccctgcacacctgtgcacctgccacactgcttcctgcccagccagatgctgccatatcagctccctgcttgctgcctgcatggcactcagcagctctggccttggccttagcactgatgggcttgccatctgcagccttccttccttccggtcctgctgtgccctgagagcctcctgctgcatggtgtatgataggtgcacaataggtgttggcggattaattagtccagttggaaccctctgtaaccaccacatgaccagatgctctgtgtgctacagaggacacaggattagtggatacaagaaatacttcctgagggtagccccaaatgaagtcttgacacaggtcgatctccacccctcagcgtgggtagaaactggatctttgctttcagaaggttgagacgggtgcagaataaacaccttgtggtaccttccagctctgaccttctagggcctactggaatttggggggcggggacacattctccagtgtcatcacagagagtatgcacattcctgcaagggcgtctggagtcagttcattccatgcaagctttaccctgtagacagctgccactcctgaatgtggtccagaaacagcaagtacaggcatgcgtcctgccacagctgacgcacggcaagccctccctgctgtgtgtggggaggacgggcgccttcctgtcacccacaggctctgtgcatcctccccaagcacagtgagagctagcctgggagcctgggtcccaccagcatctctccacagtggaaatccatgtggccctcacatgggacactgcagttgcaactgagtctccccaacctgccctgctcacttcattccagggccagcctctgagcttgttgttcagcatggcggctggatcctcccagggtgagggaagggagtgatggagtgaagccaaaaggggtcagaggggctcaaacaaaggccaagcggccctttccaggttggcgtatgggcccagtgcttttgaggttgatccaggataagccctcttcagcctccagatgaatggtacctcttccggctgttcctgaaatgtcaaaatgggaggtctgcgtatcctaacagacatgtctccgatgcattttgcagaggtcctgccatgtgccagatgctatgccagtgctcgggcacagagaggctccaagacacagttcctgcccctgaggagcccacaggctagttgggaacatttcggatttcaggaaccaatagtaccatgcacaagggcccaagggccaccagtgacccagaggagtgccccaagttcagtggagcaaacagggatttccggctgaaagaaacaaggaagggcttgtgaggaagggtctgcctaaggccagattctcaggagttccccagtgtcactttgtttttttttatcttagtagcatagaaaatacaggccattaggagatggcgactgccccaagggtacggctgtccttttgtagaatgaagtgccaggcattgcccacatatgacctgccttactccgcctacccccaggggtgagacttctcagggctggccttgctccccaggccctgggagggaccacagaggggctcagcagtgacgagccaggcttccccacccgatccactgggcaagcgacggggatgtcaggccgagacagtcctcagcgatgacctgccctaactcccctccttccaggggcaggtctgggcccttccatgagtgcagagcagaggtgggagcttcctggccaggccgacataaggaaagggcctgctgcctctgggaggatgctctggtgcccacagaaggcgtcagtgtggatgggggcctgcagtggacgggcattgaggtgtggaggagagtctgagaagatctctatcaaccaccagagagccaggaagcaccccctaggaggaagggtgaaaatccgtgtctacccagagctcaccaaggcactggttatgctgtgcccaaagacccgggacccaacgtaggcattgttcgcaataagacctacccccagagcatgcctgtgaggccacgccaggtgggcaggacggccgctggccgaggcttctcatcagtgcatgggtggagagggaagcccagcctgcctgcacgctatgacgctattgtgtacacagggaggcaggaccagccccagcactgaatgttcaggtcaagctgatagtgcctgttggggacctcagcctgggaaggtgacagagaagacctaggttgccctctagctccaggattcagagctctagaggccgggaaaatgcagggctggtcagccaggaaaatgcaggtctggtcagcatcgtcagcatcgagtcagctgcctgtcagcctcgtcgatgccgaggtatgaactgatctcaaatgggcaggatcttccactccctggttgtctggtgagggtggcctgtgagtgcacagtcaccaccagcctcagtgccaggcacagtgcagcacacacacacgcgtagaccagaaaagcaggcagtcctcacttctctacaggcattccaagaacctgtgcttggggcagggtgcttcgtttctgtggtgttcatttcaatctcctgcaaatctctgcaagttaattgctttaaaagaaaatgaaaagaaaaaaactgctccaatggtgttctgtgtaaaagtgctttaaaatctatgctaagacccaggatttatgaagtaattaagtgatctgactgatgcgctagctccaataatacctcctgtcagattgaacgtggcttaggtaattagttttaaagccatttttaaaggttgagtagcacatcagtcatccattttcctcttcagttcccaggccaaggatctgggtcctcccaggatcactctcttccaggaggcaatttaggaatggaatcgagtgtgaatcctgctttgcagtcttgcagcatttgcagatactaacagctcttcatttattcctgcacacctatattatttatttatttatttatttatttatttatttatttattttgagacagtctcgctctgttgcccaggctggagtgcaacggcgcaatctcggctcactgcaacctctgcctcccaggtttaagcgattcttctgcctcagcctcccaagtagctgggattacaggcatctgccaccacatctggctaatttttttttttttttttttttttttgtagttttagtagagacagggttttgccatgttggccgggctggtcttgaactcctgacctcaggtgatctgcccacctcggcctccgaaagtgctgcaattacagggtgagccactgcacccagcccagcacacctttattgaactctacttagctccagatttgggaacactaggaccttgcccctgcagtgcacagtgtgggtgtggaagagggggcagcttccaccgtgggtgagcttgctactccagccgttacgcacagagcctgcaaggctacgaacggagctggcaacggtgcaggcagagctggggcgatggctcgtcctgcagaacatctgtcggagaagtttggctgcatttaagagagttgccatccaaaatgcccgagattttaagtttggacccagaatgcagaaagtgtctattctctgagaaacatgtatgcttcattctcccacgtcagacatcagacaggcctggggttggatcctcctgcctccgcttttcctgtctctctggcctctgcgctgggtctcctctcctgtaagatagggctgtgcagaagtgagacccagaccaagtcactgaagagaggagccttcccagcccgcccttcttgcctcggagcctacgttggtggttgcacctgaacgacaaggcagagcctgtgcacctgccaaggtcaggccagcctccccacccagggccacatcccgctcggcaccctcaggtgcaggaaggtccctgcacctcctcatgacctggggcccccatgggcacgccggatgcatgcaaagtgctctgcaggaatcgagcttggctttgtcagcactaaggggcatctgcatggtgttctcctgttcatgcagcacacacttaccttgtctgcacacctgccccatgccgggtctgctgggtaggcatgggtgtgaggggtgtttccttgttcttcacttcttccaccccaagagcccagctgagtgtgccctgcaggcagtttgaccagggctatgtacagggcccaaactttactgagttggcctagccctccctttgtaaccaggagcctacctaaggtgctggggcacctcccacagtcttcccctgccagggagaattgtgagacatcaatgtctaaatagaaaaaataatcaggcatgctttccaatcttctctctataattgacaccatgtatcttatttcatggttccaaagggttttacgtacttggtattcacatagtaataaatagactgtctgagacaattgatggcactttaaaaaatcctgtgtcactcttgaactctgagaattcactttctccctgattaaaatttcttttttctctgatctttcatctgtttccaaaagagcagcaacccacatgtgctgtgtttttccagattatttcaacagcattatttccagattcccaccaatctaggaaagaagtccaatttatcaaaagaacgagagaggaataggatgatgattagcacctacgtgttctccagcaggcactgggtgctattttatctcgctgttacaaatcagtatagaatcagggtagatgataataaggaattaaagtttcaggaaaagttattcttgctagtgatgcatatcatggtatttacaaatgaagacatgaccacgatgcctatgatttgtgctttaaactattccagagggtgggggtgaggagtgggagagtaggaagagggtgggcgaaaccagattgagaaaaggttggggattcttgggactgtgtgatggggcacggggactcattgtactgttttctccattttatgtttatttgagaatttccattacgtgaagagtttttaaaagcacatgtatgggaaacatttcttccgaagaggtcagaatgcaagactgtctgagagatttacatggcacaagtaaatttaacgatgtaaagatttcattgctttacagcaaatacacttcagttcttcacttgtgaggagtaaatgctcaatgtgccgtgggacacgtagagacagggattttacactttgtttaaagtgtaaaaagacacgtagtttcttttacgtttgactgaaggtgctctagacagttactggacgtgtgtatgggagtgtgtgcttgggtgtatatatgtgtgcatgtgtgagggagagtattgtgtataagtatgtatgtgtgtatgtgggcttgtatgtatctgtgtgtccatgtgcatgtctatgtggatatgtatgtgtgtatatgtgggcattaggtatatgtgtatacttgtacatgtatctgtgtgtgtgtgcatgtggatatgtgggtgtgtgtatgtgtgtggtgcatattggcttatgcttccttttcaagacccagtgtaacacaaggctgagctctagagcggcctgcttctcagatccatcttccaccactggtcattgcggacctcggcaggccatttccatgctccgagcctccaacctgtcctctgcccagggatggtgggaggattaaacgaaacagtgcccgagaagtgctgagccttaccagcatgaacatgattctcttattgtgagtgtttagattctccttttgtggaagagggagctgagtccaagctcctccacccagagcctgactgagctcacctgcctggaaggggcagagcctggcgtcagggccgtcttccaagctcagggccaccctcacctcaacccaacctggtgaggtctccaagcctctccaaggcagtacaggcagcccatagttgatctgatctctttagccctgtggccagtggttttcatgtgtctggcttcaggatatttctggttggatttttttgtttaaagtgttgtaattagaagataaaaattaaatgaaatattaaaagctgggagcctctgctgggtgccagccagggtcggggtgttgaggaatgttgctgctgagaggctgcctcacttggctgaaatccaagagagcagcaggccttctgagaacttgctttgaccagtccacaagagcaggggtccccatcccacctaccggtccatggtccatggactgttagggactagactacacagcaggaggtgagcggccagcaaacacttcatgtgtgtttacagctgctccctgtcactcccacttctgcctgaactctacctcctgtcacatcggcaaaggcactagattctcataggagtgcgaaccccattgtgaactgcacgtgccagggatctaggttgcacgctccttatgagaatctaatgcctgatgatctgtcactgtctcccatcacccccagacgggaccgtctagtcgcagggaaagaagctcagggctcccactgattctacattatgatgagttgtatagttatttccttatgttttacaatgtaataatgatagaaataaagtacacaatgattgtcatgtgcttgaatcaccccgaaaccatccccactgctccccaccggatccccagctgtggaagaattgtcttccaataaactgattccttgtgccaaaaaggttgggaaccactgcagtagaacatttgaaatgcaataggtacttggaatagatgcttggttttaagggtttttcctatagactatgttcctgaatgggaggattcagtatcactgagatatctcttcttcacaaagaagggttagccgtcactttaacacagtcctcatcaacatcgcaacaaaattaaaggaatgcaaggaaaacctattctgaaagaatgggcacagataatagctagagaaattctgaaaaaatgaatgcaggtgtttaactgtgttttttaactataataaaatgatctggcactggtgctggaatagaccgatcaagggaacagtacggatagtccgttaataaagccacagagatatgctaaggatagcgttttaaactggtgggaaaagactgaagtgttgaataagagttattgataattggccaaccatttggaaagaaaataattatcttgatgcatacacataaaattagaaatttctgtctggcagaaaacatcataaaattagaaaaatattcctgtaatctcagcactttgggaggccaaggcaggtggatcacgaggtcaggagatccaagaccatcctggctaacacggtgaaaccccgtctctactaaaaatacaaaaaattagccgggcgcagtggcggccacctgtagtcccagctactcaggaggctgaggcaggagaatggcatgaacccgggaggcagagcttgcagtgagctgagattgcaccactgcactccagcctgggcgacagagtgagaccccgtctgtaaaaaaaaaaaaaaaaaaaaaaaaaaattagaaaaatatttataaaatattttggacaaactcaagtgattcacagatggccttttcacttctgtctagcccatgggttggaaaactttttctgtaaagggtcagatagtaaatgtttgaggttttctggtctctgagacaactactcaactctcccattatagtgtaaaacagccatggaaattatgtaaatgagaggccgtgctgtgttctgacctcactttataaaataggcggtaggtcctggccttagtttgctgtccccactctgccctgtttacatgttcagttgaattgagtcttctgtttcatggtagttaagagggctgtttatttggctgttatatgaggcatcccatcctgtccccattttcccaccacccatgaagttatattgtcctgcttgctggtaaatatttaacaactagtgctctgggggaaattatttatagatattgacatatcacataagttcattataaattttactgatataaaggatgttagccaacaatttacaaataataaaatatacattgcttgtattataaattccatttagccagttgattctcagagactgctttcattgatttttgccgaattctggttccataaccagccgatggctgccatgcatgaacagttgtctttccagcgtaaatattgggtaatatttttgccacagaaacaacaaagacatatgtcagaacttcattcactcaccagggatgggaacaacttccttgctaaattggaaaataattttcaaatactgaaagaatatctcttcagttttgtaagctgttcacagtgtaatacctacagacacgaaacatttttaagttatacctgcagtattaatgctttctccatcactttcttaagcccagaaaatcaacagtaaacccagcccttgtttgtagcatttgtcgatttccatatgggaatatcccgccatggccaatttcaagctgctcacgtgacgtcactgaagacgggttggtaaaagaggggtccagtagccaccatgagatagtgcttcccctgtgtagatagaacagatgtgagtaaccctgaagcacagataatgacaaaatatagtgagatcatgaggaaggggcaatttgtgaatattcattacctttgtttttagtataatttattcaattgtaagcttctataatttaatgtttaataaagactgtgtttaacaaccagctcacaaaggttctgaaaatgttcacaatcagttccgttaagccagtgctggtcggctgcagcgcaccactgcatattgggaattgaacgggtagagggttgtctttctcttgggacaagcacactttaaggggagcgtattcattgcaggaccaaggctcaacgtgcactgctccccacccgtcccagctcctctttatgcttgcgggggccagccactctccagtcctccccaggaatatacgtcgcaaccaggcattcttttttcattggcctcattcttcccagggccggctcagaggccccccggtctaattgccattggtttaactgctgtttaataaatcaaactatttttctgactaaatcttgctaatcagtaaatagtgatcatctgaattctccatatgctaaaaagtcatttttccaaggggtaaaattaaagtaatatttggcataaaaaaattctaatacacaggcagacacctttatgtctaatatctcaactgtagaggttagataatcacagagtgctatactgtgttatagccttaaaatgtagagtgcttacagatcactaagaaatatttaaataatatcactaaataggccaaaatcctgaaaagcaattcgtaaagaaaacatacaaataaccagtaaacacaagatagtcaacatttgtagtatccaaataaaatataaactaaaggccaggtgcgttgtctcacgcctataatcccagcactttgagaggccaaggcaggtggatcacgaggtcaggagttggagaccagtctggccaacgtggtgaaaccctatctctataaaaatacaaaaattagccgggcatggtggcgtgcacctgtagtctcagctactcgggaggctgaggcaggagaattgcttgaaccagggaggtggaggttgcagtgagccgagattgtgccactgcactccagcctgggcaacagagactccgtctcagaaaaaataaaaataaaaaaaataaacgaaaacacaagaaggcaaaatcatgatagaaagccaacaagcagcagttgcagagatggtagaacaaatgtgtgaaacgaatctgtatggcactctgcactcggggccacagagtgatgtgatttaaagaacgggaatgcaggggcagaggagcctgggtcccacgctggctgcaccggtgacgggctgggagacctgggactgatgactccctcatcagcgtcttaccagcacctggtggacatgaaatttctcacgcagcctgtgtaggttgtcacagaagcccaggctcctctcccctctccctacctgccactgcaagtgtgtgttttaccacagcctttaggaattggtccatttgctctctgggaaaattccagcctggagaagctggtagagacctgcctccatgcctctgaggaaaatcaaattggctgcgacctctacagaacccaggaatttggaattcactgaatccagggttgctgcgctggaggcaaagctgggctgctattgggttggctggccctaagggaaaactcttctgacttttgaactcagcaggtacatttctattcttcctttcttcttcttaagcaacacttttcccgagaaaaacaaacaaaactttgctaaccaaaagctttgtgttgaaactgccaggaggagatgataagccaagcattgccttggctcctcaggacttttgcaggcccccggggcagagccattcaggaagttcccacagggcttggctttctttggagctcagcccagtgcacctgactctaccctgtgcttctgtggaatcccagctttggttctgtccttcccagaaacctgaaagttgaagccaagacaggatcaaggaaggtctagtcagaactgtggtgcttttgccaaaacttgcagaataagctatcggggcacagatcagttacgaaaaccaaatctgacccgttatccaggcgacttgagtgagaggagcaggagggtggcgggaggagaccaggctgccgcagacactggagcccctgaacgggatttggacctcagggtggtgtttagggagagcccagagcagagcagctggcaggcgtggtctgagttcagctggccgcttcctggcctggtcacggaatctctcagtctctgtttctgcacgtgtgtgatgggaataatagtgtctacttcaacgggcctggggagattcaaatggaggaaggtttcatatgaacaaatcctttatgaggagtttcaaaggtttcaggattacaatctttgtccatagtgcctataacatcagaaacaccaagaagtgtttcttgatattgagcttccttgaagccaattacacatgtcagttacatatcgaattctgtgttctgccttgtgctgtgacggtgtctcacgaaggtgctgctatacctttggaagactccagaaagcccagggaagcaggttcttttcaaacatgatagttcacacttcatacctcgaagcatgtattttgatgacgttttactccgcaaatgtcacactggccccactgcgtgtctccccagactggcccagccctgctgtcgtcaggccttgcctgttgcccagtaaagagatctagccctcacttccttgcctcggctcccccagcctcccccacggtgaagcctgggcgttggaatggctgctgacgttcccaccggggaggagcagcggaggcgtaggggcgggccggtccgacccagcgggaccccgggggggcgggggttgtggcttttccctccacttccaggtgaggcttggtatcaggcctccccagcatctggctgcctggagggggcaggtaacacaacccagaaggaaggtttacccaaggaaagacaggacataaagtgtatgcccttcctgtctgagggcacattggtctcacaaggcctgtttggaagacttcccccagctaagcaaccaccccgtttctttgtggagctgcagccagcttgaaacacagctccttccatttgtcaaccccgagcgcttcctcctgctgccctccactcctgttgccctgggattgcacctcccaataaagcttcagcccatgggcttcacttcagtcccttgttttccagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaagcagttgttgattgactgcatgaatgcatgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattgatgaaaatgaaaatgacagatctgaggaagagggagagctctcttgaaacccctttcccagatttgccctcagttttaggaatgaggtacgcttgggcattcctgttgcctgcatggttcggcattctggcagccaggttcgccccagaatagataagtgtgtttgattttcgaacatttgactttattacttatttccagaaacacttcgtgttcaaactacgtctctacaggcatttctacttggtctttttctcccctgacatttcacagagtcctaactgtgctgcatgtataacttgttctttctttttgttacttgcatagcaagcatgtttctatgtcattaaatatcctttgtaagcagcattttatagatttttataatacttcaccaacagaagcaccataatttatttaagcatctctctattgttggacatgtagattgctttccattttttcctattatgagcggacagcttagtacaaaaagccttctcctgaatttaaaattatttctttgggattattcaccagaagtaaaattactgggataaataagaggtggaaaccacaaatatgcctgcctttgatacatattgccaatttgcttttcgaaatagttgaactgatttgtagtcttaccaggagtgggcagttctggaggaggtagatgatacccttccttaacttacattgtgatcattactaacaaaggtgaaccttttttcaaatgtttgtgcactgtgttttttcttttgaaaattgccctttctggcgtggtggctcacgcttgtaatcccagcactttgggaggccgaggcaggcggatcacctgaggtcaggagtttgagaccagcctggccaacagggtgaaaccccgcctctaccaaaaatacaaaaattagccggtcatggtggtgggtgcctataatcccagctactcaggaggctgaggcaggagaatcacttgaacccgggaggcggaggttgcagtgagccgagattttgccacctcactccagcctggatgacagaacgagactccgtctcaaaaaaaagaaaaaagaaaattcccttttgtctttcgcgagagcgctcagtgttgctatcaagctgataagtatgtagtctgtgtaaaatattggtaaaatattggtgtaataaccctgtgtgtgtcgtaattcatataaattttttttctggcctgctgtttcacttttgactttttaaaaataattttaaatttcccctccagagttttgataattatttccttttttaaaaaagtcccaatttgtttgattttattttcttcataatctgtttgcctttttttcagtctaaatattagtgtctctaaaaaataaataaaagatatataaaactttttctaagttgctaacaaattactccaaaacaaagtcaagatcaaaatgttaaaagatgtcgtggacttttatttccaacaacagagaagacaagtgtcttgaaatctccctcccacagaaaagaattttaaatgttggttgaaatgttcacagccaaagaggtgaacagaatcatggtccggcttttgcttgaaggcatctgcttcatctgtggagcccacctagtagaccacataacactgggacctcaggggcacccaaggaaaggagacacagacaaagctgtgtaactagaacccacaaaacaagtgcttacaaacaagtccaataacttcagtagtttcactaaaggcatacagactcgttgctccccttgagagacaaaaattgtcatattggatttttttaaaaaatgtatttaaaaatgtatttgggaggctgaggtgggcggatcacttgaagtcaggcattcaagagcagcctggcctacatggtgaaacctcgtctctactaaaaatacaaaaattagccgcatgtggtggtgtgtgcctaatagtagtcccagctactcaagaggctgaggcaggaggatcactggaacctagaaggcagaggttggaatgagccagttcatgccagtgccctccagcctgggcgacagtgagactccatctcaaaaaatacaaattaaaaaaaagtattttctgtagtgccaggtatatttcatttacccaccagatccattctccactcctccaccccacagactcccttgcctgtggcttatagttgagttcagccaaggggaaactccagcaggagaggagggagggaggagatatttatttatgagttagtgattctccagtccttcatcagccaaacagaaatgttatggcaaaaagcgttattggagcttcatatgtagctctgtgtatgtatcaatatgtagagggtctatacatattggtaaaaggtttagttcagttctaaaagttccacctctaatcttttatgcaatttataacacagccttaaaatacatatagagcaaaaacttgttaaaactacaaagagaaaatgacaaactcacacaggagggagagatttagcatacctcggatatatttgatagataaaacagcaaaaattcataataatagaagatgcaaatatctcaattgacaatttaggtcaaatggacatattggaacactgtgccaaacaacagaataatacaccaaattttttatttatttatttttttttttgagacagaatcttgttctgtcgcacaggctggagtgcagtgacgcaatctcggctcactgcaacctccgcctcccacatacaagtgattctcctgcctcagcctcctgagtagctgggactacaggtgtgtgcctatattttgtatttttagtagagacagggtttcaccgtgttggccaggctggtctcgaactcctgatccgtgatctgcccgccttggcctcccaaagtgctgggattacaggcatgagccaccgcgcccggccaatacacccacttttcaaacacgaatggaagatttatgaaaattggccacatgtcgagccatttggcaagcttcgatggatttccaaggattggtagcatataaaccctattctctgacattacacttaagttagaaatcaaaatcaaaaagataattagaaagtttccatacatttgaaaattgaaaaatacttctaaataatttatgtgttaaaagaaaaaaacataatttatattagaaaatacttaaaactggatgataataaaaatactacatattcaaataaggaagatacagctaaagctgtagttagacaactttatggctgtaattgcatatatcagaaaagagaaaatcctgaaaattaatgtgctaagcatccaacttaagatgatagaaaaaaactaacaacataaagaatgaagaaagaaggaatttttaaaatagcagaaattaacaaaatagaaaacaaacatatgtagagaaaattaaaatgccataagctggttcttgaaagaaactaataaaattgataaacttgtaagtagaccaaggaaaaagctgaaactatatgatttcaggaatgaaaaacgcatgattatagatcctatatacattaaaattatgtgacaaaggaattctaagtgaaatgaacaaattccaagaaaaaatacaacttaacaaaattgacacgtttacataaaattaaaattgtcctattaaagaaattgattctataatttaaaagaaaactcaaggccagagcaatttaccagcaaattctgccaaacatttaaatggaagaaataatgtcagtgttctgtaaattcttctagatagtagaaaaatagggaaacagtccccactttgttgaatgaagccagagtttggttttttttttttttgagacggagtctcactctgttgcccaggctggagtgcagtggtgcaatctcagcccactgtaacttctgcctcccagattcaaacgattctcctgccttagtctcccaagtagctgggattacaggcatgcgccaccacacccagctaatttgtgtacttttagcagagacagggttttgccatgttggccaggctggtctccaactcccaacctcagatgatccacccgcctcagcctcccaaagtgctgggattacaggcgtgagccaccgtgcccagctgaagccagtgtattcttgataccaaatcccaagagcacatatgagaatggagaattttcagccaatctcactcaagaacataaatacaaaaattctaagcccaatatcaagaaaactaaatccaacagtattaaaaagatgaaatactctgttcctcttttcctgccttgttttagattaatcaaatatttgtcagcattccactttatctcctctattggctttttagctgtactttgagtggtgctctagggattacaatatgcatccttaatttattacactttacttagaattaatattgaacagctttacacttctcagataaaaggatctaataacagtgtaattccatccccctccacttcctcatttgtgctgtaatggtgttgtatattttacttctgtatttgttacaaactccttcttaaaacagtgatattactttttgctttaagcaatcttcttttttttttttttttttttttttttttgagacagggtcttactctgtttcccaggctggagtacagtggcacaatgtcagctcactgcaacctccacctcccaggttcaagcaattctcctgcttcagcctcccaagtagctgggattacaggcatgcaccaccgcgcccggctaatttttgtattttcagtagagacaggttttcgccatgttggccggactggtcttgaactcctgacctcaagtgacccatacaccttggcctcccaaaatgctgggattataagggtgttgtcttttaaataaattaagggaaacagctactcttcagtgtgtttactgacatgtttaccatttctagtgctctttattctttcctgtagatctgaattttcatctgctatcatttcccttagcctgaaacacatcctttaccatttcttatcaaactgggcttctggcaaggactttgctcagctttgttttctttgaaaatgtctttacttcaacccatttttgaatggtattttcactggatatagaattctgggttgggagtatttattccagcactttaaaaataccaaatttttaggccgggcatggggactcatgcctgtaatcccagcactttgggaggccaaggtggccagatcacctgaggtgaggagttcaagaccagtgtggccaacatggtaaaacctcatctctactaaaaatacaaaaattagccaggcgtggtggcaggcgcctgtaatcccaactactaatcctaactacttgggaggctgaggcaggaggatcacttgaatccaggaggcagaggttgcagtgagccgagattgcaccactgcactccagcctggataacagagcaagactttgtcaagaaaaaaaaaaaaaaaaaccccacacttttggccaggcgcggtgcggctcacacctgtaatcctagcactttgggaggctgagacaggtggatcacctgaggttcggagttcaagaccagcctggccaacatggtgaaaccctgtctctactaaaaatacaaaatttagctgggtgtggtggtggcatctgtaatcccagctactcgggaggctgaggcaggagaatcgcttgatcctgggaggcggaggttgcagtgagctgagattgcaccactacactccagcctgggtgactctgtctcaaaaaaaaaaaaaaaaaatttgggagaagcacataaatgccttaaaattaaaaatataagtcaaaaattcaaaattcaatagatatgttagaagataaacttgaggaaatctcccagaaaatgaaagggtggtgggggaaagacaataaatattggacccagtaagaaattttgttagaacattgggaggtgggggcgggagagggatcatgtgagtatgtggaagatagtgtaagagaactgaattctcagcttcctaggtgagacatcactggacaatgtctaacatcaagaaaccaggacatagcatatgagtatttttgtctagcaatgtaagggcaaatgccagaaaaataactcaaagtgttaaaaagaggtggggagtcagggggactccaagaggtagaatggagtgaaggaggactgctttctttgttataaaccttgtaagagtttttgactttccagacatttaatttattactttggaaaagctggagcatcttaaaagatagaatgaccttatagatgccattaagaaaagtgctgtgttgtccattgtacacacaggtgatcattctttcccgaaaggatatttgtttaggattcttcgatccttttcctggcatttaaaataccatctttcagggtttttgtggctataggagcacagggaagccttgtatctcccctttcttagcctgggtctgagagttcatgtgtgtatgtgtgtgtgctcaggtaagtacgtgagtgtgggtgtgcatgttatgggtgccttgtgcacacatgtccatgtgcatccatggacgtgtgtgtacatggggagcacacatatatgtactctttttcttatcctcctttccaagccattcctaaattcctttttacctttctcttacttgccataatgtgaacttaaagtgtattttaataatgtgtttattgagtaaaggttgatatttctgtttgtgtgtgtatacatatacatacaatatacacaaaaaattactgtgtgtatgtgtaattttatatatatatatatatatatattgagaaagggtcttgctctgtcacccaggctggaatgtagtgtgcaatcacggctcactgcagcctccaactcttgggctctagcaatcctcccaactcagcctcctgaatggataggactacaaggacacaccaccacgcctggctaatttttctattttattttttgtagaaacggagtctcactatgttgccaggctggtctcgaactcctggcctcaagagatcctcccacatcagcctcccaaagctctgcgatcacaagcgtgagctactgtgcctggcccctacacggtatttttaataatagctttattgagatataattcacatactgtgaaattcaccccttttaaggagtaaattataggagtattcagtatgtgaattataggggtgtttttgtatatttttataaatggatggaagtaagcttttttattccttccgcccaaacctctgcattaacctttgtaacttgaacatagccatgggtggctggttcaccaaatctcagaaggaagaaacttccactggtgttttaaactgaaacatatttacgtgatttttctagggctctcttacttcactgtgtttcaattaaggaatttcttcctgcatattttaagtatggggacatagggggagaattaattaaactctatattgttaataacttctcctatagccaggaaaacccaggaatccaaaagtattagctcagagtccttaatctaatagaactttcccccacccctacttgctttgtctccaattgtaaatttccttcacaaggattttaatgcttaactcaaaatgccaggcataggaaagcttcattattgctggtactttcctgttggcaaattcaaccatagtctccccttaattctggttctttctttgcataatgggaataatcctgtttgttcattatgaatttaattcattgaggggaaatactgcattgaagatagtgaatgatgataaatccatttactggcagcctcagttggcactagctgtggattatcctctgcctctcacaatgacattccctggccttcattgttgacatctggaggcagcctgctggcagtgctggcccaagtgtttaaacaggtggatttgtgattcttctacaggctcaggaatctgatggcaaaaaatttgattgggcatcttttaagaccccctccttttagaaactaaggaactcatggtgctagttgggtatgtacaacagtaaacttgaacaggcttgtagagtatcttgaatagtaaataacacattcttgctaagtggtttgccgaaagcagggtcaacattctaaaatctgactgcctctgggtggcagttctgttgagtgtagaccctggtctggcctggggtgtccctggacacatctgcctgttcttcctccttgcttctcctgcacccatgtggcttaccttcccaaagagaatgtggcctcttgggggtgactgagtgtggaggggccggcctggggagcctgtcctggcacaagtgctgctgctgtggggggccgacactgtggacgcaatgagaggaggtggatgcctcctgaaaactaaagcctccaagaagctcattcctgtgtgtctctgccttagtctgttatcctaagtcacccataagcatctgactctcctgcctcagttaagcttgggctgtggtttggagaagggactgtgtagagggggtgattcttatcaagtaactgatttgcccaggtggcctgtggtccctcgcctgggtattttgcagtcaagcctcatgggacaccaaacactgtggcgggatcatgtggcattgccgttcatgatagacataagtttacagttcaagataagacattaacgtgttgtatcacctgacccagtggttccactttcgggactctattgggaaaaagtaatccagactgcatcaagtaatatttctgtcagatttatgtatttcaaaaaagggaactggactaaacgttctgtcataacctatcataagaggttgttaaacaaatggtcacgttcacagggtgaagtattttgctgtaaaaaaaaatgttttaacagattcattcattcagcaaacatttattgagtacctactgtgtgcccaaaagttgctacacactgaagctaatgcaccaaacaagagagacatgttccctgcccccgtgatgcctctaggctgaaggaagagaaaacagtgaacaagaaaataaataacgtcgaatgcgattaacatgatataatgctaagtggaaaaagaaagagaaaacagggtgctgtgtgttttcaactatgcaagaaatacacatgcataggaaagagcccaggaggaaatatgccaaaagagttataggtgatttatttttatttttctttaaatatctcaacatttaataatttttattctaactagggaaaaagtaattttaaaaaagaatcactcttcaaatttatgccatacactttatgccataggtatggaattctcatttttacgtcttccaaaggcaggaaaaccaaagtgactcccttggttgagaaagtgaaaaaagcatttaagtactagaaaggggagataggccaggtgcagtggctcatgcctgtaatcccagcactttgggaggcacgcggatcacaaggtcaagagaccaagaccatcctggcaaacattctgaaaccccatctctactaaaaatacaaaaattagccgggcatggtggcgggcgcctgtagtcccagctactcaggaggctgaggcaggagaatggcgtgaacccaggaggcggagcttgcagtgagctgagatggtgccactgcactccagccgggcaacagagcgagacaccatctaaaaaaaaaaaaagagagagagagataaatgtctcccaaattaccattgtctaaacctaaccttaggtcaagtgtcacaaatcgcacctattagaaaaggaaaggtctcttttggaggcacatgcaggaaggggttgctttggtcccactgcttcttccctgctggcgtttttggagctcccagctctcagctccgcaggttgttagctcagtgcctggcccctcataggctgtcatgagtatcttgcagatcgagagaaagaacaaaaatacaaaccatgtgtgagcaaaacaccatttcattccactggcccttgttacaaatgcagctaagatctgcttctatgcatcttagacgtctcatcccttgttcctagcaaatatctttggtaaatttacaagtttataaattgcttttaattttatcaaatcagaaatttgtcttgctcttaattatatgaaaaggatgctccgtttctcatataatgagagaaatgcgacgttaacctttctgagttatcggattggcaatgtaagccatagctgcaggctgcaagggagcccgttccttttgacgtgtgacatgtgacgtgtgacgagttttacgtctagtaatgtagcctacaggtacacatgcacacagctgaaatgacgtgtgcagtaggtttcccttaatggacagctcctgcgtgccagtctctattctaagtgctttaccatcatgaagtcatttaatctccaaagcaaccctgtgaggtagacattcggagacgttattattatccccacgttacaaatgaggaaactaaagaacagagatgaagtaatttgctagcaggggcaaagccaggttccagaccctgttgttccagggcccttgctctgctcacctcaagtagttgctccctatgtgaccaaggatagagcactatttgtgtagtcgtgtgctgcaaaatgacatttccatcagtagcagaccccatattcaatagtcattgcataagattctaatgtcgtattttgactgtaccctttttatgtttaggtgtgtttaggtacacaaacacttatcattgtgttacagttgcctacagtattccatacagcaccatcctgcacaggtttgtggcctgggagccgcaggctgtaccctatagcctaggtgtggagtaggggtaccatctaggtttgtgtaagcacactctatggtattcacaaaacaacaaaatcacctgcatttctcaggaggtatccccatagttaagctacacatgactataattgccaaagtttataaacaacctaaacgtccatgagtaggggattgtttaagtaaacaacactacatctctcctgtgcagccatggaaggatcataaggatacactgttaatggaaaactcaaggtgcagaaagtgctagcaggtgtgttaccaaaaaggatggggaaacatatgttcatatttgcttgaataagaataaaatgcttcagaaatgatacacaagaaacggggaaccaacattgcccatggggagggagacttcgtcatatgcacttttatacttttgcatttctgagccatccttgtatattacttattcagagacaaaaatcaaaaccccgagtactactgctttttaatggggttttttgaccatacaaccactttattcatagattttaaacattaaacttttaaaaagttttaatgtttatatatgaacaggtaacatatgttgtggttttaacaaaaagtcaaacaggctgggcgcgtggctcacaccagtaaatcctacactttgggaggccaacgtgggaggatcgcttgagctcaggagtttgagaccagcctgagaaacatagtgaaactctatctctaccaaaaatacaaaaagtagccgggcgtggtggtgcacacctgtagtcctagccacttgggatgctgaggtgggaggatggcttgagcctgggaagttggggctgcagtgagccatgatcgtaccactgtactccagcctaggcaacagagtgagaccctgtctaaatacacacatacacacatacacacacacacacataaagtcaaacagagagtgtaataaaaatgaagtctctcttccattccagtccagcctcctcccatgaggctgcctgtctgctgggtccctgggaattcttcctgctctctttttccacacagtgcacaccactgaccctgagtgtggagcagcccctcttgtttgtcccaccaaaactatatctgaaaataaaaatccagttttggtgaccaggccttttgtgggtgtttttggagacatcctctataattgaaataaacttcaactcaaatgatagcctctagagcccttggtccctgtcctaccgtcatcacaaccccagccaatctcagtgcaccacttggtggttaaagtgctcggattcctttgtggtcggaatgtggccgtaactggaccctaaggagctgaggagagtcagaggttcctcaccaggcttgttttctgcacctgcagtggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcgctgtcaccacacacgtaggctgggttaggaactgtgtcagggagggggagctgctgtggggcttaatgaaccgagccctgtggaagaccgtgtgctagaaatgctatgctggggatgctgtttcatgtaggagggccttgcttacctcttccggccctgtccaggctaagggaggcttgggcagtacagaatctgacttgggacagtgtgcaggctccagccttttgcaacctagtacttagccagttgaggctgtggttaaaatgaaacagggctgccacatgccacattgtgtaaatgggtcagtgtcgaatgccatttcgaatcgcaccagtggggccagtcccgcctgtctttcacctgcccgcccacccacccaggatggtgtggattacagcctatgggcttatggtatgaggatgagcaggagctcctgttctggaatttagaaacgctaagagatttccagaattggaacaaaaagtaaagttgtactggcagaggggcctgcattgcagaaacagtgcataggcaggtatgtaaagacagacaggctgccatttagagccagcgggtggagtagcgagcatgggcagaggtaagtgttgagaaaacacagtcaacagcaaagaatcagagcagtattcttcctccccgaaaccattctgattgccaagaaaccccatggcaggaaaggaagaggaagcagggatttttcagccaacagagacattgagccagcaatggccctgtccccagcttgggtcgcaggagacagtcatgagggcccactgagggggttcacagctgaacatgtgtgtgcatgtgtttcctattgagccaatccaattagaaacaaacattgaaaggctggggcgtccgggagccccgtcagcatgagcagctgtccttgggcaggtcacactggcccctggccccctcaactatgtggggtgatgaccttctaaacagtaaccctgctctgaattctggggatgccgtggttaaaaaaaagaagaagaagaagcttaaaccagtggccagcagcagagtcggcctgcagataggcgttaattaattgcatagatgctctttgacttacaaattgcaagttgacttatttcgatgatattttcaacttatggtggattcatcccaacatagccccatcattaagtctaggagtgtactgaatgcatctggcttccacaccattgtaaagtcaaaaaattgtaagtcaaactgtcataaattggggactgtttataatgtgttttataacatcaggaattcacctggaaattgctaccaggattttcactttgcttgatacctgagaacagacagctgcatgggccatcgctccctgtggagctgtcggtggggcgggaccccagctgcccccatgttggctgggagctctcccatcagcactgtctttcctgtgtctgtctgtctctgatgtcccccatggagcctggtgtctgtctactcatccccctgctttcaaagatgttcttcctccacccagcttctgcagacatttgggtttttaccagcactgctatcccccagaacatccctcactgtcctgggctagctgtggaggagagagcccaagactgagtcttcccatgatctaggatcaaggatccaaacagcaggactcctccatgcaacccagttatcacacttggatgctgtagggcaagactcacagccaggcctggcaccagatttacccaccggatatcccaagacgggaaggtggctgctgctaggcatcggggaggcagcatcgagggaggctgcagtgagatcagcagggcagaggacagcctccaggacagtggagagtccagcccggctgacctccatcccagcagggacaggaagcggagggcagctcgatagaacaggaataaaagggcactggcttgcaggaatgagacactgggggaaagcagcatgtggcctgggcaataggtgcacagctggccagcaggtaaccaggaagtgaaggtagcaggccagagcccagctatcaggggaggagccaggcagcatctggcttatttctgtgagtgacagaggtcttggcacaggcaggtaactctgtgggtttggtgccttccagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtaatgagcctgaagtaagaggagacggccagcttccacgagctttgattgtccagagtagctcttaaaatgtagggctgctcctggcaaaggtggggctgatggttgtgtgtcttctcttgcctgggagtcataataatcatggcaatttgcactcacacagctcaatccaccccaggctctgctaatattttacagaccagtaagtatgcttcaaaccagtaagtattttccaaccttcccagctgggagagcagggtctatatgcccaaccagaatggggtcttgccccctggtaagttagccacttctaggagcaccccctttccaaaggcccccatctcacagctcagcctcctgactccctcaagtacatccactttcagtccttgaggtcaggatgtgggaaggacacagttactcccaaggatccaggaaggttgggttcaaggagcacagctgggaaaggacttcgtggcagagatcctgaccagcctggaggcctagggttaaagacccagagaggatctcaagagatgatgtcagcagatactgatgcttcacagatgccttgaaaatcttacagcatctaaaaaggccctgcatgaatcgtttttctccaatcatcccattgccaaggtgggccctggtttggggccgccagttcactccacaaggcggccaaaaccacagctgcccagagaagctccagccactgagctggacatggcttttattcgtttgttagactagaagctgttcttctccctctgagccctcctgtagcaatttgtgtgagaagaggtatttctggttggacatattttccttagctaaatactacggctaaatgataaatgatgggtgatatctaagaacactgatgctttaagttatctaatatcttctgtgaaaaacaaataacaaatggaaaattccaccaacacatatcaagtataaattacggtcaattccattttaaatttcttctactattcctttaaaatagagcattgaattatgtatggactaatctgctctgtttccccctgtgatttataaactgtggcaagattcagtaattattaataaggaactgatttttttcttaaaatctgctactgacttcagccttgcacaatggaacctcactgtgataccattctgcagtccagcagtctactgagcagggattaggtggagagagggggtctccatgggaaggagatgcattcctggctctcagagaagccccctcaagtctcaggggtgagtgggatgggcagaccagagacagcaggagagcctattcagagaccaggacagagtgacagaggaggtgagaaccagacggtgccagagtatggaagccaaaggaggaggacgagccacgttagagtccaatgcaaggtcaggtggatatgagacggggtgtgcggagccggccatggtcatggtgcatcaggagtgacgggcccaggccagtggaggctgcacctggactctttgggcaagagagcagttgccaagaaatagaggaagtgagcgagggggacgagggaagcctagggagtacttgcaaatggccagggtcccaggacagcagcaggcaagatggtccctggagaggaaggttgaggaccagagcatctggctgggagaaagggcagcagctgcagtgggcagcgtggggcacaaggaagatgtcagtgctgtggttctgaaggtggacaactttgtggtgacagccaacctgctaggccagagccgtctggtggccaaagtgcaggtggaggccaccccagggactccgcagggtgctgagttgagagcagaccctgggctgtccccccgcccagagactgggattcagcaggtgtgggacgcctgggggtctgcacctgtagcaaccactcttaggtgcctgcaggcaccgtgggcttagggagctggcagataatgaaaccagcgaggatgggggcaggaggcagggaagagcttgggttcctgcaagagagtggctgggaggccaggacattactggcatggaaacacagggaagcctgggcctcaggaaagaagccatggttgagcaaaggaagctgagtgggctgagatcagctcaggacactgtggtcatccacacaggactgcaagggaagccaagaacccacgtggcatcgtctggaagacggagttccagggcagctccaccggtacaggagacagttcacaggatgagggtgatgtctggagcaggaccatgtgtgctcacaggctcagcacatccgtgcttactcgacaggctcaagcagaggcccagaagcctcaggtcgcttgctcagggcacagcagtcaggaaggaaaccagacttgttctcagtgtactcttattctcgtgggcacctcttgtctgcaattaatcggcccaagtcttgcatgcctctcgggtccgatactgctccagtgaggttctggtgtgctgttcttggatggcgtgaacggtggagaagatggtgataccaaactctcctgtccatcggcagttggtctgagcgcgcaacggcaaagcacatggagaactcccaagttgcttctaacatttatttgtttgtgtatttttttaaatcctggatttcctccacaaaggattgaaggtggagttttcaaataaacccgtgtcagtttaagcccatctagagaggcatcagccgctagccaggctgttcagcacgtgaacggagccccccttgtatgaagagacccctgctaggagttacgggaagtgacacaagaaggcagcggggcttggaggaactgtcacgctaattgaggcaaagggaaaagcagacctaagtacaaattgcaacacgaacatcatggttgcccagagaatgagctgcagctggaccagaacacgctcaggcggtggagtgattgggaccacgtggacagcaaggtggatttaatttaagaacgcttcatgggcgagaggaacctggatatttggcttttaaacacaattcaagtggacagccatactggggaggtttgtttacagatattcatctaggcatctccacccttggatgggcatcgtcttaacctgaccggtgggtgacctcagtgcagtgtgggggccctgcagctctgttgaatagcccccaaccttgcactgggctccttgcaaaattatgaataagctttccactgcagagagacccaggaacaggggtggggggtgtgaagtccatacacccggaccagcagctgggagcactgcttcaggaccctccccaaggctgtcctcctccgaggacatcctagaacattctgtctggagatggtgaggacatctgcactttccctgttcctagccaccctcctctcatccgctcagcaaatagtgattgagcacctgctctgtgcctaatgccaggaatctagcagtgaacacaccgaaccaagccctgcccgcccgtctcccattccgtgtctagaaagagtgaaaagattggtctgccgcctccctgtcgcactcctgccctcatcttcttaagatgaaggaaattgttcactttatcaagcaagacagacctgctgcctcctcagggagaagacgctgcaggaaaaggcaggagagaagtcctcaagtcaccacgacagccccgcgttcgctgggccagctgcgagggtgggaaggcgagagcccagtggctgagctggagttttgggctcaatgggtaatttaaagcaatggtgcgagaaatgaggattttggaggctgtcctcatagatgacccaggatgaggtgggcaaagaatccaatcagatgggaattgatccaaaatattatagtaaaccctctggagctggggggaggagtttagtaatgagttttagaaatggtgggtggcatctggaacccaggataccagcaccgcccaggaacagcatctagagtgtcctcgtggatacacacagctctgaaaggggttcacagtgggaaccgggacacgcaaagcccccccagtgaaaactagggaaataacaccagagagccttcggggagggaagccagcctcactgggtctaacactggcaaggtctggagacttcaagacgagtgaagagggctttgcgtgccccagcaaaaccccactgtgggcagcagagaatgaggacttttgtcttttcctcaagtccccaccaaatgaaggtggccagcaactcactagtctttactcttgagctcactccccatcccctctcataactcacacctcggaggaggaggtttttcttccagtaactcaaaagccttcacatgccccacttagtccctgtgtgtcagagctgtcggggtcccctgggccgtttcccagcgtaggagggacaggtgggcagtaggcaggagtccaccccagctgtagcttcaggcgtcactcctgccgaccagcgtggggaggacccctgcagcgtgccccgcccccgcctgacgggtagacctttaacactggcttcatctctgggatacctgggaaggacctagagggtgaggtttgctggcatctactcagctcgcctgcagttctcagttgtttttccaacaacacaccagcctccggagtgagaagctggggacccctgggaacttgagggaagacacagctgccgtcccaccaagggctccaaggaaagcctaaaggggatgttctgaaaggggctcagccctcagcacagaaaacagcagccccccaaccctaggacagcactgtctagctgtgtccctgccccaccctagacctggccagcaacagccccaccaggcggtcctgagcatgcggagatccatccccattcccaccacagcgagttgcgggggggctacctaattcctcctggctcatcagcttgccagcagctcccctgacactcagcaccccctcttgtgttgctctgtcctccacgtggaagtcaaaggtgctggctggtcccagcatgatgactggtgcaagtgagtgaatgaaacagctgttccagcctctccctccccgctacccctccaggctctcacaagtcccatctcctccctgctccgggtggcgtacccaccctggatgtttcactccttctcatgccatccctgtctagagtgctcagactgacactggagcccagcgaggctcagctgtgcctgttacccgcagggacggctgctcccgccttgtcgtctggccgtccagccccagcggggcctgggagcgtctcccaaccctgccaagctgcgatatcctgacacagggatccgcgggactgcagtagatggagaaggcgtctctctggatgaaaggcaatgcttgtttctttaaggtgtgtgccatccggagtgtggtgacaaaggctgtgatggccccaatgcagaccagtgcttgaactgcgtccacttcagcctggggagtgtcaagaccagcaggtaatgcatgtcccgcagccctgtggctcaccactcagtgactttccagttgtatccttagcccctccatgtcctgatgccccagttaggaagtaacgtagcacccccaaacaatcatcacactgaagttaactgctttggagtttttaaatttttagtaacttggcattcctatcatgcaagtcatacatgtccattacggagaaattagaagctgttgcacgttggcgtccgtgcttataaagccttttctatctgtgttgttaaagagaagtgggtcatgttgggcgtgccaaggctgccccagagggcctggagacggatgcgattcaaggccctggtgctgtcctcacaggccagctcaggggacatggctcttggacaggctgaagcctgttgatggtctttctttcagtgtctctggactctggctgggtgtggggctttcacagaagctctcctggcacctccccagagagcccatgaggctgagtttaccccaagggaggatatcaggagctctgacctgggaccccacgtatatggccagttgcccggttcaggctgacccttctgtgatgagtgtgccctcctgtgtggcctctgcagtcaggccctgggctctgtccacggagctcctccagctcctggcatcaccactttctcagattctcttccctgccagtcctgcagctgccctgttgtccattctcatttcacaaacttccctgagcacccattatgccccgcatgtgccaggcctcagaggccacgatgacaggacactgctaggctccccaaaggcctgggtgacagatgcacccaccaaccactggtgcacacccatgagggctcaggcacgggtgcggccgtgcaaggtcaagccgggtgcccatgtggctctcgtggcgtcctcgagctcccagccacagcgcactcactggccaaagtgcaaaggctgtcaccctgctggcctcactcactgcccacaagactcactccctgagggcgcccgagagagggttttgccagagccgacagttccaaaagtcaaatacgaacctcacgatgcccttgggaaaccatgcgcaccctcaggaccttccagcggggccagctttgaaaagaaaggattcccaggttctatgcaaggcctccagcctctccacctgtgtacgtaggaacctcagaactgcactcaccaagacaaagggcatcatgtttgacattcactcctgaagccttcgtttcctcagaggaaacaaaggggcaggcctggggctggggctgggttggcaaggccctcaccctcctgcctttgctcctacaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtaagtggcttgtttgtgggtacaagaactgatgagccagccccaactttctgggcccgtgtcctctctccagggagaatttcccagccttctgcttccgtgtattttgttgttctgagtaaggactttgaacagggaaggaggcagagatgatgaaatcaaagcacccagacctgttagttaatagcacttccccacagacctggccaggagaagttccaagtgatgctgagagacatcctggctgtccagggaatttcacccacctgcaacagagtcaacgtccactactgagcaagggcagagaggtggctagggccagccactcttgaactcagtctgatttcaggtatcagaagaggaggtcctgctgtctgtgctgtaatttctcctccaggaaagactatgccatcggcttctctgtaacacaggatgtgtgcgctgggcgtgggtcagggcacatgggattggtggtcagagctgggggagagccctcctcggcagagctgcggagatgaaattgggagtcagatgtgggcggaaggtttgcagacctccagacatgaaaaggagctgctgaccaacgtcagttgggctcggaagggatgggtttgtctttgccgggcatttcacaggtggcaaccgcacccctgaacactagacaggcagtgttttcctcgtcctacagatggggaatcaaagctgagcaggggcaaaggccacaactagtcatgatggaggtgggactcggactcagagccgcaaggccaggtgtcttgctgtcccaggagggtgggggctggacaggagttgtaggcccaagaccccatgccatgttttcgtaattcgcctcgccctgggagacacaaaagcagggcttgggttaaattgacaggggatagttctcaaacacattaaagaagctaccgtttggcactcgtggtcttccaggtagcaggcctccccacggccctcctctctgggcccttactgctcaggatgggtcattgatccggcctgtcatggcactgccgttacccctgtggacaagacccagcaaatctttaaagacgtataaagccatcaaataacaagacacccccttttttttttttttttcgagatggagtctcactgtctcccaggctggagtgcagtggcatgatctcagctcactgcaccctctgcctcttgggttcaaggaattctcctaccacagcctcccgagtagctgggcttacaggcatgcgccatcacgcccggctaatttttttgtatttttagtagagatggggtttcaccatgttggtcaggctggtctgaaactcctgacctcaaatgatccatctgccttggcctcccaaagtgctgggattacaggtgtgagccacctcacccgtcccagactccctttagcggggaaacaaaaagtcatgcaagacacatttcacagcctttgcaaacgcttgccctgggctgccaaccagacctttgcaaaggacggaggcgccttcatccccacccccttcccaagggcacagttggccgcccttcttcaccccgacatcctcactcagcacctgctttatggcgtatgatgccacctgtgggggccctgagggggacacgtgcaggtgtggcaagcagctgttagctcccaggcccagagcaccccagccacttaggagtggtgcatggtggtgtttcatgaggcgccaacccagataataagttatgacattgcaggtgggagttggggtgacccagaacttccccaagaggcacgatgactcgccgtaggttcctgtctcaccatctagagcagccagatcttcatacataggtttccctgagaaagcaccgtggtgggcaagcggcagcctcaggctctccaccccccacctgcccacacccggccacgtttatgaagatttccacctcgttaaactctactcagcccaccaggaattggcctccatccctgttgaaataagcagaaccacctcagaggcctggtggttgtctgaggaccgtttttacctcagaaaggggaggtgagaattctgtgaccccacaccaggtacaagcggcctctggctgctttatttccacccattccggaggtggactcggggaacagcccacccgcacccccgctttgaaatgccgggggcctgcttgcccagatttcattcctgtcagtgtcgtcccttctcttttcttatctcgctatttttctccaggtcagaaaaattgccttaaatgccacccaagctgtaaaaagtgcgtggatgaacctgagaaatgtactgtctgtaaagaaggattcaggtaaaaccccctcgaaacctgaggaatgtcagggcggtggcgctgcttggagtgtgttatggatttaccacgttggtgcatttctcctaaaagctgaactgtcagaggcccaaagccattgagggtaaagattccgagtcctggaaatcgtgtgtccacttaggatggaaagggagaggatgggcggaatctctacattttacacaacatgggcgaattgggcaaagcagcacttgatcacatcacgtacagcacagggctgtgcccagatccgcctcctttcgctccagcacctccacctgctccagttcccctcgctgtctgggccggggatgggctgtagcggctcacccaccctctctcctctgcatccctcggtcttctctttttctcccagctcctgacatcttcacggcttcctgagggtgctctttacgttcctggttctccctgttcatcaggctcagccccataaagctcagcatgcattttctttaaaatcattctactgggttaatgattgttcttggaatattttgaaatgtttcttcagcccatttagtgcaaccaaactgcatttaatgcaatcaaatatacattacctgttcctccgaattgctgtctaaaatcttagaacattctgttcaaaattttttgggggacactcccatagtagggagactagcaccatggtccgcactggaaggatcacctcatgtccagatgcaggttctgatgcagcaggtctgggcagagcccacgactctgcatttccgcaggctggcagtggtgaggatgctgcggtccaggcagggagctgcttttgcagggtgaggcggtggagggctgcaacacacccccagccccgtctcccttctcaaatgctgtgaggactggaattctccatagaagaagtttcttttttggagtaaagaacaaaggaagaaaacttactgagcatatcttctcttattccaggggcttgcaccagtgttgcctcatttaatctttgcagcaacctgtgaagtagacataattcttactcgcattttacaaacaggggagatgaagtttccccaggaggcactatgctactgccttcatttccttcagcctgcctctttcttccagatcagagtactggggagaagaggaccccaagcagctaggagtccaggagagggaaggcaaagcaaggctcccaaagtcatgcatcacatctgctgtcatttaaacctgttggctggacaaggcaggattaggagtgaaaggatgaactggcccaggaaagggatcccccaaagataaaagagttggaagaggaaggaggcattccgctggtggcctgggagaggccagctttgatgtcccaggctctgcaggtcaggcagcccaggagtggatcctcaacccaggctggtagctgggggcatcaggaagaggaggctctgtgttcccagctccctggaacctgcctgtttcccagcagagaagtgctgaggggtccccgggaatgcatttatgcatcccgtcccatcctgtaggagagggaaatcggatactcaatgtaggaatggtgtgctaaagagaaaacgcctcctgtcggtagccccgccacatagaggcagtgcttccgtcactgacgagctttcagagaggcgtgcaaactccagacgcatcgccagccgtcagccacagagagcttccgtttattgcccaatatcctcttaagctgtgacttctaatcactgcagtcatgttaaagcagcaagagagcagccgagccgccgcctctggccctccatctcttcagggggatcaacacaggaaaggtttgcaggggagtgtcagttataaagacatgatttaactgccattcgcagtgggcatggcaccatgaagaggaagggcgccgggtgggtgtccgccatctatgcagaggagcttgccaacatacagacgtcttcctgctaaatgcaggtgtaagagataggaaaaaccagtgttttctcctactctcacacacaaaatacaacacacttcacctctggtagccaaaacgtgtgggtttttccccacacaccaagcagttctccagtgaaccgtaagatatacgtaataaatatatagctcaggctgaacgcagtggctcacgcctgtaatcccagcactttgggaggccgaggcaggcagatcacttgaggctaggagttcgaaaccagcctggccaacatggcgaaaccctgtctctactaaaaataaaaaaaatagccagacatggtggtgcacgcctgtaatctcagctactcgggaggctgaggcaggagaatcgcttgaacctgggaggcggaggttgcagtgagctgagatcgtgccactgcactcccacctgggtgacagaatgagatcctgtctcaaaaataaataaataataaataaataaatagctcaattctgacgctactagatgtgtcagatcctacaaattgagggctcagcccaagactgccccactttgatgtcaatcacgagtcccacatggtagcctgtgcttctgagtgaccagccataaatcggacttgccatgacccctccttgggttcgattaattggctaaagcagctcacagggaaagactttacttacatgtgcccatttattacaaaggatatggcacacagccagatgaagagatgcggagggtgaggtttggaagggttgagcgctggaccttccatccctatggggctgggctgggctaccctcccaggatgtggttgtgttcttgttcaccaccccagagctctccaaaccctgaccttttgggtttttatggaggttttgttacatagccatgattgattacatcattggccattggtgatcaattcagccttcagcccctctcacctcccaggagggaagtcagagtagtagggctaaaaattccaaagctctgatcaatggttggttccctggcagccagcccctgtctagaggctgcccaggaacccccagctatcagttattaaagacatttagcactttgataattccaagggttttaggagctgtgtgccaggacaaagaccgaacatatatttccttttttttttctttttctcttcacatatttcttattataaatcccagtgtcatagcaggagtctccgggtctgacagatgcaccccagagcccttgctcagtatggcaaacccatctagaacatgtacgtcacagactgtacacagtataatctcaggaactaaagagataatagtaggtgatattgattcacactgctgtgtgccagacactgaaatgtttatgggtattagctcattgagtcctccaagcaactttatgatgtagaaaccaattaacaggaagggaaacagatgtagaggggctggctggcttgcttggggtcgaacactgggaaggtggcagaagccatccacgtgggtggtctagctcagcatctgtgtctctgtccagcactcggctggctggagtgaagtgagggcacaaatggggcgaaagaggaaggtaggggctgcatctgacaggcctgctggggctccagagggcgtcttatttcaagttcattgcgaagctgcagaaggttccaaggtttcaagcaagagaggcaagagcgggttggggttcagggccagccttgtagccgacagccccgtcacacgccataaatgccaacacttcaagagggacttgacactgagactgagctagcgtgccaccagtgatgacccacacagctccacttctcttcatggggtttggattcgagttggagaaatgacagtaagaaaaagctatcactgggtcaaggacggagcctggcgcctgctgcctggtgatgggagctttgcttcccagggccttgtaccccttcctgctgggcccccagcggactgcgggatggctttcccgactttccttagctgagaactttcggtgacacaaagaactgtgcctcagccacttacatctcctcttgggaaaggtgctagagggcaagtcataattagacttttggaatggatgtggaaatctgcctctttcttttcaacagccttgcacggggcagctgcattcctgactgtgagccaggcacctactttgactcagagctgatcagatgtggggaatgccatcacacctgcggaacctgcgtgggtgagttcaccgcctgcggaggcctcgggccagcgtcacccaagcgtaggctagctgccttgaacccgagaaagccctaggacttcgtgggcttctgcatttattgcagcattaaaatgcaagggcaaaacaaggtacaaaggccctaccagggactgggggccgggagagtggggatttaatgtttaatggttacagagtctcaacttgagaaatgacaattgttctaaggatagatgctggcaatggttacataacagtgtgaatgtacttaatgctgctgaactgtgtacttaaaaatggctgagatggtagattttatgtacattgcagtggctcatgcctataaccccagcacttagagaggcagagatgggaggacagctcgagcccaggaactcaggaccagcctgggcagcaaagctgtgagaccccgttctccacaaaaggaaaacgttttgttggaaattttttttaaaaccatgtttttaaatttgaaacaaaatcccaaaacaatgcaaaggcccactttgaacacgcagcctgaggttctcattagaaacccagccaggcagtggcttatttcagatggggaaagggataagagatgctcaccactcataagccatcttgtctcagagctcagctcttgctgtggaacggcgcggacagaaacacaacaccataaacattgagagggctttgggagaggcgggaatggatccaggtggggatggggatgttttcaaacatagccttagttctttgtgcctatcttcacttattttgaacattttttcaaagaggaaaagaattctataaacaattttacatgtattataattgcccacaaagatgatggcacagatgtctcccaggcacagtttttatgcagaatagcagagaattcattcattttattggattttgttttgcagagctatttgcacagtaagttgaagtgcaccatcagtctgtgggctcggatatgttttgggttaagttttctcctctctccttcctgtccttggtactttggtcctttctaagaaactcacatcatatgagctttttctgcagtaatactttaagaattaagtctctactggccgggcacagtggttcatgcctgtaatcccggcactttgggaggccaaggcgggtggatcacctgaggtcaggagttcaagaccagcctggccaacatggtgaaaccccatctctactaaaaatacaaaaattagccaggtttggtggcaggcgcctgtaatcccagctactggggaggttgagacatgaaaattgcttgaaaccgggaggtggaggttgcaaggagctgagatcacacccctacatacttcagcctgggcgacagagtaagactctgtcaaaaaaaaaaaaaaaaaaacagaattaagtctctgctaaaccagtttccatgatactactgtgcctcagaaatcctgcagaatgggcacacccctccccacgtggccggccatgagcaccccatgcagctccctgccgtatgtcctggaatagacaggcctgatgaacaaggctgtggccaaggccagtgtcctcctatgattgccaggctgacctcagaccacccaggggagacatgtcctcctcagttccctcctggggcagccctcaaggccacagtgctcagcatctggatgggttccacccgctggcagctcagcagatttccccagcagtttgcctgtcgcctttttgtctattatttttattatttctttgacttatttagcccagatggattaggcagcatcactgatgttgcttatttaaatttcgtagtcacttgaatccataacattcaggcatacagttttgcaactctttgatttcaataattcacttttctttctttgagtccccagattgcctgatggcaaaaagctttatagagtcccttggaattctcatctcaaaccagtgacttctccatcacttcagctattaaattcattggtgagcaggtccacagctctgggggtctcccctgcgccccatgccctctggcctggggttctttctaagctcctgggaacgtgtacatctatcccctggcagcctcttgggagagagacctcattttcctcctctgagtcactggaggcttcttgttccatgtcaggtgtggacctcattggaggcagctgttctcagctgcctacttcctgtgccctggagacccaggcccacctggcattcccctccctgttcccattcagtgaccactgctgtccaccacccacccaggggcctgggcacagtcgtggggagggtcggagtcaggcatgagtgcttggggtagggcatggcggaatctgtccccacccttggctcacagtgccccagtgcacttggcaggcaactcgatcgagatgagcctctcatcctcctgagtccaggtgccccgtgtgtcctggcatggaggttgtaatccttcggggctgctggcacagctgggttaatgcagtggccccgtgggacgcgacttacccacctggggcatggcatgtggattagcagctgacagcctgcagggcacacacataccaagttgcggggcagtgccccaagcacctgtgacggtcagccctcaagcatgagcgtcctgtgcctgagacggcactacttgaaacagcaaatgagaaacaccacaacagaccaagagagattcaaaagaaaggaaaacgctttctgttttagtccctgtcgtggcacattcttccagctttctgaacaaaggctccatgttttcactttatactgggccccgcaaacaacatagcaggtcctgtataagcacagcccgttctgctcttattgctatgattgtgggtgcttttaaagtgttcaaagtctatagagacttgcgacttaatggaatccttaaaagactttcactgagttatgaaattcatattttttagtagttgagaaaataggtcgcttagaaaatcaacccactttaacagcttttttattgcggtaaaatacacatcacataaaatgtaccatcttgactatttttaggcatacagttcggtggcattaagtgaatttacatttgtgtgccaccatcgccaccacctccaaataaatgtgttttaacaactttgaagcttaatacattgagcatgaaacttaagtacaaacaagaatgagctttctttcccacttgggaggctccacaggtgttaaggaccctggtgctggaggaaggatagtggggaagacgggttcagcaggtgaggcgtgagaggtacaacggcaggccctgaacagctcccaaaccccactcagagtggcaccccgcctggtgtatgagacccacccaccagatgctcccagagaccagtgatggggaggggcggcattggccaaagcatacgagcagcctctgctccagaacaacataaaccagacagagtcccgcccccggggcacagctcttccaccgcacctcaggaagagagggagacacctgccatgaagacggtggtcctcaagaggccccttgaggtccctacatctgcctcctgctcaaaaccctgtggccttctcggcttcactcttcctgactctccaaggaggagcttctcctgcaggagctcagaattccctcccaggcttacggctgtggttctgaggtgtgaagccagccccagagcccagggccttgtgcttgagccctccaggctccggaacctctgcaaagggattttcccttgatgcagcgagaggccccatctgagtccagagcagactgcaaggcctcgatctgcgaccacaatcgaactgaagcagctgtgaggaggtttacctgggcattgtgattatcatagagcccctgagataatctcctccctgcctgtaaccctctccgctgtcagtcagtgactacttcactgcccctctctgacgtcccatcagttgctccctggagacacctggcccagaggaggtgctatctagtcaactagtccaacatctgacccaggtcgacaggtcctcctcggaccctgagccaacctgaaggttttcctccatgactcgtggccctttgctcagaactgttgtgtcttcgagtctctcctccctgccctataaacccttagtcttaggcatttgtttctctgttgttgaaaacgccctggctgtacacaccaaacacctgtcaacaccattcccaaagatctcttctttcatcttcccccgtcatcttctacagcgttctgtgcaatggaagggccacaaacgcaagccacgggtgcaatttgaagttgcctagtaaccatatcttaaacagtcaaatgaaacaggcaaaaataattttagtaacatatcctattcaacctaatgtgtctaaaatattgccatttcaacatgtatccatacaaaaaataaatgagctgttttatattttttatatgaagactttggcactggatttccaagtgttcagggagcagaggtgggcctaggcctgttggaaacagggcccatcatcgtggcacggccagtgggcaggtgtgctccctctgagatcatctcatgcctcgatgtccccgtctgtgaaatggtgatggcgatgcccacctcctgggagtgggtgaggacggcccagctcacagaacctgggaaatggcagctgtggtggtggcctgggggctcctgaatggtacccctgatctcacaaggccctgaagcaggcctggggcatggtcttctgccagccatccctgatacctgcttcttttcctgtgtctctcagggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcagctgtgtccagcaaaggagtgcctggagggcagagtctggcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaaaaaatttttttggagacacactctcactctgtcgcccaggctggagtgcactggtgtgacctcagctcactgcaacctctgcctctgggattcaagcaactctcatgcctcagcctcccgagtagctgggactacaggcgtgcaccacaatgcccagctaatttttgtttttgttttcgttttttttgagatggagtctcgcctgtcgcccaggctggagcgcagtgggcgatctcggctcattgcaagctccgcctcccagattcacaccattctcctgcctcaacctgccgagtagctgggactacaggcacccgccaccactccccactaattgtttgtatttttaatagagaccgggtttcaccacgttggccaggctggtctcgaactcctggcctcaagtgatccacccacctcagcctcccaaagtgctgggattacgggtgtgagccaccacacctggcctaaaatattttttttagttagatacttagagaaattaaaaagatcctgacaatttcctcattctaaagctgttctctgcacagtccacgtacatctattttcaccctccatatcctcctcttgtgcttcctcccatgtgtccctccacagagtcaccattcttatttgatggccctggacccttctgttgttggacatgagctgttaaaggaggagctgtttgctctggtctcctcttttctggctgaatattgccctatgttgggagatcatgaactcaggacccagaacagggcagggcaacctgtcttattcagggtgggagcaacattgaggagtttgaagggacctgtgagggtgtgacgatggggtgagctgtgaggggtgacgatggggtgggctgtgaggggtgacgatggggtgggctgtgaggggtgacgatggggtgggctgtgagggtgtgacgatggggtgggctgtgaggggtgacgatggggtgggctgtgagggtgtgacgatggggtgggctgtgaggggtgacgatggggtgggctgtgaggggtgacgatggggtgggctgtgaggggtgacgatggggtgggctgtgaggggtgacgatggggtgggctgtgaggggtgacgatggggtgggctgtgagggtgtgacgatggggtgggctgtgaggggtgacgatggggtgggctgtgaggggtgacgatggggtgggctgtgaggggtgacgatggggtgagctgtgaggggtgatgatggggtgagctgtgaggggtgacgatggggtgggctgtgaggggtgatgatggggcgggctgtgagggtgtaatgatggggtgagctgtgagggtgtgatgatgtggtgggctgtcaggcaagtaccaggcgtcagctctgcttctnnnnnnnnnnnnnnnnnnnngtgggctgtgagggaagtaccaggcgttagcctgctttcacagtgctaaaaagaaatacctgaggttgggtgatttataaagaaaagaggttgaattggctcacagttctgtaggcttcataggaaacatggcgccagcttctgcccagcgtcttcactcctgatggcaggtgaagcaagggcagcacatcacatggcaatagcaggagcaagagagggaaggaggccgggcacggtggctcacgcctgtaatcccagcactttgggaggccaaggtgggcggatcacctgaggccaggagttcaagaccagcctggccaacatggcaaaaccccttctctactaaaaaaaaaaaaaaaaaaaaatgcaaaaattagttggacgtggtagtgtgtgcctgtaatcccagtcttacaggaggctgaggcaggagaatcgcttgaaccaaggaggcggaggttgcagtgagctatgatcgcaccatgcactccagcatgagcgacagagcaagactccatctcaaaagaaaaaaaaaagtcaggagttgccacacacctttaaacaagcagctctcacatgaactcactcatcaccaaggggatggtgtgaggccatttatgagggatccaccccatgatccaaacacctcccaccaggccccacctccaacactggggatcacatctcatcatgacacttggaggggacaaatgttcaaaccatatcggggggcttccgtctgaaaaagactgaaaatgagggagccctcaaaggcttgtgtcagagcaggggaggggtgcccatggctggctgccagctgggtaccgattcaccacacagtggggtctgcctcccaggctgtgtgtaagaaccactgtgggttgtaacctattcccctagaaacaaagccctacagtgagcccatgagggaccaccaagcccttgcacttgtctgacccacagcagagggacctggtggcggttacgtatctcggcaagcatcagccccttctactgcgttgctgtaatggaggaaacttgccacccgcttgcaaggtgcagccttgctgagtcctgcacggggccctgggcacagttgtctgaagttaaacccttcatggtaaccagtcagctggttctcagataattaaatatagcaatccagggagaacttggaattaaacagtgataatcactttcatttgtcaaatgccctggatttcagggcatgctgatcatgcccacagctgtgcaactggacccctgcaggcagccccaccgcaaacctctctttgcccctcaggaggcagcaggcgggcagccccaccgcaaacctctctttgggcagtggaggacaggagtttcctgggtacttgttcccaggtgaggggcagctttcggccctgcagaggctgacagtgctggggctgacacaccgggtcttggagaagcaccccccaggaagagcgtcagtgtggacgcctcccaaaggaagcaaggccttggtccgattggttctgcggggtctctccccacttggacagcctgagctgagaaccacaggcatcctccaggccccagaatgctggtggacgccgtggccgtccgctgctgctgtgccaggcagctccgagggagcatgtggccagacgggctgcgttggaacatgcaggtcaggacgcaggcctgctgggttggcaactgcaggtggaagccgaggcccgacgctgagaacaatgcctgataagttccctaagagaggggccgaggcccgacgctgagaacaatgcacgataagttccctaagagaggggccggacaccctcaagacctagtgagaggacccagcaagagccagcctggacaacttggaagaaaaacaggcctctgtggagtgcttgccagcgggggaggcaaactcctcatgccctggccctgcctccacttgcccccaggctcagcgggggcagagactcccaggggcacagcttgaaggggcacgccttctgccaatgcgcatgctgcgtccaggctggagcatgaaagcgtcagtcttctgcatcccactcctgaacaggcaggaggctgatgggagtggcctctgcaagggagcagggacagagggctgcatccggcatccctgtccttccagaatgtggcagggcaaagcggccatggtgtttgggggaaaagtaggtaccatagatggttgcagaaccagaagcatcttaaaagccaccctgcccaaagctggtgctgcccacgaggacccgctgctgggcacggtaatcctgacggaaagcaggagctacacagggtctcccagggagagccgtctgcactggcctaacggggacgggagcatcacccatctccctgagcagcatggtgatggattatttccccagacctccagaggagagcccagcctggccaccaccttgccctgaacctcgtgagaccctaggtggagagcccagctgcacctgcctggacttctgcctgcatagcggggagccgctgagtgggtgttattttcagctgctgagtgtgtggcaacctggttagagcaatggaaaaccgaggcccctgccatcctgctgagctgggtgaggttgtatttgaagaagcaagcaagccgtaacctcctggctgtccaccgcagcgcgctcctcaccacagttcttcactgatgaagcagccctcagccgtggcctgggggcactgggcccctgggtcctccagaccactgacatctctttaaatgactcagctcggccctggttctcgtctcaccagtggcattgtctgtaagagaaaccagagggtctgtggggaaagtcataacctgtactggggcatcagggtttggtggctgggccaccagaatgtgcaagggcaggtgtggggagggggcagcatgatgggggcagacccatggggcttcccacaagtgcacaaccccctctggcaagtcctctaaccccatcctttcctctggggcggcctggatgggaatattagaaaggctcgtgggtgtgagtttgcctgtggggtttacacatttacaattacagaccaagggcttgagctctaggctcagcatcctcagacacactaggaataaaacccacctcccacccaggctgaagcgatgctgcacctggggctccagagcagcggagtccgtggtgagaccagaccccatcagagggctgctctgcaaagagccccacgaggaggcctggtgtctgagcgtgggaaggcttcacacagcagggaggggacatctgtataaagcaaagaactgccccccagggaggcccaggcatgagcacaacaaagctccaagccctgcctatggggcctgttccacccttaactggcaacaatggggaggtgggcagctgatgcaagcactgtggagaccgagtcaccgggctctggactcaggacaggcagcagcatagccggggtgcactcacggccccaggatgggaaacgtgctccttcaagcactcggcccgcatcggcaagtgctttctgtagagggcacaatggtcagtcgttcaggcttttggggccacactgcctctgtcacagctactcagctcagccactgctacacaaaagattgtcaatgaatgagtgtgactgtggtccaggataaatgctggatgtggcccttgggctgtagtgcaccaaccgtcccctgaggtcacgtttaccctgcattagaaatagccctggctggtgtccatctctgcgcaggctgggccaggaccgtccgagaggggcaggaattgtggggcatctctcccactccccgagggtaagcaggcatggccacatataggtgacagcagccttctggtcagctcgagtcaggtgtgtcacatccctgggtggagtctggcctggaccccaagcctacagccatcgcagcccggcagccgctggagagagaagactgacacagctctgggagccgtgtggtggggtgggggctgggtgccagggcccaggagggtgtccaggtgagctgcgggaagcctcggaggcctggcccctgatcctgggcttgctcctgccaactggccatggctgtctctgccctcccagggcaatagtgaggtcagacaggagaaaagacatgcagacactcagcccctgtgtcagggaatggtgggcgacacagcctctccacagaggaccgaggctgagggggtgggaaggaggtgcagggaggtgagggttctgggaagggagcccggagtggtggagcctcttccccagacttcagcaggaacggtatcttcccacaggtgtgacgagaactgcttgagctgtgcaggctccagcaggaactgtagcaggtgtaagacgggcttcacacagctggggacctcctgcatcaccaaccacacgtgcagcaacggtgagcagcagctgggttaccctggggctgcctgtggaggagctcagctggccagctcgtgctccaaagagaaaagcaaagccacataggcatggcggctccacagacaggcgttcgtgcccctgatccgattgactgtctgggattcctctagctgatatggaagacagctgccctgtctcccagcttccctctaggcctctcacatcgatcagagaggcatcccagccactgctgatctgtttattgagtgactcctaaaaatgattttgtccttgtactggtcccactgccatgccataggccgccggtggcccggatgtgacgacataccataaaagaagcctgacctggggggtcaaagccaggaagcctggagggtctctgctcaggacgagggggacagagcccagagtagagcacacgctcagcagcagcaatcccagctctgcagggatccagcatggacctgcatctgtgctgcaggagagccctggctctgccataggatgggggacaaggacaagttgtaaaaacagaaacttaaaagggcaccaaagctaagtgcccagtttgggaattccaggcaccaaggagggttggcaggactcgggcctggaggtgcagtgcaggagtcattgtagacacacgggcagggaagggggctctggcccagcaagcagcagggtggagccacattctgacagccaggagaggaaggctctctgctccagtgtccagggtcagggcaggtggtccttgggtatgaagctggcactggccctgtccaggcagagcatggagcttgtggagggccctgggatgcctccttgccttgttactggttattatttttggggggtggcgggagggttgtctaattatgtcccttcaaaggcccagaaactacttctttgggaagtcacctgcccaggttatgtatctagcccaaaaaagtgtggttgccactggagggcctcccaggtccacggatgatgcatcctcaaaggcctcttccccttgctgcagcggtgtcctcagcaagtcctgtccacggcggctcccttccccccatccccactcctccctgtccgccccctccaccctggaagcagcttccattccctcctgcctccaggcccgtcctccggcctcccctacagtcttcctcctaagctccactgccagcagttgtccagaaagacaggtgcacatgtgccccacaggcccaggctgggtgttctcctgagatccctcccacaccacccccacatcctgctcatgaatccccttgtcactgagactcagcaagagccccatataccagtgccctcccgccacacagggctcccagagtcaagtgcattgcaggagaggggcttcaagggctgccatcctgctgcccacctctgtctgtgtccctcttgcccagggcaccactgatgcccagcatatgtggaatgattgaaacaatatttatttatgtatttatttatttatttttgagacggagttttgttcttcttgcccaggctggagtgcagtggcatgatctcagctcactgcaacctctgcctcctgggttcaggtggttctcctgctttagcctcccgagtagcttggattacaggtgcccaccaccatgcccagctaatttttatattattagtagagacggggtttcaccatgttggttagactggtctcaagctcctgacctcaggtgatccacccacctcggcctcccaaagtgctgggattacaggcatgaggcaccgcgcccggccttgaaacaatcttcacaggcaccgaagactgacctttccctcttttgcctttcctgatgcggggccccagctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcacaggagcctgtatttctttccacggcacacaaaatgaaacatgagtgctgaccaagtgttaagtggacgttactttaactgtggtttcagatctgtttgatgtcattacgtggaaggtcttcttttgagctttagcaaatgttgatgtaaggaagcaatggaggaaatcccagatcccaaccccagaatgtcactgggcaaagagaccccttcagaccacgttagcctcactgggaggaggttctagagcctctccagatgtaggggccccttccatctgtcacgggggagctccccagagcccagactgcctcttcaccggttgctgccaagtgtgattgaattaggttacagcttgtcttctatgcagtggctgaaatccctgaacccatggctgatgcactccttgggatgtttaccatggcctctctgtgaagtcagaagcttgtacttgctaggaatcctttggctgcaagtaaaggaaacgcaccaactagaaatgacttaggtgaaaacaagagtgggtgaggggcgttgttttgagaatccagagtggattcagaatttcagggaggggtgcagcagagccttgggaaagctggagccggcattaaatgtcacctggaccctctctgtacggcagcactgcccttctctccatggccgccttctccagttgatgggacaaatgacaagacctccagcatcttccaggtaaaactggtacaaatccaacccctcaggccaactttctgggtctgtttcttggctcttcttttcccagggacaggacttggtcagcctgccttacatgggtactctccctgtgtcatcagctgtggctacaaggacaggcttgtgcagcagaatatggctgcagggagctctgcagcagaggaggggagcagtgtgcagctctcagaaggcagggcaagtcacacaacccaacagctggccaccacaagcaccaattgaccagagttgtgcgtgtgaggcagtgaaggaataagtgtgtttgggatgaacattcaaccccttgccccgcccatgagaccgaccttgaattaaaagtaacttgttaagtgctgctggtgccaggcagccttttagaccctagagcccagataccagcaaatccgagctgcccactgagagcttacagtctaccatgtttgcagctgaatcagaaataaactcctggccgggcatggtggctcacacctgtaatcccagcattttgggaggccgaggcaggcggatcacctgaggtcaggagttcgagaccagcctggccaacacagtgaaaccccatctctactaaaaatacaaaaattagccatgcgtggtggtgacacctgtaatcccagctactcgggaggctgaggcaggagaatcgcttgaacccaggaggtgaagctgcagtgagccaagattgcaccactgtactccagcctgggcaacaagaacgaagctgcgtctcaaaaaaaaaaaaaaaaaaaaagggaagaaactccctttatctcccaaagggagatacaactacaggaaagccaaccaggcagcctcgtcgagtggctaagccaggcaagcccagcttggggctgacaagtcgggtggggagttgagaagttgttcacaaagtcctaatgactaaactccaccttgttgaaagagaccaactacatataatgtctgctcacaagtggtccgaccttgaggttaaaattgtctggactctggcaggatatgtgtatggattttaagtgacaggatcatggatcacctcctctaaacctgtcatttcccagacaaggacactgagacccacagaagtgaatgccttgcctggggctgcacattggcaaagttgctccccaccgggcccagggaaggaagctggctggctgcaggaggggcgtcgttctgcagctgcccaaatgcagccatgatgcatttgttttaaactagctttattttcagggggtgatgtttacctgaccttatccccaaattctttggcacctcacagtggaccccatgtgtacatccccatccctcccaggccactactgactttgtatcttgcgactcttcaaaggactggtgagaatggcactttgtacagaagacacacctgaaatgggagggggggtggacagaacttaaaaaaataaaagggccagccacagtggctcacacctgtaatcctaacattctgagaggttagaagcaagaggatggcttgagcccaggcatttgcagccagcctgagaaatagagcgagaccctgtctcaatcaatcaatcaaaaacgacagagatagatagatagatgatagattgatagatgatagatagatagatagatagatagatagatagatagatagcaacatggtctaaatgagtctaggagtggagtgtccttgaacttggggagaccaccctccactgcatttgcattattgatactatggctggagagggccttttgcctaaaagcttggagtatgttggggcccccgagagcaggtgagggccagaggttcagatcagaggatggaaaaaggaggtggagaacaggaaagaaaaacattttaataagaacaagcaggggtgatggaaagtatacaccaaggccattctctagcatcttaaggttctgcccagccagctgggaggccactgggcactggctgctggggggaaaggaagaatctgctcccctaccccagccttcactgttgctttcctcgcacgaaccccagactctatccttcctggttggctgtttaagtcctttcctgacaccccaggctttgtggcttatctgagcacagaacagcatccttagatggtacagcactgagcacccaccttagatcctaggattcagtcccaccatccaaagcccctcaccactacagaccagccacactaagggtgaccagatatcttagactcccttttgaaacaacaggaaccaaagtgcccagggcagagaacatcctgttgccaaaatagtggttctcaaccagggatgacttttgtcttccaggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccggccaaaagaaatggaatcaaaaaagaaaattgtttgcaacttcatagagataccctcaatgaataaaaccacatatggtttgacttctgtccctgttcctatgctgaagggaaacttgtacaactttccctttttaaagtaaagagataccaccccactcttttttttttttaaacacagcaacagaagggccccaagttaaaaccagctctccagcctaaggactccacctggtggtcctctctggaattaaatgaagttgaggttttattttgtttaattttttcattattcagttattttgtttaacatttttagttattttgtttaaatttttagttattttaacttttaagttattttatttcttagttattttaacttgttattttaatttttttagttattttaactttttaaagttattttaattctttagttattttgtttaacttttttagtttttttagttaaacaaaagttgcagtgaccggggcaggtgtgatggctcaggcctgtaatcccagcactttgggaggccgaggcagggacagggggcaggggaaatcacttcttaggtcaggagctcaagaccagcctggcaaacatgacaaaaccccgtctctactaaaaatataaaaatcagccaggcatggtggcgagcgcctgtaatcccagctacttgagaggctgaggcacgagaatcacttgaacctcatgttattcctcatgaggcggaggttgcagtgagccgagattccgccactgtactccagcctgggcaacagagcgagactccatctcagaaaacaaagaagttccaagtacaatacaaagaaattccctcccaatttgagagtaagttgccgatataccctatgaccgccccccccccgccaatacttcagtgggtatttcctatgaacaacgacattctccggcacagccatcagactcaggaaattaacatcggtatgttattaccatcaaccctctgactgaattctagttctgccagttgtcccaataaagttcttagcaaaatggtctggtttagaaacacacttttcacttagtcatcatgtctctttaatgttcttccatctggaacagttcctcagtctccttgcctcatgatgtggaagcttttaaagactataggccagttatttgtaggctgcccttcgctgtgcacttgtctgagggttcctcacgttttgagtcaagtcatgcatctttgacacgaatctcacaggctgattctgtgttctgtctgcattctagcagggagtacacgatctgttccattattggtgatgttaacgatcattggttagagttttcttccgggctatgaagtgatgcctgccaaagcatatccactaccaccgctgttcaacattgtgctaaagatcccagccagtgtaacagggcaaaaaatacagaaccagtataataattggaaaggaggaaataaaactatcttttttttttttttttttttttttttttgagaccgagtctcactctgttgcccaggctggagtgcaatggcatgatcttcactcactgcaacctccgcctccctgattcaagtgattctcgtgcctcagcctcccaagtagctgggattacaggtacgtgccaccacacccggctaatttttgtatttttagtagaggcggggtttcaccatgttggccaggctggtctcaaactcctgacctcaggtgacccacccacctcagcctcccatagtgctgggattacaggcgtgagccaccacgcccagccaactatcattattctcaaatagcatggttatgtatgtagaaaatccacaagaatggttacagataaacttaagtaaatttcacaagatcgctggatgtaacgccaatatacaaaaatctgctgtatttaaatatatcaaactaatgattagaaaatggagtttttaaacaaaaggtactatttacagtagcatcaaaatctatcaaatatctagacaatctagtaaaggatatacaaggccttgacacaaaatctgcaggatgctgctgaaattaaagagtgcctcaataaatgtagggctataatatgcccattgattggaatacttcatattgtaaagatattaattctctccaaattcttctacagatccaacacactacaaatcaaatcatgggtgctttttcacatatatctataatttatgttcacatgcaaaggattagaataatcagataactactagataatctgagaaaaaaatgggagctttttttgagggacaaataccaagtctttttctaaagcttgtattctgcaaggatagctgactaaacccatggaaaagaacagctagttcagaagcagaggccctcacatatttggacacttgatttttgaaaagagctgctctgcagagcagtgggggagaagatggtcttttcaataaatggtgctgggtccaccaaatatccatatggggaaaaatatatcttcttccctaccttagactatgcacaaaaatctaggccagagagactgcagatctaaatggacaaggtggaagaagaaagcttttagaagaaaatataattttggagtaggcaaaagtttctcacagcgtactcgaaaactattagctgtatagggaacggttcataaatcagactgtattaaaatgaagaacctctattcatcaaaagataccattaagagagtgaaaacccaagccacagggggaagatactcactacagacatagctcacaaggttcctattgaaaaaatataaagagctcctacaaatcagtttaaaaataaagcccaatagaaaaatgggcaaaacacctaagcagacacttcattaaagaggttatccaaacaaacataaatatattttttaaagttctcaattgtgttagtaattagggaaatacagttaaaaccacaatttcataccattacctatctaccagaatggctaagattaaaaagacaatactaaacgttagcaaggagtttaagttggcaaccactttggaaaactatgtcctacttaagctgaacataagtaagccctatgacccagtaattccatccctgggagtatatcagtatatgtgttcacataaagatatatattattgagtttgtaggtacactatttataatataaaagagtgaaaattacccaaatgttcatcaacagcagaatggataagtaaattgtaaaacatccacaatgaaataccatattacagtgagaatagattaactacatctacacacaaacataatgtttagcaaaaaatatgcaaggtacttcatttgcataaatacaaaactagataaagcaaatctatacaagatggcaggataatggttacccttggggcaagggtggtgactagatgaagacaggaggagggcttctggaatgtggcaatgtcctgttcttacgaggatgctagttggttgggtgtgttcagtttgcattcttctatatgtatatcatacttcaataaaagttcaaggagaatcatctccgggtggattgcagaactaaatgtgaaaagcaaaacaatcgtctagtagaccacataggaaaatatgatgggggtaagggaagatttcctaaggcacatgcacatgcacacacacccaatccactaacctaaagaaaataattgaactacataaaacttggaaacttctcagccaggcgaggcggctcacgcctgtaatcccagcactgtgggagtctgaggcaggtggatcacttgagctcaggagttggagaccagcctgggccacatatcaaaaccttgtctctacaaaaaatacaaaagttagccaggcctgttgacctgtgcctatagtcccggctatttgggaggctgaggtgggaggatctcttgagcctgagaggtcaaggctgcagtgagtcctgatggcaccactgcactccggcctaggtgacagagtgagaccctgtttaaaaaaaaaaaaaaaaaaaaaaaaaaaaaatctaatcatcaacaccattaagagtgaaaaggcaagccacagagtgtgttcatatccctaatatataaagaaattccacaaatcaataagaaaaaaggcagacaactccataaggaaaaaaaaaaaatgagccagggactcgaaagaacacttaaccaaggaagctatcagaatgggcaccatacacatgagaaggttctcagcttcattagttattagagaaaagcaaagcaaagcagtagtgcaataccaccacacacccatcagaatagctgaagttatagagttaaaatgccaagaaggctgaagctggaagccatgaaaacccttacacaccgctggagtgtgtatattatttcagcctcttagcataactgttgggcattacttattgatgatagatataccctatgtcccagcagtcccactccaggacaaactcatgcaaacgtgcatcagaaccacgtaccagaaaattcatagtagcattactcagaatagccctaactgaaaacaactttgatgtctatcaacagcagaataagtaatttatggtataatatatacaatggaattctcttcagcagcaaaagcaaacaaaccatctctgtatgcaacctggatggactccagacataatatagactccatgaaactaggccaaaaaaaaaagcatactgcatgattctatttatagcaaaagcaagcaaaccgaatttgtagtgttgagttcgcggttgccttttgggaaagagggaggctttcagaatagcggtgttttggatcccggtgtcggctacgcagctgtgttcactctggtcattaatcactgtaaattcctgatatgcacacttttatgtatatcacatttcatacatatgaatattcagaagtctaaaggtcacaagcttaaccgcaaaccctaccgtgcccgaggccgggctggacttgcggggcggtggggttgtcccggcgacctgccccaggcgggccacctagcccgggatctcacactgtagcccggagccaaggcccaggcccggggcgggcacctgaactgctggacccttcactgaaccccacgggttcccgcgacggctggtggagggaggacagtcaccgcttcccctcccacctcgaggtgcgctaatgcatgagaaagttcccctcgggtgtttccacattcgccttaacttttaaacaccaacgtctggaatcaggggtcctccagactccgaaacacaccctaggaaacaacccagaacgagacacatcccctgtgcgcgcgccacgacttccggcaagaacgcccccggaggcgtggctcttcgattgcttcggcctggcggtcgagctgcgcgcgcactcggcggctgcgattggtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccggggtgagtccgggggcgtgggcggccagtccccaggcggcaccgagccgccttattttccgcgctttgccgcgtgcaccgaaggccggagcttggcccgcgggccggttgtctgggctccgaccgggctgcgcagggaacgccgggcctgattcttgccgttgttgccagatgagcatccggttaagctcctgggagccttctgttagcgccgtgcctcttgacaggcacgggtgacttcattacttcctggtgcgtcctcgtggggccctgttaggccttgcttggctgtttcgccgctggctgtttgagggcccggaagagcggctcattaatggttgtaacgcaagtgcagggcgcgggattggttcttaatacttgccgccagatgatattttgagcgtagataggatatgtgttcattattcctaatgtgagggaggaaactaagtccccgaacaaccgcgattgtttcctccagtattttctacttagtagctttaattgtctggcgtttcccctatatgaagacgttttaaaaattgaactgtgtcacccaggcttgcaccgccgggtgctgtgtgtaagttgtggaagcgctcgcaattattcagattcctgtactatttcaaccttagcaagacttggtaagatactgggagggcagctagctagttggcatttcaggagacggctttaaaagggacgtgatagagcaacttctctgaggataagaccatgctgtcgtagcctgagatttgttcccatggggacctatggcctcggagcagcatcgctgcgggatctgcttagatttcttgccgacctttgggaaatcccactgttttgtgttgtgttgtgttgagatggagtctcgctctttccgccccagctggagcgcagtggcgtgatctcggctcactgcaaccgccgcctccccggttcaggtgattcctgtgtctcaagcctcccgagtagctgggaatacaggcatgcgccaccacgcccggctaattttttgtatttttagtaaagacatggtttctccatgttggtcaggctggtctcgaactcccgacctcaggtgatccgcccgccttggtctcccgaagtgctgggattacaggcttgagccactgcgcccggcccaactcaccacttttgatgatctctgccatttctctttatggagcatgtgcagtgttgagaatacgtattttgatgcagtacgtgtagtacagctctgaattgtgtcctttaactttgggtaagttctttttttagtagaccttgcttcttcggaatatttcttttcttatagtgcctaacacaataattatgcccaaattagacaaattaacatttgagtgttcacagatttattactgtatttaaaccattgatcttcaattctgaattggagctgggggaggggagggagaactgtcgtgatatgttgaggctgttctgatgggttctaagaatctggcctgtggagatgcaagagtggagaactgtcgtccacaatgtttgaacgccgtttgggcactgagactaagcagctccaagtgtaaactcctgttgtgccgattccgcttaactagcccaaacgacttaggacagtgtgaggcaccttgtaaatgttcttataaatgttagctgcctatatcagccattgttattgtccttgtccttgttgtcatcagattctaagcttcatggcactggggacttgagactcgttcagcgttttctctctagtatcttaaacagcggcaagtcatgcgtgacccgacataggtgctaggtaatacttcctgaataaatcaaagcctggagtcagatactatgaaatacagctaatgctttaaggggcaactgtttagttatattaatacctcttgtgtttttttcctccattttatagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatggtacgtgtctgtaggggaaagtaattttttcccctagagtaaatgttgcagtgtttcctgaagaagttgtagcacgtgctactggttaaacctacatgtttctttttctttttctttttcttttttatttatattttgaaaaaatattttttccataatggaagccacattcaatacatgttttttcttaaaatgagaaatgaacttcacttttcctatagagatccagagattaacctggcattagtctagtcttacttgtatctgttcagaaatcatgtatttttattttcatggttaagtttctaaataaaaacatgttgctttgtatacattttggcttctaaaacaattatcaaaggggtcatagtaaaaggatatataaaggtaacaattatacttttgactgagcgtctctgcttttttttttttttaactgcaactaatttctagactgttacttattgaaattgagatcttttttgaccctgccttcatcagctctgtgtaaactttattggaaaaaaagcacttggtgtatagataatgtctttaaaggtactgggtggtgagtgggatttccttcagatagaaatatttctcataggttaaccattcccctatagtatagttgttgtgtcttgtacctgagctgggaatccagaattatttgtatttctgtgctgcctgcacaaaaaatcatgaagtgagttaagtagtttgtgccacccaggagttgcaccttttctcaggttccactagatggtatgacagtggaattagccccaggcagtgtctaaaatcccacttctgttgctgaccctgtggcctcagaaaagggttctttttgctttgtttcctctttatcagggtgttggaagaaggatctctaagtgtctctctgtgatcctctgagcaaggaggtagataaaattgttagcttatttaattttcacttttactaagactctatttttattttagccgtataggtgagggacttgatcaggctctgccctgtctgacagaactcattctcaccaataatagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatctgggccttttgggttctgcagccgtatgttgcaaatattttcctacttttacttgacttttgacttaggatgtcttgttagagaagttcctaatttaggtgcagtccaatgaatcaatcttcttctttattgtagcccttttgatgtttaaatttcccctattccagggttataaactcctatgttgttttctacaattgcagtgttcaatatagtaccagtaactacaggtggctacttataattgagatgtgctagaactataaaatacacactggatttcaaagacttaagtgcaaaaaaaaaaaaaagtaaactatctcagtaatttttttatatcgatgttgaaatgataacgttttggataataagttaaatggcatattattaaaattagtttcacctattttaacatggctactagaaaattttagattacatatctgatatgcattaaatcttgctgaacagttccagtctagaaaccttgttttactcttcacgttagatgaacaatccacttggaactgttttcatgctttttaaatttctgttctgtgtatccaatttttaacataattgagatactgtgtattgttttgtaacctaaattcttcacttaaacactggatgcttaaatttatattgtaggccaggtgccatagctcatgcctgtaatccaagcactttgggaagccaaggtgggaggatcacttgagcccaggagttctagaccagcctgggcaacatagtgagaccttgtctctctctataagtaatttttttagaaaagccgggtgcagtggctcatgcctgtaatcccagcactttgggaggccgaggcgggtggatcacgaggtcaggagttcaagaccagcctgggcaatatggtgaaaccccgtctctactaaaaatacaaaaattagccgggcgtggtggtgggttcctgtaatcccagcttcttgggaggctgagacaggaggattgcttgaacccaggaggcagaggttgcaatgagctgagatcatgccactgcactccagcctgggcaaagaaagagactccgtctcaaaaaaaaaaaaaaaaaaaatgccaaaagtggtagcgtgcatctgtggtcccaggtattccagtggctaaagtgggaggatcacttgagccctagccatcagtcgaggctgcagtgagacatgatcatgtctctgtactccagtctgggcaatagtgcaagacctcatctcaaaaaaaaaaaaaaatcgtataacttaattttgtgacttaaccttcctcccgtattttcctgattgttgagaatgaactgtgttcctttccttgtggacaaggtccatagcatccttcagattctcaaggagatgcttgactacaaacataagacagcactggtccatggccatgtcctttctgaagtgtgtgaagtattcaacccgaaatacatatttataggcaatgtgtctcatgataggtgctgttagagaaattagagttgtatttaaagctctttgcaaagatgaagactactgggcttatcagttattgagagaggtatgttagaatctcacagcatggtagtggatttgactatccctgaagttctgtcgattttagttttgtatattttgaagttgccttatttgatacatacaaattttaaattattcatatctttctggtgaacggaaactttttattatgttgtgaccctcgatctctattaatgctgtttaccttgaggtttcttttacctcgaaacaatctttgttttggttagttatatgcatgataaatcgttttccatccaaaatttactttcagcttgtctgtacctcttgtagtttagatttctctcttaaaaactgtatggttgaattttttttttttttttttgagatggagtggctggagtgcagtggcgagatctcggctcactgcaacctctgcctcctgggttcaagtgattctcctgctgcctcagcctcccgagtagctgggattacaggtgggcgccatcacatctggctaatttttgtattttttttttttttagtagagacgaagtttcaccatgttggtcaggctggtctcgaactcctgaccttgtgatccacccgccttggcctcccaaagtgctgggattataggcgtgagtcaccgcgcccagctctggttggaattttttacaatccagtctgaaagctcttttaagtgaattatttatatttagtctgtttacatttaatgtaattactggtgtgttccagtttgtcttctctctgttctggggcttcctgtctgtcccacccgttcttcaatccgttttctctcctttattgtagatgctctccttctgtcattccattttttcttctgatggtttagaaattactctctttcaatcttgagttagcatcgtaggaattaaaacacacatatttataaaagtttaaaattaaatgttaagatcactgtaccatgaccttcaacatttaattttaaactttgacacctttaccctgctaaacaatacagtacagtgaccttcaacatttcagcagccttcgggttgttacatatttattcttttttgaagcccatcactacatcgccattacgttttacactgtgtatgtaacaaatgttaccactttgttctttattcctttttggatcatcttcagtgggggtaaaacagtatcaagctctagagctccctctggtggtttttgtgacatatttgaagatggcagcttgctttttgagaatttctggctctgctctccctgtttttatctgtacttttttttctcattgtgcctcttgcacacacacaccccttccccaccatctacccaatttgcgcctgttccagcagtttctcttcagggcagggccgtgttgggacatgatttctattaagagtgagggcccaaattgctcttgcccctgcagcccttatcacagacccctgtagtcattattggaacatgctggtcttgggcctgcttttctcagtcactggagttctccagtttgtaagacggctcctcgcctcccctctgcttcttcctgtacaaaggccgtcaccctgcaagccttgttgctctcaacatgggttgtctctacttgttcctattttagagttactgcagaatgccttgccatctagcttggttgtagctggtaaccataggtttttgtttttttgctatccttattgcactatgttttatggaacaattggagaagattaaaaattcaccctgcccactgggcgtggtggctcacgcctgtaatcccagctctttgggaggccgaggcaggcagatcacgaggtcaggagatcgagaccatcgtggctaatacagtgaaaccccgtctctactaaaaatgcaaaaaaaattagccgggcatggtggtgggcgcctgtagtcccagctacttgggaggctgaggcaggagaatggcatgaattcgggaggcggagcttgcagtgagccaagatcacgccactgtactccagcctgggcaacagagcgagactccgtctcaaaaaaaaaaaaaaaaaaaatcaccctgccttctttccattaattcgatcatttttaagctatactattccttgtccctgcaaattttatttaaagagattttcaggggcagctaggataaatgtaccttctttcaaaagacagtatacctttgttgttcttagacgctgaagctggcgctagcaggaaagcccacttacaccaagattctggcttgcagttcccagtgtgaataggttgctccagagtcccatcagctttgccattgttttcttttccaaatcatggctcagcagccactttgagattcctgtaggaaagcaatttcttatctcctgctattgagacagaagctgttaatgccaagattttaagaagctcccatgtattcatcggtagaaattatttaaacatttgtgatgtgctagtattgggcttgttgctagagagtaaaaattcagtaaataatgaaaagacaacttgcttcaaaagcactctccatttcagaatctcaaaatagcgtgtggtattcgcgttcttacctgtggctattgcttgacagggtgatctggaccctctggcatctctcaaatcgctgacttacctaaggtatgggaattacatattgtgacaaaatgaagccctttaaaataacattacttttaccagccttgaccttaatgtaatcagataattaaaaaatgtggcacatatgcaccatggaatactatgcagccataaaaaaggatgagttcatgtcctctgtagggacatggatgaagctggaaaccatcattctcagcaaactatcgcaaggacaaaaaaccaaacaccccatgttctcactcgtaggtgagaattgaacaatgagaacacttggacacaggaaggggaacatcacacaccggggcctgttgtggggtggggaaaggggggagggaaagcattaggagatatacctaatgtaaatgacaagttaatgggtgcagcccaccaacatggcacatgtatacatatgtaacaaacctgcaagttgtgcacatgtaccctagaacttaaaagtataatttaaaaaaaaagtgccttttacaaagaaagattgaatatatttccttaatgttaaattgttacaatgttgcaatgtgaagaatgtgaatgttcccttgatttataggttccttagactattcaaacagacctcttgagtgctgtgccatgaacaagtttgccattgtgtcattccttttcttgtagtatcctaagaaatccggtaaccaataagaagcattacagattgtatgtgatttataaagttccgcaagtcagagtactggatttccagaaagtgaaactaaaagtaagtagtaatctgttgcttgtgagccattatagagttgtgtgtttttctttatatttttgttactgattattaaaattgtctaaatgagtaaattttaccattagtttgtaataaaagtgggagggaaaatgttacatcacatttttttctaatagcagagtttatgatagaacttttaagttggagctctcttatgtaatgctggctattccgaagttcgcaaagtgctgaggccacggtgagcagtcttaacagtggattgtctgcctagatacgttcccagcggagaacttaatgtaacctactttcgtgcagctccgtgtgttaggatgatttttccctttattaggaattcattattttattattcatttaattgccttcttagttccctgggatcccctccttggagctaggagaatgaactttcttcagggagctctaccaaagaaagaagaccactgtgtcttctcttaatttgaaattgctttttggtattttcaccagcccggagtactgtaggagagttcgcttccatgtcttctgaggaatgcatctaaatgcatgtggtattcctatttccattaactctgtgtgtggtgtcgctgtaggagcgtcaggaagcagagaaaatgttcaagggcaaacggggtgcacagcttgcaaaggatattgccaggagaagcaaaacgtaagacacggatatccaacttaactctacttcaccttcagaaacatgatctgatctgtctggcagttcgtctcctacaaaattaaccaaaaactctgacatattaatgtggtattaaatttgagtgcttatagtccatgtacatcaatggtccacacatcacaagaaatttctaccagcttagcagagcaaatatttcagtagtcagtcttcatgtgataccatgtacatcctattttctatataggaagatgaactggatggtgtttctgaaggagagagttcttgtatcagtttgttaacaaagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaaggtaatcatgtgttaggattcttggactggaatgagctaagatgggttcagaacacaaagctggataataaacatgttccgaacattgcagatttcattttcccacagttattagcatacagcaatatttctgtttaaggaaaaactagcataaagttattatttgatcagacttgaaattacacaagctaattaatgtggaggcagctttgtctttctcattttccaaggtgcatttatcacttcgaacagttacttaccttggtatgctgtctcagtgtttgccttaatttttactttcgaagatttgctgtctggcaaatccttttgactgatcagtagggaccctcgttttataatattgcctccttaaattattcagtaacataattgcaaatagttacttcacttagctacgattttagaacatgtggagtgattatttataagaaggcctgcatctcttcaccaattttagaaatttgtggtttggcttctagttttatttttgtgggccaataacattcttccccctacaccaaagtatttaatgttcctgatggagaagttgctgtgaatttctgtaggtgattgacacttagttttctgggtagctgatacttggttgaagttaatcatccatctccattgccctctgtcctccagaatgccatagcaaatgcttcaactctggctgaagtggagaggctgaaggggttgctgcagtctggtcagatccctggcagagaacgcagatcaggtgaacaaatggtgttctttgtatgttcaaattaatgttacactcagagtgtaactcacaaccatttagatgccatgactctggaatgccagagtagtgcctccttacatcaaatctaatatatgaaatctctttaaatgctctttgaagataaagtatttgatgggttgggtgccagtggctcacgcctgtaatcccagcactttgggagcctgaggcgggcggatcacctgaggtcaggagttcgagaccagcctgaccaacatggagaaaccccatctctactaaaaatacaaaattagccgggggtggtggtgcgcgcctgtaatcccagctactcgggaggctgaggcaggagaatcgcttgaacccgggaggtggaggttgtggtgagccgagatcgcacttttgtactccagcctgggcaacgagcaaaactgcagctcaaaaaaaaaaaaaaggtatttcatgaagaaagttaagttacagcactgtggggggttttatgtaaaagttgaagctagaattacttcagccatggagtgcaccgaacactagcgatagccatgtggacttttacctatatatatttgcgtgtgtgcatgatacctcagtagttaggaacacaggctctagagccaagcagtccgaggcccaaatctcagcttcaccagctctgcctttggacaagtttcttcaagtctttcctcatctttaaatctgagataacaatagtagcaaacctcaaaaggttgccgagaggctgagagactgaacacagcacaaggctcaacattagcgagtttttgataagtggtaactgttctgacatctgaatgcctgctttatgctaggctgcatgtggggcactagggatataagataaaaagtactgaaatacgtcttacaagttttgatatgaatgtaactggggacagccactcagactgccgtcttggggaagtttcctagggaaataatgtttgagctgggagctaaaaattaaaaagacatttttttcctttttgagtcggagttttgctctttttgcccaggctggagtgcagtggcgcgatctcggctcacgccaacctccgcctcccgggttcaagcgattctcctgcctcagcctcccaagtagctgggattacaggcacctgctaccgtgcccggctaattaatttttagtagagacagcgtttcaccatgttggccaggatggtctcaatctcttgaccccgtgatccacctgcctcgtcttcccaaagtgctgggattacaggcgtgagccccgtgcccagccaaaaagaaattttttaagaccagtaattctctactgtatggtttgtgggcctctgggagtctgtaaggtgaagactgattttgttgttgttgttgttttgagacggagtctcgctctgtcgcccaggctatagggcagtggtgcaatctcacctcactgcaagctccgcctcctgggttcatgccattcttctgccccagcctcccgagtagctgggactacaggcgcccaccaccaagcatggctaactttttgtattttttttttttttagtagagacagggtttctactaaaaacacatgttagccaggatggtctcgatctcctgacctcatgatccacccgccttggcctcccaaagtgctgggattacaggcgtgagccaccgcgcccggccgaagactgttttcatctaataacaccaaggtgttacttgctttagtatgaacatttgcactgatggagcaatagtgggtagaactgcgggcacctcagtaggagtcaaggcagcagcctaaataatagctgttacattcttccctgctctgcactcccagtagcgtgcataccagtttcacttaagagtgtcctggatgcagcagtaaagataattaaatatcactcctcgggcacacgtctctttgatattctgggtgacagaaagggggtgcacatgtctgcattcttgagttaggtggttatctccatgcactggtgcagttgtttcagttgagaggcagctacctgtcttctcaaacatgatgaagtgagcctgtcacttcagggaaaacaattgaaaattcaaggtttaaagcaaaaattaaaatttagaaaacttgtatccactgccgtaacctgccagcttcccagtactttaagacttttctggggaactcaatagtaatgttatgtgcatgtgaattaatgggtgtgacatttttgatgtgtaattacatggctcaacgtttggaagatctgcaaaagtcggtgaaccacagttttccaaatgatacgaaatcatgtacgggtaaaagatttgttcaaagtacaagataaaccaagtaagagtatgaaaagttcattgataaggtttcagacttttacactgccatctaaccttgaggaagctaccatttgtcaagttttagcatagtatctaaaaagagcatccaccattatctgcacaggctgttaaaatcttcctcccttttctaactgtgtgcctgtgtggccagattttcttcatgcccgtcaatcaaaatgccgtattgcacaggatggaatgatgaaaccaatacaataattcagctgactgatgttaagtcagacattaagtcaacaataacaattgtttcccaaacaattgaaggagttacaacttttttttccccctggaatacattgagcaaaatacctgccataaattgttgaacaaatgtaacattttttggtagttgttggcatatttccctaatttagagacaataaagtcattgaactgttgccagtatatggcatgtagtaggtgcccagatgtttttgagtatttccggtttctttgcctacggtagtgccatgaaaagcacatgagtataggctttaccttcaccaaaaatgaattattatcaactacaatgggaggcaacaattttgaaatctttgtgacccttttcctttgaaattgagcatcccttccagtacctgccaaagacagactagaccgtccctggacgataagctcctcaaaggcaggtgctgcttttgatctttttgtacctacttcagtgtgtaacaaacagtggccacagaacaaacacttgcatgctaagggaatggattctctaaaattgatactacttttgctttggtggttttctttagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctaccaagttgtgtgtcatcatggtgcatttgcagtgaggtctaaggacacgttgaaattggaaatgcaggagggcagcgttttctcggtaggcttcctgggctggattagcgtctggctcctgcagtgtcatgacacatgccaggaaggccgccttttccactcccacatagcccttctgttagtgcagacttacctgtcgctccggcttctgataggacaactgaaatgattccatttttgaaattgattggtgtgtcccaccaaacctggctatgttttttgtttttttctcccccgcccccaggctggtctccaactctggcttcaagtgatcctcccgccttggcctcccaagggagtacaggcctgagccaccatacccagcctttagttttatatatgtacatagttaacataaaggtcatatggagagtctacaagaacatttgttgaaaggggcgtaagttactcatatttgaagaacactactgtttcattgccatctctctgatcccccttagccacgacagtcttaatcccatcttgttgcatatacttttgtgaaaagcttggcactttatcagttagctcttgctgcaataatgctgtataacaatccacccgaaaactcagggttttgtttgttgttttttttttgagacggagtcttgctctgtcccccaggctggagtgcagtggcgcgatctcggctcactgcaagctccgcctcctgggttcacagcattctcctgcctcagcctcccaagtagctgggactacaggcgtccgccatcacgcccggctaattttttgtatttttagtagagatggggtttcactgtgttagccaggatggtgtcaatctcctgacctcatgatcctcccgcctcggccgcccaaagtgctgggattacaggcgtgagccaccacgcctggccaaactcaggggttttaatcaacaacactattatgtagttggctctgcttatcactgtaggtctggattaactggggtggcttggtttctttacaggtctcagataagccagctcacccggcaaaggcacaagaaataaacactaggagcttcttaaggcctacctacactcaaaactgacacacttatttctgcccacttgatattaaccaaagcaagccacctcgccaagtacaaagtcaaaggatgatggggaaatatactcctttgaccttgccatagcaaggatatggctgtgagaaggagtgacaaattagggccactctttcagcctcggccaatcatttagcctacaacagtcagtgataggtggcagccctggttactgtccacctttgtcctctttttgcaaataatacctgagcaattacattgagcaaagtgtttgttgaaatacctttccagttctagacaagccaagccaggtgaggttataacacctgattaaagggacaaaggtaacaaattcctggctaggatgagtaacttctatcaataggaccataagatcaatgtgctaggaactgaaaagccatcatccatgcattcaaataatatctattagattttagtggaatatatgcattatatgtatatatgtatacaatagttcacaatagtttacaaggatactttggttttctatatgcttagaatgtgcattattttcatgagttaatactggtttccattttatatcgcaaagtcctgagtgaaaaggattgttgcctttttttaatgatagaacctaaaatgttacaatttattccatctttgtgattacagacattacaggataaggtagctaaacaaggcaaataaagcaaacgttcccttcatttaatcagatgcaacattttggcatttttatactgtgcacgttgactttaattcattgacatggattgaaagccggcaacaacaaatctttgcaatttaggatcttcttccataactaagttttgtgggttttttttcttttcttttctttcttttttagacagtcttgctctgtcatccaggctgtggagtgcagtggtacaatcttagctcactgcaacctctgcctcccaggttcaagcgattctcctgcctcagcctccctagtagctgggattacaggcgcccgccatcacacctggctaatttttgtatttttagtagagacagggtttcaccatgttagccaggctggtcttgaactcctgacctcaggtgatccatgcacctcggcctcccaaagtgctgggattacaggcgtgagccaccgtgcctggccaaatttttttgtagagatgggatcttgctgtgttgcccaggctggtcttgaactcctggcctcaagtgatcctcctgcctcagcctcctaaagtgcaataggattacaggcaagagccaccactcctggcccactgcaacattcttgaagctctcaagtcttcatctgacaccttgtcaagatggggaactcttgtgttaaaccatcctgttaagttactgtataaaaataaaactgctcccaagcattgattgaaactgttttggtatgagtttcctgagagaaaagtgaggccctaaccatttttttccatgaactatgaccccagtacggtatacctaatgtccttcacagcctaacaaaatagttgaggcaaccctgctcatcctgtctagtttatcagtatttagatgtaaggcggatttaaagctaatctgggactgagaattgcaactaattccatagaagtcattcaatttagcacataaatgttcctgcaagatgccagagcaagtgagaaatcatctgtagcaaagcaaagagtggtgatggttcatcaccttttacaacggaaaggcaaacatgaagaaggaaattctccctcctaaaattcctcattaaatcgataagctatcttcacagcctttatggataacatccagagtcctcggttcatctgaggagtccattttcaaggtggccaacagggaagaagagctttcaggcttctctttgctatggctcatgaatgccaggtcccctttattgctttctgaacacactgctgggaaagcttgatgaggtcagtgctcaaatccctgcagctgtcccccttgaggaacttcttggcaaacctgcattgaagaaacactgattgcgttcacgcttcatgtcatggtttgccttccccacactgctcctggcgacagtggtgacgcagcactcggatgttgtcacctattcattattttttcagttctattcccaattcccaacccttcttttgaaacacagctaggtatgtgcacttcaaatgctccagaaaaacccaaggtcacatttcaaataggatggttatggtcaccataaaggtggtgacgtttgagtggtggaagagggtgcgggacggcgttgcaggcagaggaacacagccaggacactattataagtaactctgtgatcgtgtcttgtggtgatacagtataattcaacacaggttagagcagttactatgatcgttctttcctaaaaggctttgattttggagaaagaaccttgaggatcggtggggactttcttggcctgaaaggtatcaccagcagcaggagcaggaggctgctcacatttcgtgtcttcacttggggtggacgttggctgcaaccctcaaatgctgggagtcgtcaaccaactgagccctgttgtccaatgtgccccgggcaaggatgtgggtgcaaatcctgcttccgggcgaccactgacttccttggcttcagtgtccaattagaaaaaaaaaagaaagtagaaattcggtaagaaatccgtgaacgaggtccgtcctccacccccgactcaagccaagagatagcacagaacgttcccacacgcgctgtcccggccccggcgagcgtagccgggatttctcccccgccacgcccctcggccacgcccccctgcgtttggcccagcgacggggcggggtcggcctgcgattggccgggaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacgggtgagtcgttgcggggcagccgggcgcgcgccgccacttttgcgacgcgcagccatgatgggtgggtcgtccgccgctgcaccgggcgccggagcctgggaggcctgggaacggtcgggcgttggcgcttacgcggaccttgggcagcaggcccggaccttgcgcggaggcttctcgggagccgcacttccctgggcggctcggctgtcccttgtttgcgcaagtcttttttgcgaaccaagcccttcctgtggtagttactggggtcactcggccgttggcgtttgcctctgggacccgtcccacacagccccatacacactcctgactccccgcgctgtcacccctttctatgtggctctgaaaggcctttgccttcctgattcagattagttgctcttcattcttcaaaacccagttgctgtgccctccacactctaactgcccccgactccccagatggttgggaagtctcacttctcagtgatccctgaattgtcgcacttcttgagttcgtgttttaacgatctacttaggaggctttttcctcagcctagaccatgaaggctttgagggcaggagttacactttgtgtttgttgagtcttatggaaaggtcaactagtagtgtcatttttagttttttgaaaactgtttttcttttcagtgggctccctgctggccacctatggctggtacatcgtcttcagctgcatccttctctacgtggtctttcagaagctttccgcccggctaagagccttgaggcagaggcagctggaccgagctgcggctgctgtgggttagtgcctgataaccgaaatgaaagcggtggttttgcacctcctttatattaagagttagtctcttagtaaaagtaagaggggccacacaggaagaccctgtctctatttaaaaaaaaaaaaaatagccgggagtggcggcacgcacctgtagtcccagctgctcaggaggctgaggcgggataatcacttgagtccagggagtcaaagctgcagtgggctatgctcgggccacactacactccagcctgggcaattgattgagaccttgtctttaaaaaaaaaaaaaaaaaaaaagtaggaagtatatggttctcggtggggcgcggtggctcacacctgtaatcccagcactttgggaagccgaggcaggaggatgacttgaggtcaggggttcgagaacagcctggccaacatggtgaaaccctgtctctactaaaaatacaaatattagtggggcgtggtgacgggcacctgtaatcccagctattagggtggctgaggcaggagaaatcgcttgaacctgggagctggagattgcagtgagctgagattgtgccactgcactccagcctgggcaacagagtgagactgtcttttctttcttttttttttttttttctatgagatggagtctagccttgttgcaaagagcgagactctatgagtagacgttatgaatagaaatgagttcatttctattcataatgctatttggaaggatttttcttttctgtagaaacaaatacttaagaatcttctgcgctaattaagggatggataatgatttagaaaactttatatttccttggtagtcttccaggattctagtcagcctagagactgtgggtgtcactgaggtatccaagatgtgctctgtgtggccactatcccaggctttatgaatcggaattgctcaggggaactcagaaattggcatttctaacagatttctggtgatgtagatatttcgggctaaaatccgtggctcagcaacagacccctgccccctgaagcagtaaaatgtatgcagaggggttaggagtacttatgtaaaaatatgttgtttcattgtctgatatccatacctctttatacttttaataatatggacactcaaaagtttctattttatattgtacacagtgctttatctccatttttttctgacattttagaacctgatgttgttgttaaacgacaagaagctttagcagctgctcgactgaaaatgcaagaagaactaaatgcgcaagttgaaaagcataaggaaaaactgaaacaagtatgaactggtttcagtttgaatgtgtgcatagaaattgtctgaggtttagtggctaacgatgcctgtgtctgtgttgtctataagcttctaggaccaggtcctatcccattagattcaataagcatttcagttcctaccatgtaagtattggtgatatcaagaagaatacacgattgttagggaacactagatgtgtgaatatattaccatgaaaggtccagagcacaaaaggagggacaggctggagcagggagcatgtgagtgtgtgtgtgcatgtgcctgtgtcttccccattaccaaaaatgtcctgacaggagtgagtttcagaagaatggagtcagtaatctttttcatgaaacattttgctttctttaatagtgtacaaaaaccaaagctgctctatgtgagttaaactcacactaccagatcacaacagttttattaactaaagaaaacgagggtgaagtttgttctgaaagacatttaaattaagaattatcagagttagctttgtctttgagagaaatggcagcttctgaattctttctgtaaaatgtgattgtttctcagcttgaagaagaaaaaaggagacagaagattgaaatgtgggacagcatgcaagaaggaaaaagttacaaaggaaatgcaaagaagccccaggtgactggagacctcggccggctggcatgcggtagatgaagattgccaagtagaatgttttaattgcttcttacactactgtgtgtgttcaaacaggaggaagacagtcctgggccttccacttcatctgtcctgaaacggaaatcggacagaaagcctttgcggggaggaggtaagcaccactgatgtcaaatgttaacagattttcaacacttacaggatatagttaccttttaggaacaagattgtttgtttctttgtccataaattaagactaattccttaggattgtgaagattcaataaaggaaacagatgcaaatcacctcctaggtcctcactaagtacttagaaggattgtacttatagtattctaacttgatccttctgcagccccgtagagggagagctaagtagggtgaggaattgtctgccaatcttcagatgagtgtcaaggagctggaacacagtggttttggtctttctggctgggaccaccttgtttcttgcaaataacaaggagtagcagacagatgctcatccaaagctgcttcctgtgtgcagcactgccccggggactctggatgatgccacagcagtctgtcttcatcccatccctgagaatttcaaatctgggaagatgggactcacaaacgaaaataagcaatccttggtgattctggctaagagttgcaagttactgctgaggaaggaaagaacaaacacactagaacactgtaggaaccaaggcggaagattttgtatcctccataggaggagaggggcaccgcagaggccctgatggtgtctttgaggactgaggaaagactggggcatgggctccaaggcagcagggccacagacttggctgaccttaaacactgagctgtaatcccctttgtgtcagaagactaaacctggcttgctgtagagaaggtgatgcatctggaaagaaaatgctatttttaaatggtcctgccggaagcttatttttagacacatagaggtgatatttaggagaggaatggaaatcgtagaagatggaatgcagggtgtgcttgcctgcacggcctctttcagcatccccagcatttctgagctgggacttttgactagcctggctttacaaataaggaaactgaggcacagtgtttaattgcccaaagattccactataagtaaggagtaaaagtaacatttaagttctgggtggccctagaaccttagcactcaaccaggttaccagttgtgcactgactttgggaagctcatgagggagtggggtggttgggggtagggaaggatacagaagaccccgttctgactggtagaagtgacaagtttgactcttgattttttttaatctgttttctgtagcgtgaacagcccttatttgaatgtatgagttttagtaagcactgtgataggaggattcatatacttaaatcaggccctcttgagagagttttttggtgacccttttgcatgtgtttcggaggttgggacaaagaagctgaatgacttttttccccaccagacaatcagttcaaatggcaatcacaatataaaggtttttttttttttcacatagctaaaaggtttttttaaatgtcccttaggatctgtatctttgcagtgctttgcgtgtcactctcataattttattgtggatatacaatgttcccagattttcagatttttatcaatactgttgtgctgcttttctgtcctcccaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacctccaactattacttatttctctatttattattactcacccaaaataagtctggcaagtggcagacagctgccgtgattttgaaagttgacagactccttggggttcatccacaaaattgggtgcttggagtcgagttgccgaattactgggataaagaaacatcgtgcctcaaggttcctcataggctgaccaggtttctacgtgacctctcagttattcccttacgccatgactcatcttttacgctcttgtccagaggcactatcagcagttttggataaagagccaaacagtaaatattttagactttacaggccacatatgatctctgtcacatagtcttaggtttttatatttttaaaggattgtttttaaaaaagattctctgctcatgggctggatttgggctgaatgctgtagtgtgtggaccccgtctagatcatcagaaggaaaaacattaaccttcagaatagggggtaattcgctgcaaaagtactatagaatggtctcatacataaattagtcaacatttgttatctcctgcaggtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcagtggaaacaagggtgggccttgtgaggtgtggggaagccctgggaccctcactccccttccagtgtgtaactggattggctcccaccagcccagaagatttacgacgtgggaaatggtatacttggattaaaatatttcatccagatttgtttacatctagagagaaccccttgtaggttataaggaaactttttaacattcttccttgaatatattttctgtagctgaaaatgtttgtgaagtggctgtcaactacacatcgcatgagtagaggggctctgggtcggggtttcatatgcagcagagcagctcccttgctgccgtccatcaagagccctcaacacaagagtttgttataaatagaaataaacgacaaaaagtagaggggtatgtttaagtacactattagatgtgactgactaccttgaaacctgatttttttccatggggagaaacagtgcttgaattctgcatgccccccttgcatctagcaccttttggtaggggtggaaggagggtgtcagggagaatgattaggagataatggaggggaggggaaacttgcgttgtgtaatagcatttgaagagcacttaccacgtggcaggagtgtccatttctgtttgatccccctagaatcctatgaaacgggtatgttactaaccttggttttcagaaactgaagcttagatgggcttagtaactggtccacaacgctactcgctgtagtctacttcatccttgtgttcatattagccaaaggccttaagtcatcaaggtgtgggaagcttcttgcagctaatgaaacagttatgtggccaggcacagtggctcacgcctgtaatcccaccagccaagatgggtggatcacctgaggtcaggagttcgagaccagcctgactaatatggtaaaaccctgtctctactaaaaatacaaaaaattagctgggcatgatggcatatgcctgtaatcccagctccttgggaggctgaggcaggagaattgcttgaacgtgggaggtggaggtggaggttgtgatgagccaagatcgtgccattgcactccaccctgggcaacaagagcaaaactccatctccaaaaaaaaaaaaaaaaaaaaagttatgtgaagtaataatacagtgaaaatcacattacagatctagggcattaagcatttcagaaaggtggactgagcttgccagggaaagcaggtcttggacctttcttgaaaaaatgagaaattgggggcagaggtgcaaatgccaaaagctgaggcccctggggaagaagggacggccagagccataaaaaccatgcttcaaacctaggccatgtgctcaccttgtccaccagcagaggctgctgtggggctcgcggtgtgtcctggcagttggcaggagtttgggacagacactgggagctgtgaagttttagataatgtgtgacgcaccctatcccaatcatggagcaacatgagtaaattgtggggcagaacacacaagagtcttcaattggaatgcttaggagatagagttgtgcccttggctaaatgtttgaggagaaaagacttgaacgaccacgtttggatcccatcaccgcctggatcccatcctctcctcagggactccactctgcgcccccttcagataggtaacatgccaagtctgtctcttcttggaaagagcaaggccccgtcaaatgcgcagccctgggtgcctctgggtgggcgtttctcaccctactccttagcgatgtggaaggtgcccttactgagttcatcccatttctcgtgccagtggaattttggtctcgctgtatttgacttgacagcacatttcctacatgcccctcctcgcagccctcccttctggaacactctacacactggatcttagcccccgtgacagtccacacctctctcctttgccagttgtgccatggtctctagtcttgaaaaagtgttctgtgttccctaatttctcttcctgcatttgctgttaaatccattctgctgaagctgctcttcaggtcacgtgtggcagggggtgatgggtcgcctcggtcctcgcctgaagttagcatcctttgcggtccttgagcactcctgaagaaacacctcccttggcttccaaaacaccgagtttgcctggctttctcctacgtttctggccactccttgttctcttttgctgctttttctcaccttcctgaaacccctggggtgcccagagctgtctttagacctgttctcttggccacatttgacacagtgtgtctccccctttctcccctgactaaggggaagaagtcaggttgcagtgaatgctgtgtgtgctcggagcatccagtcttcctctggcacaactgtcacatttcgttgtaattgtgtcttttcttcactccaagacaaaaggagtggtctctttggtgtgtgggtgcatccccggcaactagaacaagccctgacataagcgcccacctcatggagttagaaaaggcaagaaggaaaccatcactaatgtcacgtggcgaaagtggcattgtggataccacatatgtgcaaacgcatcttctagtgattctgtagacgggtaatcgtggcttatgataaaatatcagtgtctcataccccaattcaaatgctctgtttcgaagaactcacagaaaattatgggctctggggaactaaaggctcagaatgggcctgggggtgccgaggatgctgtggacagtgtaaacacaggccccgccctgagggccttgacatctgtgggggaagacgagcactgcatggccacagaagtagatgacgatagctgatgaaggcccatagatgggaaatacacattccagtaagaaatgatgtgacttacgaagacctaacttaggtttattctgtagctacagattccacttctgtggaagtaggggttggaagttgtaggaaataatttagagatgaaacaaccttttcctctgtcttagctgctgtaatagtaccacagattgggtggtttataaacaccaggcatttgtttctggaggctggaagtccaggatcagggtgcaggcatggccgggttctggtgaggccttcttccaggctgcagatggccaacttttcgttgtgtcttcacgtggtggagagagctctggggcccccattataggtgtactaattccatcatgacctagttaacctccgaaggcacccccccaataccatcaccttgggggtgaggatttcaaatgctaatttgtggggggacacatacattcaatccataacaaccacaaaccaggagactctagtgttcagtattagtacagctcctaacactcctgagtagctatgtccgtcttggggtctacgtggtcctttgcaggttctgagggaccttcactggccccttgctgccttcagcatcctgagagggggtcatacagtgccaccagaccagcttcaggagagcacgtctgcagatgttgatacaggttaagcccgcttctctttgaagtagctattccaagcctccactcagctcacttcaggcttctcttcatcatcacccaaacaatggcaaacgctgtaataaaaagggctcatcatgaaaaaatgcaagagaagtgagcttgccagggtgacctctgatttggaagatggtcagctcagtgtttccagcatctggactgccctgaacataatgacttcaaacaaccatttatcccgaagattctgctgggctggctctgcactcatgcttgtggtcagctggcggctggcagggcccagtggcctcccccacatctgcccgctggctggcgctaagctgggcgacaggcgactggcccatgtgtttctgcatctgcggctaacccggatttgttcatttccaaggactgtgtgcccaagtttttcaagctgctgcttgctccacactgctaccttcccacgggtcaaagcaattcataaggccagtcccaacgcaaaggctggaggaaggcacagcctctcggtgggaggagctgtcgagtcacattgcaaaggcgtagatgcagggaggggaagaaactggccatttgcagtagaagggagtcttccgggtcacacagccttagtatacatctttgcgtctgtgaaacttctccccatctggatcaaaactgccccaacttgatctttgaggatcatccccaaaatttataagcaagagagttacccggcaaatgtgaagactcctgttctgaccaatacactccacctgaatcccaaaagagcctaggacatggcctgtatcagccggaaatggcatctcaaattggctggctgaggagcgttcagtaaacgagctgtttgccagggtgcagacagggttaggcatgatacaatccgggtggctagcaacatcggggaacctttaatgcccccaaacctgagagcagttaccaggacctggggggagggccgcccgacagagaccagccttcaatagagacgccagctctcagtgacccagtgagaaggaccacgataaatgaccttagtctcctcccacccaccagtctttctgcctgtgcctcccattggctgagcccagctgaaggcatgagcctctggggatggcattaatatctctttttgttgctttttttggtttttttttttttgagatggagtctcactctgtgacccaagctgagtgcagtggcgcggtctcggctcactgcaacctccgcctcctgggttcaagccactctcctgcctcagcctcttgagtacctgggattacaggcacacaccaccacgcccggctaatttttgtatttttagtagagacagggtttcaccttcttggccagggcggtctcaaacttctgacctcagtgatcctcccgcctcggcctcccaaagtgctgggattacaggcatgagccactgcgcccggctttaatatctgctaagctcattaaccgatgcctgcactcaaggtgactgttaggggttgagttgtgtcccccaaaatgtgctgaggtcctgcccccagtatctgtgaatatgcccttatttggaaatagaatctcagcagatgtaacccagttaagatgagatctgcgcagagggtgggccctgagccaatgtgattactgtatcattggctagggctgccgtaacaaaatgccacagactgggtggcttcaaccacagacgtttattccctcacagttctggaggctggaagttggaggaggtgctgcaggactctcctccaaggcctcaattcttggcttgcagatggccaccctcctgctgcctggtcacaggctcttttctttgtcacagttacccctcctgcctctctgtgtcctaatctcttcttacaagtacatcggtcataccagactagggcccactctgatggcctcttcttaattacttctttaaagactgtcaccaaatatagtcacattctggagtactgagggttaaggctccaacatataaattttaggggggacaattcagctcgtaacaattggtgtccttagaagagaagaggccgggcgtggtggctcaagcctgtcatcccagcactttgggaggccgacgtgggcagatcacttgaagtcaggagttcaagaccagcctggccaacatggcgagaccccatctctactaaaaatacaaaaattagtcggacatggtggcgtgcacctgtaatcccagcctccccactgggaagctgaggcaggagaatcgcttgaacccaggaggcagaggttgcagtgagccgagatcccaccactgcactctgttcagcctgggtgacaaaacgagactctaaataaataaatcaaagagacacagacactgaaagaaggtgaccacgtgaagcccacggcagagactggagtgacgcagccacagccgcaagccaaggaaagcctggggcccccagaagctgaaagaagcaaggaaggattctcccgtcaaggccaggagggagcatggccctgctgacaccttaagtttggcctcagaaactgtgagagaagcaatgcctgtaattataagccacccagtttgtggtcatttgttctaacagccacaggaaatgaaaacagtggcctttggcaagcacagttcaactctcggaatttccctcgcatgtgacgagatatggtcccaaggctcagggcacacgcaagttgcatggatgtaccacgtgtagcttgctcagcacccctccccaacaatgctccccagagatggtccagaggacattccttcatcagagcataaagcaagtgctggtgggagaaccaggactcctgagcagcatgagaggaaggccggctggagggcagtgggattgcgccgtgctggatgaggtctgtttgcccctccacatctactctccacccggttcctgccccaggaggctgacctgtatgcatgcagggagcccttctatgcagtccgttcaggccctctcctggggtgctgtccctaggccaccttgactgcaggcacaggtaactttctcaatggatacgaacaccaccccaagtgctccggccagcacagtaaaccctgaattccttttcctgaagttggactccagcaagccttaggatccattctcctcctcctgacacccttaggatccattctcctcctcctgacacccttggagtccgtggccatgattcttcccagactcctgccacagggatggatgaagtcatactacattttcagtgatggctgtgtacagtgagccttgtacttttcgatctgggattttctggaatcagactctccattgcctggaggttgtgaggggtgatgagagtgaagcctgcaggatcagcagcagctggagagacaactgtcccagtaccttaagtgaaagctgtttctgcaggaggaagcaggcagggggctgagatgaagggattgggaggctcagcattctcaattctcagcctcctctgtgtcgacccatatttcagggtcccgcttctttcccatcagtgcccttagcattagggacctgacaggggtcagcatttcattggcaatgctgctctgcagaccttaaagccaggcctgggctgggcttcagccatttctctcctacaactacaggggatgggggaattccagcagggctagaactcactgcattcacttcctgtggctgctggaacaaatgaccacagactgggcagcttctaactacaggcattgcttctcccagtttctgaggccaaacttaaggtgtcggcagggccatgctccctcctggcctcgacgggaggatccttccttgcctctttcagcttctggtggccccaggctttccttggcttatggctgcatcactcatctctgccatgggcttcacgtgatcacctttcagtgtctgtgtctcttctcttattttctatttatttatttacttatttgagacagagtttcgctctgtcacccaggccagagtgcaatggtgggttctcagctcactacaacctctgtctcctgggtacaagcgattctcctgcctcagcctcccagttgggaggctgggactataggcacatgccaccacgtccagctgatttttgtatttttagtagagacagggtctcaccatgttggctcggctggtcttgaactcgcgacctcaattttcatctgtgttctgcattggatcctaagtaactttaacttgtccttttccctgtacacactcaaggcccatccaaagcagccaggtgaccccaccttcttcatagtcatcctcgttgccattgtgcctgcttcacagccatttggcctccactgcctcgctctgctctcgtccactttcctcggccatggccatgggtactttgaatgcccatgatgcccctgcctgccattgagtaagtaccagagtgctgttgctcattccttaaatagctgagcgatcctctcctcagtcccattttgagagtatgtctcccaagaccacattgttagtcattaggaaaatgcaaattaaaaaccacaatgagataccactacacacttattggaaaggctaggctgggcgcagtggtggctcacgcctgtaatcccagcactttgggatgctgaggttggcggatcacttgaggtcaggagtttgagaccagcctgtccaacatggcaaaaccccatctctactaaaaagaaaaaaaaaattagctgggtgtggtggtgcccacctgtaatccactttggaggctgaggcatgagaattgcttgaaccggagaggtggaggttgcagtgagctgagatcatgccactgactccagcctgaatgacagagtgacactctgccaaaaaaaaaagagctaaaattagaaagactattccaaatgttaatgaggatgtggatgaactggaacacacacactcctggtagcaacagaaaatggaaaacagtttggcagtaccataaaaagtgacattacacctaccatatgatccagccattccatccataaatacctaagggaaataaaagcatctgtccataccaagacttgcacaggaatgttcccagctactttacatgtagtagcccaatgaatggatggctaaatcgtggtatgttcatagaaaggaacgctattcagcaaccaaatggaatgaactattgatgcatgccacgtggatggatttcaaaatagttacaccatgtgaaagaagccaggccaaaacaacaacaaaaaaccactacataccatatgattccatttctacaaaaatctagaaaacgctcattaatctatagtgatggagcagatcagtggttgcctgagctggaggtggaggtggggaacagggagggaaggaggaaaaggtggttcaagaaaacttttcagggtaatagacaagtctgctgtcttggtggtgatggtgtctgtgatactgtgaaacatatatttggttttcaactctgtttgctgggatacaactcctaaaatcctcagactcttcaagtgatgtcctctcctacgctaatgagttgactggtggctggtagctccctaggagcttcgggatggggctggtaccggaaagaccaaggcaggattagagggttgggactttcagccccattccccaacctcagggaggggagaggggctgaaggttgagttgatcaccaatggccagtgatgtagtcaatcatacctatgtaatgaagctcccataaaaacccaagaggactggatgtggggagatttcagacagctgaacatttggaggcttacaaggaactgaacaacacctcatccatgtgccaggagggtagtgcatcccaactccaccaggacagaggctcctgtcctcaggacccttccagacctctccctgtgtctctctttatctggctgtttatctgtgtccttcaaaatatcctttgtaatgaactggtaaacataaacgtttccctgagtactgtgagcccctctagcaaattcactgaaccaaagaggggttgtgggaaccccagttcatagtcaccaggtccaaaggcccagacttatacgtgcctgagtgtggacaggagccatcttgggcactgagccctcaacctgtatccgacgctatctccaggtagatagtgtcagaattgaattggaggacacctagctgatgttggctgcagaattgattggttgcttcctggtggggaaaacacaacccccaacacgtttgatcacagaagccttctgtgttgattgttatggtgtgaaagcagaggaaaaacacagatgagttggttttttcacacatggtgtcacaggtgtatatgtcaacacttaaattgtacattttacacatgtgcagtttatcgtatatcaattatacgtcaataaaactgttttttaaaaatccttggccaggcacagtggctcacgcctgtaatcccaaaactttgggaggccgaggtgggtggatcacctgaggtcaggagttcgagaccagcctggccaacatggcgaaaccccatttctactaaaggtacaaaaattagctgggcatggtggcgggcgcctgtagtcccagctactcaggaggctgaaacaggagaatcccttgaaccctggaggaggaggttgcagtgagccaagatcgcgccactgcactccagcctgggtgacagagggagactccgtctcaaaaaaaaaaaaaacaaaaaaaaaatcctctctgttcaaataagtggcaaagtttctgtaccctcgtgacacaggtagttctggttcagggtcagagctccctgtgggatcttggagtctctgtgagctttgcttctttgacatcataaaagttgaccaaaagtgaagcagaggtggtttggcctggcatatgtttcaggcaagcatcatgggcagttccagtgccctagctgaagtgacacagcttctcacccttgtttctgatgtttgctgtctcataggtgaagcagttggcctcactactactaaatactttaaaattacgtatacttttcagtggcataaatgttcatttctgagttaacaaatgctaagtggcatacacgttttttttaaccaagtaaaacattgactcaaaaatttcccatctctacaaaacattttgccgggtgtggtggcttacgcctgtaatctcagcactttggaaggctgaggcgggtcgatcacgaggtcaggagttcgagaccagcctggccaatatggtgaaaccccatctctactaaaaatacaaaacttagctaggcgtggtggcgtgtgcccgtagtcccagctgctcgggcggctgaggcagaagaatcgcttgaacccagaaggcagaggttgcagtgagctgagatggcgtcactgcactcaggcctgggtgacagagcgagactccatctcaaaacaaaaacaaaaccccaagtaatccaattaaaaaatggacaaaagatctgaatagacacttctcaaaagaggacatacaaatggccaacaggtatttgaaaaaatactcagcatcactcatcatcagagaattgcaaagcaaaagcacaacgagatatcacttcaacttcaccccagttaacatggcttttatcaaaaagacaaaaaataacagatgctggcaaggaggcagagaaaagagaactcgtacgctgttgtataaattagtacagctattatggagaacagtatggtggttcctttaaaaactacaagtagaactaccctacgatccagcagtcccactgctgggtatatacccaaaagaaaggaaatcaatatatcaaagatatgtcttcaatatcccacacttattgaagcactatttacaacagctaagatatggaatcaaaagtgtccatctatgaagctgggagcagtggctcacgcctgtaatcccagcagtttgggaggccaaggtgggcggatcacttgaggtcaggagtttcaaaccagcctggccaacatggtgaaatccagtctctactaaaaacacaaaaattagccaggtgtagtggtgggtgcctgtaatcccagctactcaggaggctgaggcacgagaatcacttgaacctgggaggcagaggttgcagtgagccgaaattgtgccactgcactccagcctgggtgacagagtgagactctgtctcccccccaaaaaaaaagaaaaagaaaaagaaaaagtgcccatcaatggatgaatggattttaaaatgtggtacatattcacaatggaatattacacagccataaaaagaataaaatcttgtcatttgcaataacataaatggaactactaaggacatgttaagtgaaataagccaggcacagaaagacaaatattgcactcatatgtgagaccatttttctcatggagatagagaatagaacggtgattaccagggattataaagagggaatgattaatgggtacaaaagtagagatagattagaaggaatatgatctagtgttcagtagcacaatagggtgatttagttaataatttattgtgtatttcaaagtaactagaagagtagaattggaatgttcctaacacaaagaaatgatacatgtttgaagtgaccagttaccctgatttgatcattacacattgtaggtttgtatcaaattatcacatgtacccataaatatatatgactattacatatccacaaaaattttcaaaatacagaaaaaaaagtttgcagttttaggagaattgcaaagaaaacagaagtctcaaagaggtcagcagcccctcatggggaggaagaggggctcattccctttgcattggtgttggggggctaatgaaagcccagtgatgtaaacaacctctctgacctttaaccctggcccctcctcccactgccccagattctatgcccaccagcccccatgggacaagatttgccgggctgagggaaggcactctgatgaccttttgcattgtgagcatgtttgatgctgtgggaggcagtgtgcccaagagcaccccagacaactccggattttgtacagccacatagtgcttatttggctcagacttcggcagcaaggacctgcggacaagctgtcctgggtgagctcctctgcagcttgagatacccatgcagatgcaggaagacaaaagcttctcagctagcatctacagccatgcgcagtaacttacgctggctgacagtttgcatctgttgggagataactgacccatttctcacatgaaagcagagactgtggctctcaaaccactctgggtatcagaatcatcttgggtgcttgctaaacctacctacttccctcagagtttagggggagtttccagccgacagcttttaattcaacttctctcatgttacagtgtcaccagctggagaaccacaaatccagaaccagggtatcaccttggaaaatgctggaataggcgataattagaagtaggttattattaaccataaagtaaaatgtctgaccattgttctttaagtccaaggttaaacagaaatcctcacttcgcaggaattagctgtgtaccacaagagggtgccattgtcgcaaagttgtggcactgcccttccagccctttgttatattcaatacgctatccaaggaaattttgaaaattatttttctatgttaaaaggctaaaaaaagacatgacacaaggctctaatattatggaaggtccgagaataaagtacaaggaggaacacatataaaacaagggaaataaggctgggtgccgtggctcacgaacctgtaatcccaacactccaggaggccaaggcaggaagatcacttgaccagcctgggaaacagagcgagaccccatctcaaaaaaaaaaaaaaaaaaaagttaggcctgtagtcctagctacttgggaggctgaggtgagaggttggcttgagcctgggaggtcaaggttgccctgagccaggatgactccattgcactccagcctgggtgacagagaccctgtctttaaaaaaaaatcatggccgggcgcagtggctcacacctgtaatcccagcactttgggaggccaaggcaggtggatcacctcaggtcaggagttcaagaccagcctggccaacatgatgaaaacccgtctctactaaaaatacaaaattaggcgggcatggtggcaggcacctataatcccagctacttgggaggctgaagcaggagaatcacttgaacccaagaggcggaggttacagtgagccaagatcacgcctttgcactccagcctgggcaacaagaacaaaacttagtctaaaaaccacaaaaagggccaggcacggtggctcccgcctgtgatcccagcactttgggaggcaaacatgggcagatcatgaggtcaagagattgaggccattctggccaatatggtgaaaccctgtctctactaaaaatacaaaaattagctgggcgtggtggtgcacatctgtggtcccagctactggggaggctgaggcaggagactcgcttgaactgggaagcggaggttgcagtaaactgagatcgcgccactgcactccagtctggagacagagcgagactctgtctcaaagaaaaaagaatatgtgatatatacataaatatatatatatatatatcacatatactatatatatatataaattatatatatatatacacatcagtgatatcaatgatatttatcagtgcccaattgggaaatcttgcccacacacttcaactgccctcattttctccaccccccattaggccatcacttttatttcttgtgcatccctctagtgttttgttataaaaacactagcaaacttcttattctttctgctttctgttttgtgccatttcagtagagagagcgcctccttgctgtggtttacagctgcacaatagttcattctctgatgggtgcgcctttgtgtatttatccattcccctatacatgaacactggggtctgatcttttactatcacaaacagtgtcgcagagaataacctcgttcaagtgtcattttgtactggtatggctggaggacaaatctcagaagcaggactgtggggtcgaaagcaaatgcacttgtaatgtgtaatgttgacagtgagccacgatcactccaccgcactccagcctgggtgacaaagtgagaccctgtctttaaaaaaatggaaataaaaattcacacttatattcaaacaaaaccgccctcccagtgggtttgtatgactttgctctcccgcaagcatgttgggaaagcctctatttccacagactcctccgagtgaatatacatacggtgattattttgagttcctagagaggccttaattgccaactttggataacaacatttatcacccatgaggtgtgcattaagagtgtttatgaccctagcatgggcttgatagcataactgggtgtgagaaggatcaatgacctggggccatttagccatgagtattatggtgacagtgttttctcttgcattgtactttcaggtgtttgtagatccctatttctgctgcctcaatttgtagcttaaaccgtcttctgcagcgtgaatgtttttcccagttttacgtttcattaggcctccagtgggaatcgaatctgagctgcacatctggccccagctgcactgagccctcaggtggccatgctgctgcccagctgtccagtgcctgggttcctacagggagttccctcctgtggataggagctttgtctttgtgcaaacttcccagctgtggaaactctggcaccgctttaaagatcaatgcatttcttggcaagggatgggaaaggcaaactcctctccacaaggattaagtcttacaccagaagccaactgtcctcagcctctgcagtgaggttgtctcctaaagaacattcaggctggttcccagtagtgcctgtgctggcggcacccagcgttttctagttaggaagatcacatcccatctggctggtccacatggttatactgaacttaaatctcttttgtgtctctatcgtacacatgaaagctcacacacacacacacacacacacacacacacacacacagtgtgagaagcactcacactgactcagcgtctgatggaaacggtgtacacagctgataagcactgaaggactttgcagaacacccagggctggaataggccagtgtgtgaaaccagaacgtgagccctgctcacttgccctttcctgcatctgactggaaatgctacaaacagaaggaaatagtgagcgaaattaacaacctcatgaggatcttgcttgtaagtttaatagcagcattcataatgaagcagtgttttattgggttaacagaggttaagtggcaatattagtaaagtggtcattatagattttcttctttgcaggcagtgaacagaaccttctgaaaggatggatgattataactcctcagcattcactgtttcttaaaacaggcctttctgaaagttttttttctttaataaaaattaccactttttccaaggacccctgtttgaggcgtgagtggagaggcttcatctttaaagaagctctaacagggaactctgtcggtcgtttgaggcttgctgccaacaaacaattgaggtatttaccaagggtttccaagaaattgctgcaaattatatgaaatgttatactggtaacagacgttcaatgtattagcaacagaaaagaaatgtgaagtgtgtgggaacaaagttgccatctgtgagaaaatgctcagtaaggtaggtggcgatgaactttaataatgtgtcataaagagtcacactcatgaacacagaagggaagttaagtgatctgggatttttgaacacatttctgaatactggtctggaatcactatggaggaccgtttaacgtgatccagcagaaagactcatttggagacagagccggactcccggagcccctccaggtggaactcactccacgcagagctcagactcggtcccacactcctgatccctgatccatcacagcccacctcttgggccactcctgtgccattgggactttcatggaataactacagttaagggcttccttacaagtgttcctggtaacagttaatacctccccttcttttatgatgagaaaaatggtcaatgattccctcaacagagaaggccagtagcacagtgaaatcaagaagcccggaacatgaaaagtctttcctcagctccctgcagtgaaatccctataaatgcgaatcaccctgcctactccttacctttaaaaattacttagggtgagggggctttaggatgaggacagccttggcctccagggggctgtggggaaggacgcatgtgtgtgcattgggggcagatgttccagaccctcgttgtcctccctggctccttgctggtattgactagtggggctgggcatgggacaggccttcatactgggggtaccagtcctgtccagctgtttgggtctctggctgtcactgaagttcttgattccaggtatttgctactggctgtgaaatccccacttaggatagccttgtctcctgagccaggccccttactgggacacttttggattcttccccaggagaactgcctcagctcaacaatccagctgctccttccagatgtgctagagcttgccctcctgctcctaggctgcatgccggaattggtccctgcccctggcagacttctacaggacctcagtttctctcttctccttccaaccctctcttggcctggcatatccctcttctcccagagggagttcccgtatgtcttactctccttctccagggaattgtaagccctcaggctcagcctttacaaagaaaagggtatcctttctacattacgaaagacccccattaagcctgcaggtgagacaggtgagactgttaacctaggaactgagggacaactagg

SEQ ID NO: 12112 - DNA, 9051 bp, Human
acagaggcactcacagaggacgggcgttcctcctgctcgctgaggttgcccggctctggcacagagtcatttcccataaacttgctttcactgtgctctgtgagtcaccttgaattctttcccgtgtgagatctaagaacccattcttggggtctggactgggaccctcttttccgacaacacttcccccacgcactgttcttgcagctttgttaaaggtctgttgttgttgtgtgtgagtccatgtttggactctctatttcccattgatctatgtgtccatttctctgccaataccacaatctcttggtgactattgataatagtgcttgtaaacttgggtagactaactctttatactttattcttcttcaaaatggctttagcaattgtagctcctttgccttgacatgtaaattttagaaaaaaaaatttctctatatatctacatatggtggggtgtggtggctcacacctataattccagcactttgggaggccgaggtgagcagatcacttgaggtcagcagttcgagaccagcttggccaaaatagtgaaaacccctctctactaaaaatacaaacattagccaggtgtggtggtgggcgcctataatcccagctactctggaggctgaagcagcaggattacttgaacctgggatgcagaggttgcagtgagtcaagatcgtaccactgcactccaccctgggcaacagagcaagacttggcctcaaaaaaatatatatatgtatatatgtgtgtgtgtgtgtgtatacacacacacacacacacatgtctatagctacctacaaaatatcttgctgagaatttgataggaattgcattaaatctctaggttgagttgaggagagctaacacctttgctgtgttgaagcttccagcccatgaacacattgtgcctgtcctttaccttaggtctttgatttcccttccttgggttcagagtttaagtcctgtccatatttggtgagatttttgcctacatgctgtgtgtgtgattacaaatcctgaatttccagtttcgggttctgtctactccttgacactgtgtgggaacacggtggatttttgtgcgattgaccttgctgacctcactcggttctaggaggggttttgtagagttcttgcaattttgtacctgggcaatgatgttatatgcgaatagagacaggtatacctcccccttcccaatctgcctgcctttagttaccatttcttgcctagctgctctggccggaatgacctgctctgatggatgggggagtgggagtggacacccgtgtcttgcctcaggactcaagtgctctccagggagtgagatgcgggctcgattgtaagttataaagtgatgcttccctgtgggaaaaagtacatccaatatagactgtaggacaaagtctgaaagtccactgcctcccatttccacccagtcttgcctgtgagtcagagagaaacagtgctaacaggcagtgtgcacctgtccagaggctggctgtttgagggacacaggtgtgcacacctggggatgtctgagtggaaggtacaggtcaggattatgaccgtgcagtcagtcacccactggcatgatgtctgtggcatcctggggcagccatggggctctcaggccctctgcctgccccacaggccatacccctgccctggacacagctgtcctcagtgctggcctctgacccaacattgtccaggagccccaacccagaaggtgctcccgccgctgccagcctggacccgacccaggcccctcccgcctgaggccctgccaagaactgcccagcccggacacagaggaggttcccgcgtggacgcagggaagagcctcccattgccccagtggaggaagctgcccaggggccaaggatgagtcacaggttcgaggaatcacatggcgaggctgtgggcggggatcttgtctgccctcctcctacataaggccccctgagcccacactgcctcagcatccctctggctccagagctcagagccacccacagccgcagccatgctgtgcctcctgctcaccctgggcgtggccctggtctgtggtgtcccggccatggacatcccccagaccaagcaggacctggagctcccaaaggtttgaggctgggggagcgggcactttactgtgggaggcctggggcgggtgggagctgcgggcaggcgggaagcccaggatctcagaaacctacaggaagcacagaatggacgccatgacgtcaggaagccctcagccctgctctccatctttagggtggcctctctggtttcccagcatcctaggtgactcattatttggactttggaacactcctgagttagcacacactggtcattttaagtacaggaaatttcatagcccaggatctggtagatagcagacaaccatccaatgctcactgtacccatcccagttagactcagccccgtctgcaccgggtgcaacgagagccatggtggggtgggaccgccgtgcagcccaaggccccctcagttggcagggacctggcactccatggccatggcgaccaacaacatctccctcatggcgacactgaaggcccctctgagggtccacatcacctcactgttgcccacccccgaggacaacctggagatcgttctgcacagatggtgggtttctcatcattgagacgggctgggcgggggctcagtctcccccctcaggggtccaggactgggtgggttgggcggagctggacttagccccaggcattttctgacagccaggggcttcactgtggcccttccatgagggtggggtggaaaaccagggctccagacgttccctgtccccttggatcccctgccccaggctctgggccaacagccaaccacacagtgcagccccaggtcagactgaggagaaggtctgggcggctgcgggctgcggtgctccttggacccggggaagttcccgtggtgacctgattttaggagtgacagtgaaggcaactccaattcaagtggccactcatcctattgtcaccacctttcagggagaacaacagctgtgttgagaagaaggtccttggagagaagactgagaatccaaagaagttcaagatcaactgtgagtgtccccaggccccaagggctggctcagtgctggcatgctagccacgctctcccagaggcggctctgctggggcatgagggagtggggcctggcctgtccccactctctctgcttcagggagtcagagtgtttactccggtcaacctgatgctgaccccagaggcatcttttacctggagggcaggggaagcactaattcttggcatgacatgactggatgtgggtctgcactgtgcccaggcacaggggacaggtgctttgttgcactgttcactctggcctcacaaaaggccagggaggctgcaggcgagcaggtgggcaggtgggcaggtgggtaggtgggtaggtggatatgtatacaggtgggcaggagggtaggtgaacaggtgggtaggtgggcaggtggctaggtgagtaagtggttaggtgaacaggtgggcaggtgagcaggtggttaggtgaacaggtgggcaggtggataggtgaacaggtgggcaggtgggtaggtgggtaggtatacaggtggacaggtgggtaggtggacaggtgggcaggtgagtaggtgaacaggtgggtgggtgaacaggtggccaggtgaacaagttggtaggtgggcaggtgggtaggtgggtaggtgaacaggtgggcaggtgggcaggtgggcaggtgggcaggtgggcaagtggctgctgttcccgtgggcctggctgcctcctgcgcactctggggctgcagctctggtcttaggctgagctcccaggcctctctgggggaagagagaggggcttacagcatgtccttggtccactgaattcttcctaacaatttgcaacattttgttctattttgttaattattatttttttaaaaagacagaggtggtcagggtctggggcctcttatcccctcatgggcacattttcccagcaaatacagtttgcttctcatgcttgggacttgcctcaggcctttctgaccctgcttgccctccccagaatcgagccactctccaaggtccatttcttctccctcctcccgcccctgtgccctgttcctgtgccatctcccgccatcctcacccgtacgtgacttctcagttggagtctctccaggtcacagcctccctgcctgccgtgtctgcctctccacggcacacctggcctctccccctcagccggggctccatggccctccacattgcctctcctcccctttcctccctggcttccctgatcatggtccacagcaggggccacgtcccatggtgtcagtggatgaggaagccacttagtgtggtgggatgtccacacacctgcacaggactctgctgagacggaggcttcatcttccttttggttcttctcttctttccccagatacggtggcgaacgaggccacgctgctcgatactgactacgacaatttcctgtttctctgcctacaggacaccaccacccccatccagagcatgatgtgccagtacctgggtgggtctcacagcacatgagctcaacgtgggtgagaggcagcagctacgtccgtggctgggaaccctggggagctgacaactggcttcctgtccacctcggtgcctgtgggctgactttttctttcttggttttttttatttgtttgttgtttgctttgtttttttgagaaagggtctcattctgtcactcaggctggagtgtagtgacgtgatctcggctcactgcaacttctgcctcccagattcaagcgattctcgtgcctcagcctccagagtagctgggattacaggcgcacgccaccatgcccagctaatttttgtattttttggtagagacggggtttcaccatgttggccaggctggtctccaactcctggatcaagtgatccacccgccttggcctcccaaagggctgggattacaggcgtgagccaccacgcccggccaggctgagtttttctccagcggttcatcgagtcctctgacaaagcaaggagctgatatagggccagtgggacggtcgccagtcaaggggctgggcttggtggatagattaatactcactgggcgtccagtcaaaacgccctgaaacctatgatgctgtcaaccaaacgaaggccaggaataccaaaatagccacataggcacagcccttccccatgtttctgagcacagtgtttcctctggggtcacacaggtgtcttcttgatcagcctcagccatgcttggtgagagccgggcactgggagagccaggcactgtgctctcctgtgacgctgtagacaccatcctaagctgtgcagaccccagcgctgcccagagcggagcagagggggccgggccaaggagtgggagctggggtcagggaacctggaggtgcagtggacagagccccggagaccgccctagggacctactccagaccaaactctgccagacctcggagcactggggcctccttctctgccctccctcctcaggcaaggcctctggagctccccagctctcatggaagccccaggggcccaggactgacccagcctcttccacagccagagtcctggtggaggacgatgagatcatgcagggattcatcagggctttcaggcccctgcccaggcacctatggtacttgctggacttgaaacagatggaaggtgagctctgcctaggacacgcccagcctcagctggaggagaagctgcctctttcttagcccgagccccctgctggctctgcaggactcaggtcactcctttttggcccctcccctgttctcccctggccttctggggtgcagagccaccctgaggtggggtcctgccctctcccaccatcctttcatcccttctctagccctggggctgctgtgtccccagctgtctcttctctcgctgacacctccactgtcccatctcctcccacagagccgtgccgtttctaggtgagctcctgcctggtcctgcctcctgggtaatgtatcagcctcgcccactgtctgcggctgcctctctgggcccctgggacagaccctactgtgtccagttcagggctgaccctacaggaatgaactggggtctggtcttgtgattccagaaagccaggctgctgacgtccccattcacgagcccagcctgtgtcttgcagccattgtattagtcacgggcttgtgccctatagtcagacctcatgctttcttttggggttaggggtgttggttggaaatggtgggggctataggaggaggaaggaggatggttacatggaagggcatgagaagctggggacctgcaggtctcggtcccacgttcttttttttttttctttttttaagatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccgctttagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgtcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaataaaagggtccactttcacaaacttgtgaaatgtctagaacaataaaaccaggacactcatatcagaattgatgagcccagaggaaaactcatagtctttaatactgaaatgggttagcaagaaataattaaaatcaatgaatctgtaatgagctcttgttagaaaaaaaaaagcgttagaatgaggaaagtaagaaaatagaatgaaggaagataaaagcaaaaatgacaaaatcagagaaacatatcaaattcatgcacctgtgcccccaggtggggaggggtgggcatggtaggatttagctcacctgtcagaaacacccaggaaaaaaaattccagcaagtatcaatcaccacagattaagagaaaatagattaaaagagtcataagggattatgctatttgactccagaatatattttttacaatccaaaagagatgatttcaaggcaaatataagcatccaaaacagatcagagaagactggagacagagtaggtaaggacccttcccaaggcagacagacagacacagtcagaggtctgtgtcccagcccagcccccagcatcgagagcagccgggcaagcggccagggatctcctgctcctttcgggaacaggtgaaacgaggcaatgtgaagagtcgcaggcatggggagggggcaaagcttccacactcgtttctaatgctgggaaaatatctccatcaaaactccacaaaaccaggccctaccaggagtaactaggacttgtgaggcagtaaggaacgtccgcactgtctatataacaaacaggccattttaacccaggcatgggggctcacacctgtaatcccagcactttgggaggccgaggcaggcagataacctgaggtcaggggttcgggaccaggatggccaacatggtgaaaccccatctgtattgaaaataaaaaaaatcagctgggtgtggtggcggacgacctataatcccagctactctggaggctgaagcaggagaatcgcttgagcccaggaggcagaggttgcaatgagccgagatcgcaccattgcactccagcctgggtgacagagcgagactccatctcaaaaaaaaaaaaacccaaaaaaacaacaacaacaacaacaacactcaaataggccatttcatcctcatgactgcccatggggcagaagcccttactgtctcattgcccagctggtgggtggcacatggactggcagggagtctaatacccacacatgcaaccattgcacctgctggctccatcaccacaccaccctgtgtgtcgaagcaaacaccccgaacagtaccggtgcccctggaacccagtcacacggtgagagaatcacagaggcgtctacctgagcttcacccccggaagacatctctggacataattgtgtaattaaaggatcaagaataccatgatttctctgcagatgctggagtctgttaaaaacattaaaaccctttccctttaagttctctacaaatggacacagagtaaatctctagcacgtgtcattaagtgagacaaatgaggcaaagaggcaggtacatggtctttgctgactttcatacaagaaagaatggaattaagactgtccacacctatttggaaaaagacacaggaggaatgaatggaaattaatgagtatggtcatttctgaggataaaaatgcatgcagagggtaggaatcgaagccagccttttataagtgtaactttcatgcagttttaacttttgaaccagttaacattttatgtatttaaaatataaaattaaaacaaaaagtaaaaggcgacaagccataaaatgaaaacagaaacaaatgaaact

SEQ ID NO: 12113 - DNA, 40972 bp, Human
ggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagatcagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacatggaaatataggtcacatatggcttttcatctcttccggaaatatcctatatatccttacttcttttctacctacctaacctatgtgcctaccccttcacttatgttcaaggttctattatacttcaaaaggactctatgcaatcaaagtgatgtccaagacaaatatacagaaatagtatgaggctctaacactttacatctaatggagtggtttgcatcattaattgaggcttactctgtgccaggcactttacctgccttcttcatttaataggataggagcaggaactcttagaggttcatttcttgttcaaggatatacatctcatctctggcttatatcacagtggactcttttattcactatcctaatcattataattttgtttggtgacaacaattctaaatgcagaaaagttaaggctctttattctgtgactaaaggctttgtattttctaaagatttgtggagctttgctgccattatttcaataattttataaagatcctaggtggtaaataggcctggctttttttctttttgaaatcttctccgtcttcttcttcattagcagtgcaacttcttgtggcatatggtacccaagatcttgggaaaaggattgatcaagtaaagggaaacgatagagagagtgtgctctacaactgagatcatgctccttgtgaaagacagggtagggaaatttcttattgctccctggttcttaagaaatgagagctaacaatgacatccagttttaaaagaaataaaatctgaattgtacttttaaattttataagccagagttaaaccaatagattgtaactcctgctaatttgatagtagctccagataatgaggaagtgacagggaatgctaatttcatttggtaagagataaaactgaaattattaatgtctccacggaaatgctaaatgcctccttacaagtagggtccggctaattgtctgtcttccaacaagccagatttgttggtgtttttccagacaatgttgtgtagttttcggtttggttcgatcccctttcttgtgatcaaagaaagtgattcaaatgtttaatgagtcttgatttggattggagacttgcagaacggctagcctcacagccccaaggctggctttccctaaggtaggtttcctatgcaccgatactggcaaggcgctttggctggaaactctggaaggaagccaaaggaaagtgaagttcctggcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcactcttttgctatcacaactaaccaatcttgctaagggatggttaagctaaaacacaagatctcagcgatcagagtttagcttggtatcatttacattaggaataagctgctggatacctctaaccagtggcagcttctaggaatacaaaaactacctcattcctccacctttcaagtgattgtgacatttgtattaaaactaatagctttttgataattttcctttgtttatacagatcgtgtacctcattctcagataattttttatgaatgaaatgaaattccaggcatcctttaaattttatttcaagcattctactggaaatgatgtgcaccctgcttacaaaatatttttaccttataacagtaatgcatgtttgctagaaaattcagaaaatacagaaaagtatttaaaaaattaaaactataatctccaaacccaaagataaccatttttaattataaaagtaataatttatttcaaaaataaatctaggcaacccaagaaaacataaagtagccagactcagtggtgtgcacctgtagttcttgctgctcagtgcctgaggtgggaggattgcttgagcccaggagttctgggctgtggtgcactatgctgatcaattgatcaatccactgtctgcactaagttcagcatgaatacagtgacctcttgggagggcaggaccatcaggttgcctaaagaggggtgaactggcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaaggcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgtggtaccagctacttgggaggctgaagtgggagaattgcttgagcctgggaggttgaagctacagtcagctgtgattgcaccactacacttcaaccatggcaatagagtgagaccctgtctcaaaaaaaaaaattatcagctattactataattatttttattagttcctcactcacctaaaatctcaaacacaccttagaaatacacatatgagaacaaccaaaaatgacaaagtagaagcacatatgaaaaggctaagaaagcatgaaagccagcaagaaataactgccgctcttctggtcagcctggaaagcaactggcattttccctagaacaatgttttcaaacttggttgcacattaaaatcacctagagaccttttaaaaattctgaaacccaggccacaccccgacaaatgaaagcacagtctctgggggtgggacataggcatcattttttgaaggtccccacttgatcctaatgtgcagacaaatttgaaaaccacagctttgggaggctgaggtgggtggatcataagatcaggagtttgagaccagcctggccaatatggtgaaaccccgtctctactaaaaatgcaaacattagctgggcatggtggcgcatacctgtagtcccagctactctagaggctgaggcggaagcatcagtgagggagaatcagtgaacccaggatgtggaagtttcagtgagcccagatcacaccactgcactccagcctgggcgacagagcgagactccacctcaaaaacaaaaagaaagaaagaaaaaagaaaagcagtactctggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaattcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatgaacattagcattctgccaggtaaagagatctggtccttagcacctcccagacacactgattctttactgttttgaaacatctccctctcctggcttcctccaccccgcttccatactgtccttgaaatcaatgaatggtaatttagtgtatctagtgtatcactagcaaatgtctgaataagaaaggtttggtttccgctgtgtctcctgttacaatgagaacatgtactgcataaatttaattggctacgttaatgtgtaagccttttctgcaaagagatggatccgtttctgaatattctgcagaagggcagagttttgagtatatggcagtggttctaattagcagttgctccaatacaatcagactgagacggaagctactcatttagaatactggttgatgacaacactggcttgaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcatgcctatatctgagtaagaaatgaaagtaattggtgatcaagagccaggctgttgtggaagcatgatgatggaatgtgggagcacaggaggctacagtgcacagggtacagtgcaccaggcagtcacttggacaaaggtggctgttttctctactcttcctgaaagaggggatcagattctgaagtaccttaactctaggttaccatttcccaagggattgaggggaaataaaatctttgtctcccagtatctagtacactgtgaagggacctctctatttgaaacatagagacagcagaaagaggagagaactaaaggaatagagaggcacgcatcagagtggtggcatagatcttttggtctgggtcttaggactcatatcaagtccctactggggatttgaactagatgcggtaaattggaaggttggggcgggttggtcatcacctttggaaaaaacagtaagtgaaatcacttatgtcagaaaactggtttacagttggctgattcatagaaacagccaccctgtgcatctttaagttgagttctcctgaatttggtgaaaccatgaaacctagaagccaagccatccatgcttggcctctgaccaccctcctgggtgacctgattcagccccagaaatgttcccctacccaaaaactgtaacactcattccacatttggggtctggggtgtcagaaaagctaagtcccatgtcagctgacattgagatttccgcaaagcattgctggagagtcagggcaagactttacaaggttcttactaatcttttctctcaccttagcagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaaactccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagctaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcggcagggctccgcgttgggcgagtgagtgagcctctataggacagcaggactgggactccagtggcaccagcggccccttcctcccgcaggaagtgaaagcctcgagcgccctggctctcaacccccagagatacaggcttttggcgccgtcgtgatcacaatgtgcccagcgatctagggtcagagatttggaggtgaccaaactatctgacactctaacaagtcctgtctcctctggcagatggaaagctataggctctgccagatgccagggtgcccttatgtgtgaggaaactacaatagtaaaaaacacaagtttctccaactccaggagcttttattcaaaatatatcaatgcctaactctgctcctaggactgtattttgaaacacccccaggtgattttgatagctgattgagagaaacttactatataactcctttgagaacctcatctcatttgctcttcccaccattgctgttggctaggtactaacatgcctctcttataacagcttcacagaggtcaagtgacttgctcaagttcacagagcaagtaagagagattctaacccctgtctaactccagaatgtgtgcttttaatttcttggcacttggaactttaaaagcttgaggacaggagaggggagttgcctctgctgggattttgcttctgctgggatggggcaagggtggggttccttcccttttaggaccttacatgtggggaaagtcttctgtggctcctcatttctgagcagtccccgcagcgcaaacttggccagttatccttttggagattgagttcccccagctccgtttcctcctatcacaatcactgcatttccatgtagattctgctgtgtctaagaatacagtggctgagggctggccatccctgtgcccttctccatggcagccccagaatggtgctggtgactcccgatacacctggaatgctaggtttctgggttctgctcatatcactgccacctgtgagccttgagtgagccactggcagttccggagcttccttctccctggagtaatctgagatactcacactctctgcttctgggagcaagtatgagtattaattaccagcccaccccagaaccagtgaggaggtggctctaggagtgctccatgagagtgtgtgatgggataacacaccccctggaaagaccagaagggactcaggaatgaagtggctggccagagccccacaccttcagctaggtgggagatggctacacatcagccccttgggagccctggagacttagttggccctgcttggaggctgtgggagctggatccctccccgctgcatcccttccatttttctccgtctcagacagagcagccttgttctcttctccttagtcacagaccattgtctggcacggagttctaggggtgagaagtgtcccgggacttggatgccccgcaaaggcccaatctggcatgactcctaaattaataatgtatttagctgtgggaagagattcttgcaagccaagggcccagagaagatgtccctgtgaatgtgtcactgcacaacctggcaccaaaagggttaccaagaacagcagccatcttgctgcagaggatgctttgttcccagctgaggagttgaataaattcattctagggctggtagaattctcattgaaaagcctcctttgccactttagggggctttgtctgcacctcttcccccagttccacagaagatgccttcagtccttgaattttggctcaggagttctgactctgggggcagggaggaaggggccatttctttaggaaaggagtctcagcttgctcactgtggtcagatgaaatgtgatttatctcttggtttctggtacctcagacctctgagacctgaggtgtattttgtctttggagatgagtccacccctgccccctcttagtccgttttcttctctgtgcccactcccctccttctctcccggcccatccctaggggctcgggtgacattctaacttctcacgggtactcagcccctttccctctgttttctccacagcaagccccgcccaacacggactggcgtttctctcaggcccagagacccggcaccagcgggtaggtgactgattctccagcccaccctcttctctgcggcattttctcagggatgacgtgggaggagatgggggagggcccagcatttgctacagatggcttctccctcagtttgagatcccagggaggtcttggtgtgcggggggctggcacacagaccccggaaggaagaggcgactgccctgactgttcaggaagctcaattcacatgcttgccccttccctcctcgccacgaccggcaccttttcctatcccctgagggcactgtggaaccaaaggatggtcttaagctggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtccttccctcagtctctatctcgctttgcaatctctgcctctccctctcttctccatctctgtcttagcttccgtcttgattgctgcacctcagcctcagtccctttcatttgtctacttgcattgatctgtgccgcccactgtgcctgccatggcataagtgctcaataaatgtggagtgagtaactacacgggacccttagtctctttctccttctctatctctgcctccctgtccttgtcctggacctcttttctgtttctcctttcaccgtttcctagcgccttgtgttcttctatccccagcctctatgtttctctgtctctcactatttctgctttcctctctgttctttgtctctctttgtctctgtctctgtatatctttctttgtctctgtctctggtctctgtgcctgttgtctttttctgcctctttctctgttactctttctttatctctctttttcttttatcttgtcttttttctctgagcctctgtctctgtctctcatttttttgtgcttgtgggcaagccagcacacacaaccccccacccaccacccaccaacaccccgctctcttccttccctgcccctcacacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacagatgctgagcttccaagagttatctttcccccatcctgcaaccaaccaaacccttgttgccacaaggacccaggagcccttggtgtatggcagagattccagcttctgggcatgcacagtcctgtcacccattttaggaacgcaaagcgcttcttagaaggcccctaaaaagcagcagatcaaaaggcttgggctgcccttgcccttcctttgaccccagctgttgtccttctccctgctggccttgccaaccttctcataagttatccattaagtcattaatgtattcattcgttcatttattcaacaaatatttatcgagcatctactatgagcagggccctgtgctaaacattgggctataggagtgaacaagtagatgtgatcccagaactcataggcttccagaccagcagaggagactgaaaatttgcaacaagtaacacttaaaaaaaaaaaaaaaggctgggcactgtggttcacgcctgtaatcccagcactttgggaggccaaggtgggtagatcacttgaggtcaggggtttgagaccagcctggcagccaacatggtgaaaccccatctcgattaaaaatacaaaaattagccaggcgtggtggcaggcacctgtaatcccagcgacttaggaggctgaggcagaactgcttgaacccggaaggcagaggttgcagtgagctgagatcacgaaaaaaaaataatctagccacaaatcacagtaagttctgagaggcagagaacaatgtgagtgtaatgggggggggaagatcagagaaggcttctaggaggaggtgacattgagaagttctaggccatttatgttccctctacctaccaccaccccaggccatacactggctttgaagcagaattcaccattgaacctggaagccccaccaactgcctctcatgtgtcctctggggtgagcaccttacccctgcctcaactcccattccatcaaatgagaggcttagtggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgggtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgaccaaataattacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagctgagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccatttcccccttcttaggctgtaacccaggccctgccctgcagctgtccccagcctctgcacaaagagtctccatttggtccctagactgttctctgatggctccacactaccatccctcctctgagagacagtatccctgctctctctcagtttgggcagtcattcaacaaacaaatagcaacttaatttttttccacttataaaatagtacatgctcattatagaaacatgaaaaatagaaaaaaaattaaaaggaaaaccacccatcattttacaatctagggagaaccaccaccaactacagtttaatatgaaacatttcaaatatgtacaaaagtagagagaatggtgtcatgaacctgtatgataccactatccagcttcaactaatgccttatcttgtttcacctatatccctacccttatcctgtccttggattcttttgaagcaaatctcagacatcatataatttcatcttggtctccaccatctttaacagatgacttttttttttttttttttttttggagacagagtctcactctcttgcccaggctgtggcacaatctcagctcactgcagccttcgcctcccgggttcaagcaattctcatgcttcagcctcctaagtagctaggattacaggtgtgcaccaccacacacagctaatattttgtattttcagtacaaacagggtttcgccatgttggccaggctggtcttgaactcctggcctcaagtgatccaccctcctcggcctcccaaaatgttgggattacaggtgtgagccaccttgcccggccagatgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgctctgtcacccaggctggactgcagtggcgcaatctcggctcactgcaagctccgcctcccaggttcacgccatgctcctgcctcagcctccagaatagctgggactacaggcgcccactaccacgcccggctaattattttgtatttttagtagagacggggtttcaccgtgttagccaggatggtctcgatctcctgacctcgtgatccgcccgcctcggcctcccaaagtgctgggattacaggcgtgagccaccgcgcctggccgagcttcattttaaaaaaatctcattcacctaaataagttgttcacaaacttgtcacactttcatgtgacactttattcacatattaagaactgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaattttttttttttgagacagtctcgctctgtctccaggctggggtgcagtggcgccatctcggctcactgcaagctccacctcctgggttcaagcaattctcctgcctcagcctcctgagtagctgggactacaggcacgcgccaccacgcccagctaatttttgtatttttagtagagacggggtttcaccatgttgaccaggatggtctcaatctcttgacctcgtgatccgcctgcctcagcctccctaagtgctgggattacaggtgggagccaccatccccagcctcatttacattttaacacaattaaattcagggtgttgtcagggtgacttcctagatttctcagttttttgagcatgatgtagggagtattttattatagtccagtctatgggatattcccttatacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcctccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcacataattggcagcccacccacctgtttggccctcaaccttcaaccatttcccaggacgcctccttacactcctgatcatcatggttccaaccccactgttccactcagctttgttccctcaacaccactgctccctgtgacaggtcatcctcctaacctctggcatctggtcccgttgtctccctgacaacccgcatgctctcctccctgcaacccccgccgcttgcctgctctccctactttattcccattagcccccttcacctggggctgagaacacctggccttgaccctgcaccctcagccaggcccacagagctcagtcgggccggaagtaaggaccccagatattcagttgaggaatttaacattaatacaataatatagaatccaccagcagattttcataaatgttctgtgtgttcttttatccttttttttaatccaggattttatcaaggagcatagattgcatttggttgtcacgtctttcctctcctttaatctggagccagctcccagtctttttatttttttaatgacatggatatttttaaagagtccaggccagttgtactttaaaatgtccccgaacctggatttgctggctattctctgatggttagattcagattacacaccttggtaggaatacttcccgcagcatcacactgggactcatctaacgtcggcctgtcccactatcagtgatgccgagtttgttcgtgtggtaaaaacagtgtcccagatctctccattataaaaatatatttttataaagatattttaaaatatttgtgaaaatataagtaatctgtggatgatactttgagataggcagcaacccttcatgcaattttagtattccctgatgatccttgcctgtatctgtttttacatcagtgattacaaagcggtgatgttctgtcattccttctacatgtatttgctggtattcttctgaaaattacctggatgatttcttcagatttaaattcactgtcttttccttggggaagcctggactggctgagctgcctaaccctgactctctgtcttttttttttttttgacagggagtctagctctgttgccaggctggagtgcagtggcaaccttcacctcctgggttcaagcgattctcctgcctcagcctcccaagtagctgggattacaggcgtgtgccaccatgcccggttaattttttttttttaatatctattttagttgagacagggtttcaccatgttggtcagaatggtctcgatctcctgacctcgtggtctgcccgcccctgcctctcttcataccctctggtagcccctgacacagcccatggcaagtatcacaattgcaattactctattgtgtaattatttaaaatcagcctctcagtgcccaccatgagcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggccgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaaaaattagcctggcacagtggcaggtgcctgtcatcccagctacttgggagactgaggcaggagaatcgcttgaacccaggaggtggatgttgcaatgagccaagatcgcgccactgcactccagcctggatgacagagtaagaccctgtctaaaacaaaaagaaaaaagcatcggaggcagcaaagagctggtttgagggactgacttgtgggattctggcttctgaaggattgtagaagtgcctcctaccttgctgagagaaacaggtcttgggcatggggtagggttagggtactaggtttgggagccctgggagaggacaggaggggcatgagctgtgccggcctgggagtctgtgctcaccatcctactctctccccagctcccaaaatggcgatgacaccggcacctggcccaacaaccagtttgacacagagatgctgcaagccatgatcttggcgtccgccagtggtaagtggtgtcagtgtgtgtatggaagagtgggagacctggggttctggggtgcatctcacagccaccatgcccacggactggatgtcaaacctgtgtagtttctccagatctttcggcaggtctgaaaggacccacaattccaaacataaagcctggaattgtggctaaggaacagcagaggggttgggggtcctgggatgcctggaggagagcgaacaaggaaaagactcatggagggaatagtggttacaagtctagctctggaatgggacagtgtagctcaggtcctagctctgctactatccttgggacttggatcgacttgctcaatctctctaaacctcagtttcctcagcctagaaagtggggacagggaccccaaagggttgttgtagagattaaatgagatgataccacaaagcatagagttctgggcctggcgcttggaagccctcaagcaatgaaagtgggtgtagaaatccccagccgagagaacacctcctctttatgcgaggctcctcttttgctgcccctaactccagagtaggattctggttttcccataaggttgactaagggcttcctttgtaatagagattcggctagtggtggttgtccctgaagagtcactagggcccagagcaggagaagaagaatatcatttgtccttaagagcacagcctaagctgggcgtggtggctcacgcctgtaatcccagcactttgggaagctgaggcaggaggatcatgaggtcaggagttcgaaaccggcctggccaacatagtgaaaccctgtctctactaaaaatacaaaaattagctgggcatggtggtgcgtgcctgtagtcccagctacttgggaggctgaggcaggagaatcgcttgaacctgggaggtggctgtggtgagcagaaaatcgcaccactgcactccagcctgggcaacagtctcgctctgtctcaaaaaaaaaaaaaaaaaaaaagagcacaggctttagaggcaggccaatctggattcaaatcctggcacctggcaccaccacttagcaatgagtccttaggtaagttattaaaccccctcggtttcacttactattaatgggcacagtattaacggatctcattgtggtgttaccagggccaaatgcaagtccctcagcacaggattggcagagagtaagggcacaatatattattatctttgctgacccaaacccgttttttactgggtagaaagcagaattagaataatgcctattaataaagactagcttctggagcagcaaatcctgggcttataaggaggctggcagaggatcaaggcattgccctatatcatgaactgatagccctgccctccagcatgtctggaggactggtgggtagagaaccaggtgaaatcacaagaagcactgtcatcacacctgggcacatactaaacaaactttaggggcctcctgtcaatgaatcctctcaatagctctgcaaggcaggtctgatttctcacactcgacagatgagagaaccgagaaggcacttgccccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtggccttgcgccctgaggccaggaagcagctttttagcctaaatccagatgttaaaaacagaaatgaaatcagtatttatggccccaaaccctccaagcaagtcatgcagctcgttcccctgtcaaggcctcccacctttggcccacacagggcctgaccctcgtctaagcctgcgccctggggaacggaccctgggggtggaggtggtgggtcaggccctgctctcactttcacacccgcttcctagccctgaaaccagagaggttcctgaagtccagcccagccaggcctgtggggctgctgagaggggttaagtaagagggagagtaaaaaccgacacttgggaggaggcttttaaaataaacatctgcggggagggatgctctcaaggaggctgcggtttgcagctcagccagctgtgttccagctaatcagcctccttgggctactctggagttgctgccttggccctgggatggggtaggttaagaggacagagggaggtcagggagctgggggctgagtttccctgagtagaggctggcacaggagagaaggcatcacccccacctcgtccaggccagaagatgtccagcttcttgaggctctcctaagtctgcctctcctgggaccaagagaaaatcccggtccttgaccaaggtgggccttggggggagtggggtgtagagggaggggcactggagaactgactctacagaaagtcaaagctggcaatccaacttcttcccctcagatttatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctccctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggggccagctggggtaggagaggaggaagtgggcagctgctccctcccactcaacccctctcccccgcccccagaaagctctcagctccggggatttgcgacatgaaatgggggctgtagaaacctgagcgctggtgcgtgaagagaaaaaccgaggcgcatcccggctctcccctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggcatgctggatgtgacggtgttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgagctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgttttgaaatacaaaaattagctgggctagtggtgtgcacctgtaatctcagctactcaggaggttgaggcaggagaatcacttgagcccaggaggcagaggttgcagtgagccgggatcgcgccactgcactccaggctgggcgacagagcaggactccatcttaaaaaaaaaaaaaaaaaaatgctgttttgaaatggaggcttggaagagcactcttcacccccaccccacacacttactaacggaactaccgaatctctactcgtgccaggccttgcttggcaaaggctaggggcatgtaaagccatggtttcatggctgctgccctccaggagcccatggtctagtgtgggagtcagaggctcccttgagaaagccagggcaaggaactgagagcccgtgtcacagccctgagagaaataccagcgaatgtgttttgagcacttacatctaccaggcactattttacgtacctgacatacattttcttatttagcattcactaaaaccagaagaggtggttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactctgtgtcattgcgcgtctagatgtttccgaattgcgtgtgtgtgtgtgactgtgcaatatggttgtgtatgcttgcaatgccgttgtgcctatgagacagtgtgcgattgtgtgcctatggatctgtgtaccgtgtgccattgtgtgatcggtccgctgtgggggtggggatctgagtgcggcgtgtcagtgtgcagtggagtgtgcagtctaagcttgcggctgtctccaggcagaagaggagaccccggcgcgggcgggggcgggttggcgccgggcaaacgccttgggtagaggggagaggacgtttcgttagttcccgccccttcctgactaaaattgcctacccgaagcgccccggagggcttcacgggaggagggtagactctcctttgcccccgcacccccacccccgctgcctaggggttttgggaaagccgcgggagtgggagggaatgcgggaggtgattcttccaaagccaagtctgcagctcgagcctcagtttccccatctggaattcgccttcccgctgacatctccgtagcgaagcctaagaaattggagggctcatcctcttcttgcgggggtcaaggggactgaaaggacgtgcaggaaatgagatccatcgcagactcagctcccctccctccttcctgtcggtgcttttccactcactcgcctgctctcccatctccccgccccctccgcctgcctcctcgaagcactgtgggattccgaggttgctgcagccagagaagctgcagaagaacacggagctgggggtgaagggggacttaaaaggggaactacccggaaggacccaagaacacaaagacagagccactggggttatctggctggtcagcaagggtatgcggcttcctccgcgctgcggaggctcccagagccaggtcacccattctgccagctcaagtctgttgtcatgggaaccaaaccttccaacttaagaatctgggggcgactttctagcgtgggaggaagggtggtgtgcacggttgctgagatggaagcagggttttgttactcagagccaggctgcggaggggcggggtgccgggcgcctgggttctattccaggcacagcagcagactggcagagcgcgtgagcagctgtggtttgtcccctaattggtatgtgtgcctataaagctctgaaccagaaaggcgtggcctccggggggacgggagggaggcggcaggcaacccatccccacacctcaggccatactgaggaggcagctgcccaggctccagggctatttaaaaggcttttatttccagttccagagcccgcccgaatgggtttgtggtcctctccaggcctctccctgtctatcctgggcctgctcattgctggtctggcttttttgtgcaggtcataacgtgctcagacaagtatggctccaagtggcaagtcatctggagcatgacctcaggctcccaacctctgctgggcaggctcaggtttccaccccagggtaaacccctctactctggaatgtggtctgtggccaccaacagagcagaggggatgagaaaatgggagccagatgcttccctcagcaagagacacaggtactgccaggaaaccttgcgtgacatctgggaacatgaaaggttccaagtgagttccaaaaaagggctccaaaccaagtagcagcaatgtggaagagtcagggagctgaaccaggcgcccactcctttactgtggccaaacggccctgaggtgagctctggtggggcagcagccaccatgtattaatcatctctagccctgtgcccaagtaaagtgtctggcacctttagctttttcacagtgatttgtcaggtcaaccagggatttgaggcaggaaagactagaggagcctggactagagtgaaa

SEQ ID NO: 12114 - DNA, 8959 bp, Human
acagtggctcatgcctgtaatctcacactttgggagaccgattgggaagattgcttgagcccaggagttggagaccagccagagcgacatagtgggaccttctctctacaaaaacatttaaaaattagccaggtacagtggtgcacccctgtagtcccagctatttgggaggtggcaagaggatctctcgagcctagaagttggaggtggcagtgagtagtcatcttgccactgcactccagcctgggtgtcaaagggagactcccctctctagaaaataataaaaaaaaaagtttgacagttttcttgcttgtgctacataaaataatggtacatattacaattgaaggcatcttataatagaaatgccctttcctgttcccttttaaggctgacccagtgctttaagaggctgatacagaagggtaaagttaagtctccacaaaatccagggaagagactgtgaaactcatcttagaaccttgtatggagtcacagctgaactaggaaaaaaaaaaaaaaaaaaaaaaggaaagaaaggcattccagagataaagaatagactaaggagaggagatatttgaagccataatgattgagaatatgtcagacttgaaatgaatcttcagttccctcaacaagacaaataaaactaactccatacctagatacatggtagaaaaactaaagaattctgctgaccaaggtattaaaagtaactaaagagaagtggtgtgaagaaagcaagagagaaacaacaaatcctgtccatcctgtaacaattgaaaatttctggctgggcgtggtggctcacgcctgtaatcccagcactttgagaggccgaggcaggtggatcacctcaggtcaggtgttcaagaccagcctggccaacatggtgaaaccccgtctctactaaaaaaaaataataataataatacaaaaattagccgggggtggtggtaggcacctgtaatcccagatactcgggaggctgaggcaggagactcacttgaacctgggaggcggaggttgcaatgagctgagatcgcgccactgtactccagcctggatgacagagcaggactccatctcaaaaagaaaggaaaagaaaagaaaaaatattaaatgtgtacgctctttgactcagctgtattacttcaaggagttgatatcaccaaaattgcctaagtgctcaaaggtgtttgtagttaaacaacaggagattgataaattatgttatatacatgtgatgctatgttttaaagaggtactgatatgataaaagatgtacgtggcataaaattaaatgtactttattaagtacttttccaagtgtttacggaatgagtgcatttttgaaaaaaaaaaagtgtattcgaacttttaaaaaagctttaaaagctttatacaatgaacgattgagtgattataagagctggcgggggaatgttaagaggatgatagggagctaagtttaacagaacaattcacctctttatcttgtgacacctacgagcgcatcaattctgtaattgaaaaataaagtgcatatttgcagcagctgtactctcttcaggctgcaaggaggcttttcctcccggtaggcttgatttgcatttcactttcactttcgtggctggaaactttctacccacgtagtgggaggctgaggagccaccataaagctggggcttgacgagccgggaccgggacccgatctccacatatgcccggacttgttctgcggccgggttcaggagtcaaagaggcggggagacctgcgcgacgctgccccgccctgcgcccgcttcctccaatgtatgctctagggggcgggcctcgcggggagcatggacacgattggccctaaagtcttccccgcaaggccgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccaggtgagcctcgcggccccgggaagccggccccggcccgcctgcacctccggtgcttggcgggagcgctttcgagcctagccctcattggctggcgtgggccatccgcgccttctcattggcctgccacgcagtggggtggggcccagctgagcgcgcggttcggaaaagcccgcgctggctgctgcgcgaacctgctttttcgcgccaaagtcacaaagcgggtggtggcgggaaaatcaagggtttttccgcagtgccaggaacactgttccagggctctttgctcactaaatcctgttggccttgaatggacgctttagctgtggctttcttgtttctgagacggtctcggtgtgttgcccgggctggtctccaacttctgggctcaagcgatcctcccggctcagtcgcggttgactttaaatgctttataatgcccttgcgagaaatgtggcagcctgtcatcctacttagtggcaggagattgtttctatccagaagggacactgctggtggtattttagtataaatactgccagatgcgtcccaaaacgtctgcattaataatggcatcctccagcagtccgtttaccctccaccagttctgagacggcctgatgggtgagagtggtaaccccttctaaccgcgttcgaaatacagcccttcagcagacggcgttgattttaaagcatgtgtctcctgtcttctagtatgtccaaaatactaaaatgcgccggcaatgaagatatcattacactaagggccgaagataacgcggataccttggcgctagtatttgaagcaccaagtaagtcgtacctttttaccgagtcacgaagctacagaaaatcaaaactctgtgtcagtatttctcaaaagcatctgctttcttttggtagaccaggagaaagtttcagactatgaaatgaagttgatggatttagatgttgaacaacttggaattccagtgagtatcagtttctcattgtagagagtgctgtacacaggcacgatagttatgtcatagaatgtttgtttatttttacagacagggtcttggctctgttgcccaggctggagtgcagtagtgccatatagctctctctaacctgggattcctgggctcaagcagtcctcttgccttagtctcctaagtggctaggaaggactacgggcctgtcccaccacacctggctaattttttcatttttgtgtgtgggcgtgggggcagtcttgcccaggctggtctggaactcctggcctcaagtgatcctcctccgtcaagatatgttaatataatttaagcctacttcataacaactttttctagaaatatatctactggtgcatgtttcaaagagagattttagtatttggatagttgttcaccacaagtctaaaactcacaggttaaatttattgtttactgccagttgtctatttgcattaacttccatgaacctcttttaaaatttgtttccttctagaatgcttgctttttattaagtggattttaaagctgacttggaagaaatttatccaggttaggtttataaacaccaaaggagagaagaaatgtttgaatgttgaaaatgcctaatatattctcttgctttcttttagaaagtagttaggcctgcttgcgccatcatgatttctgtgccatactctaatgttctcttactttatccctggaggatgaggaggaggaggctcttgttccctggatggtgcatttaatagccatttatttttttgagtggagtttgttaagaaattacgcaagtcatattttaaagtaatcagaaaatattgattctgagttgtttaggtgttgccttttaagaaagtgagggtgccaaatcattaaatttctaacaattaacttttggaaaattttgttcttaataggaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgtaagtagtttttaagtaaaaagaaaatagtttgaagagaattataatactgcttattaggttaattgctaaaattaaaagtagacagaattggatcccaagtaatttctgaaaattgagatactgttgaaatctgcgaatgatttataagtgtcatccaatttagaattatatttgcaagaagggaatacaaattcagcacgtgtacataccacagaacagtggtttatggatcaagtccacaccggctcttaagggtaggattgggaagttaggcgtataacctttagctttctggagatacttactctcttaccaaataattgagcataggacagcagctcaatagaaggatatggttaggagtaaaagtctacctgtttggagcacttatgtaatcctaatattagcttacatgttgtgggtccaattggtagcccattttaaaggtggagaagcaggctgagcaaccttaagtgacaatttagccaaagtcacaggctgtaggaatcaaaggttaaacaggaaggagacttctcactaaggctagaaagcagactccatgcaactttgagagtacctagagagcccttgtttaaccaaaatagaaagaacatggcaaaaccccatctctactaaaaatataaaaattagccgggtgtggtggcgcacacctgtaatcccagctacttggaatgctgagatgggagaatgacttgaaccgaggaggcggaggttgcagtgagcccagatcatgccactcccctccagcctgggtgacagagcaagattccatcttaaacaaacaaaaaaaactcgctaacctgggcataaattaaaactttgtaaatcaaggacaaaggtcctaacctcataaccttgttaggattaaatacggtagcattaaagagcttagcatatgctgtgtgtggcatattataagcttacaataaatactatatattgctctcttgtcccttgaatgggtagtcaacatttagtttaaataaaggtaaaattcagttgaaaggtttttttttaaattaataaagtctaggagctgattctttatctgtttcctgaatcacatttccactcctgccaacctcgtttttttctttttctgtttttctttgtttttgagacagggtcttgctctgtccacccaggctggagtgcggtggtgcagtcggttcactacagcctcaaactccagggcttaagtgatcctcctgcctcagtttcccaagtagctgggactacaggtgtgtgccaacacacctagcctggtttcccctaatttcattttcccccttccattacaatctatttgttgaagaaattagatcatttattaagttttccagagtttggattttgctgattgcattcctgtgtatacataaattcctctaccctgtgtgtcctacagactggtagctatagccctggagccttgatattcagggtgttttgtttcgggggtgagagagcaagaatataggtggtggtgtgtgcctctagtaggaggcacagggtgtctggatgtgtttgcaatgttagcagctataatagtcattgtctagatccattaagtcattaattagagtttgcagagctgaaattaatacgttttattcacttattggctgcttattagaaaaacttccataaagaaaagctttcccatattatataatttggttatctaaattatagctataggaaagacaagctagataatcgagtcttttgctttatgtatcagtcttcaaaattttcatagctccctccaaagtgaccaatacaagtgtttgtgggtttttataaatatataatgagctaatagattgcaactttcttgatgtttttcaatgatgaatcttttgttttgtaggttaccatagagatgaatgaaccagttcaactaacttttgcactgaggtacctgaacttctttacaaaagccactccactctcttcaacggtgacactcagtatgtctgcagatgtaccccttggtaagataataaatttgaaccttgttttgtaggtagtcatatgtgatacatactcctcagtaattaaccatcttcctgtctttcagttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctccaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatcacagggcagtgtcttcattttgaccaggactgttggaagtatcctactgaattcccagctacagctaccctttcgtttaaatggtttttcagtttagagcagcctgatggagatcaaaaggatttcaaatacagtaggttactagatattttaggggattcacttgtcaaacttgttattccaatttgagctcaaggaacaagtgagagagtagtacaaatcctgtgtatttcattttatttggcaaaaattaatactcttcagaagcttaatgtacccaaagtcgtgtgggctttataagatgttaatggagtgtttctttttagcctggggaatcttacaagagtcttggatgtttcagtagagctgtaatggggcccaaggagtatggttgtacaaaatttctctagtataagtacactttgcaacttcactcaaaggatgaagatgtcttaaattccacggatgttggatccaaccaagaaagtgaaaaagccctgaagttgtgaagaaagacttaaaaacattcccactaatagctacaagttcactgtgtgctgtgtattaagaattttttgccaggcacggtgcctcacacctgtaatcccagcactttgggaggtaggcggatcaactaaagtcaggagttcgagaccagcctggtcaacatggtgaaaccccatttctactaaaaatgcaaaaaaaaaattagccaggcatggtggcacatgcctgtagtcccagctacttgggaggctgaggcagaagaatcacttaaacccaggaggtggaggttgcagtgagccaagatcatgccactgcactccagcctggtcaacagagtgagactccatctcaaaaaaaattattggctggtttaatagtagtaggttatcagaacttactaacattagtatcactaaagtaggtatacaacccctgctgctcaatttggctttagaaaaaacatttttaaaaactgctttatcataatccttttttccagtgcatttttgtgtttggtagattaaatgactgatttctttcttaaattacttggactgagttctagttactggacatgagaattaaccatgtccagtagtaagttcattttcctacagtgtgcctgtgagtggagaaggaaataggctgcaaaagagcccgatggaactttggggtgatggatatatttccatctagattggtgatggttctaggaccgtatgtattttcagagctcatctatttgtacttgtgtataaatacttcaataaacctaactttttaaaaagcttcatttgccgcaaaatgtcccttgtgggcaggccttttacctggacaagccctaaagataagcacaagtttgtggggctattcaagggaagtatagtggggtgctgacagcacagacaagtgtgctattcaagggaagtgtggtagtggggtgttgacggcgcgcgcccatggaaggctggcgccttgcagcggatatctggccgctctgactgctggtcctgaggctcgacggactcggcttctgcctccctgggaagccacggcggtctctagcctggcccctgtactgaggaggggagaaaccacgtagccggcttgccctggacctgactgtgacccaggtaggtgaggaccctaggtgctcgcccgccacagcggaggtagccggcggcaggcacaggtcgcggctgcttaaacaaaacccacgaagaagcattcgggccgtgcagccccggagtcccggtgcctcctgcaggtgacactcggtaagggttagcccgggaagctgggtaaagagacaaacgcttccggagacgcaacttccgacgcgcctgtttccggcacgccacttccggcgcactgatcccgcctggggccggctgagtggcacttaagcgggccatgccatgcaaccttgggcgctgccaaccgtgggcgagctctgggtgtgcgggcggcctggcgcggcgctccggtaa

SEQ ID NO: 12115 - DNA, 104475 bp, Human
  misc_feature (1)...(104475): n = A,T,C or G
gaggccaccaccattgtttctgaagtgggagggcagaaaggaggctgagggccaggtgagacctcgtcacacctgcacccatgcatgcccaggaggaaccctcctttgaactcttctgactcagcttcttgctgccaggttcctccgaccagtgagcaggttcccaggacatgaaggggagctgtgagggagcaggacgccatggtccagggctgcagcttcctgagcccagagaatgccttcctagctgtcaggaatggagcagcgaggccccagtgataggtgaggtggagaagcaagacatgagttctgggctggctcagctgctttacaaccagcctgggcctcgttccctttgagaaaatggtttgcccagagttcagagatctaaaattctatgatgccttctggggccacagtgggaagcaaagactcctcatattttctttcctgacacttcccaggccacaagacaactgctttctgcagcacccagcctgggcaggccatctacacaagctcagtcatttctgaccttgccccctccaccgtgcacccccatgttcttcaacatgggtcaggtttctattcagcctcagggacttctctgcttgaagcctgttgtgtggcggggaggtattctccccacagctcagagagatggggttgctgtggagggtttgctgtagctcctctaccctggaatataccctcttctgccttaaaagacccagcttggaccctctcttccagaaatgcttgctaaccgcccccccaccacccaaactaggtcaggggtccctctgggcttcacagaccctgtgcttctttctgtcacagcctgcaagtctcccctccccactccccagcccgagtgcttctctgagacaagggatagtgtgagccatgagctcagccactggtaggccaatgaataagtaagttaatggtgaagccaggatccaaatccccatttcctgcctcaaggtgtggagctgtttctcctgcatacaatagtagctctgctgtgacaactctctatctgtcctagggcctaaaatgcctctatttcactaggttatagctttatcctagggagtcctctttggaagcagggtgggggtgcaacaggccttcccccatgcctgtagtctgtgagcagcgaaggccatgtggggcaggctgtggcctaggtctccacagatcctggtagaagtccatgctcacgcatcagctccaagtcccagctaaaccaagccaccaagaggtgggccctgtgacaaggctctgagtccaaaggccatcagtaaagccccctaagtcttccgtggacccagctccaggctgggatgcacgctaggagatgatacacaccgggtgagggagcccagaggagagggcagctagctgtgcatggaggcctgatctctcagacttgagggcacaagcgtgtcccctcatcctgaaggcttctgcgatggggcagcagagggtctgggtctgctgcccctcaagtccccagccccatcctagcccatgaggattgtaaatccctcgtcctctcccctctctcctctgtcagccactcccctttccccctaccccactctctttctatttctgcctctgattttttttccttttctgcctttgttcctctgtgtgtgtgtttctctatgcctctctgatctctttgtacttccatcttgatctcgctaaggctctgatccctctctcctctccctcttcatgtgttactgtcccccttcctgtctctgtttatctctcagtctctctgtctgtgagtcttttttcctctctcccagtcagactctctctctacccctccctctctccctctctccctctctgtctgggcctctctctgttcctcctccctcctccctcccccttctgcattatcagacctgctccaacctcctcccagagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgtgagtatagtgaggggctggggtggtgagcggctgtgagaggtgccacagacagggtcctgggagtccctccaaggagctggggttggcatggagctgagccacgtggaaggatcgatcctgttcctgggcacccctcctccccgcgttgccagactgcagcctggggtgggggcaggttacctctgagcagaatgagggtgtctaacgtcaacctagtaggtgatgaggctggggtcccatggaaggggctgctggttggaggaggggctgataatgaacctgaaccgcttcttcaagggctgagggtgtatgtggggagggggaggtctgccaagtagttgggaggagctctcggggctgcaataggctggttcaggaccctggagagggagagtgtcttggcccaccaaggctatgtgtgtgtgaaggaggtggggagggggaaagatggagaaaatatgaataagagtggccctggagcaagagagggttagaggtaaccaccttccatggaattgggaattggggttcagggacaccactttatgaaactttaccccaaagcgtctgtcccaggatagggttctacggagccagatggaatatggtgccagcctcgtgtgtgtccacgtgcaggggggtgcatgtgcaagtgagtggggggcgccgtggcgacacccctctactaagggctgccgaggtggtaggcatgtgtgtgtgtgtgtgtgtgtgtgtgtgtatacatgtggaatgtaagggacatgttgggtgtagaggggcctgtagagctctagggtccttggtggttggatgtaaagcagcctgtcagagtttgtgatcatccctgtgtgagtgagagtttattcgcatgtgtctgagtgtgagtgcaggttggtctgcatatgtatgtaggtgtgtctattaggttgagtttgtatattatgtgtgttgtgtctgcaaaatagagtgaatcagtgtgcattttttatctgttccatgtgcatttatgtgtgtgtatttgttagtgtgtgaataatagcattgctgtgtgtggaggtggatgtggctgtgtgcgtataagtattctggtgtgggtgtgtgatcatggtgctagtgtgtatatcggtgcttctgtggctggtgtgtgtgtgtatctatatgtgtgtattcatctgagtgtgtgtgggtggctgtttccttcccctggcaattgaggatacagctgggacaccatggcccactgatgcagggcagggaggggctgaatgtatgaccgcctctttgaactcaggacaattcattctacaccctgtgggaaagatgcagaaaagaaataggcaataatgactctgccctctggggcttcctaagcttcttagacataaaatagcttgagaataattaagcagtagagatcaacgtcatgctaacaggtgggggtggggtgggaactgcataagcaaaggccctgggctgggcatgtcctggagcagtgaagacactgtatagagtggggggcaggcaggacccacattcaatagaactttaagatccaggactcttaggctttatccagagagccctggggagcccagaaaggttttatataggggagagacatgatcagatttgggttctagaaacctgccctgggccaggcatggtggctcatgcctgtaatcccatcactttgggaggcagaagcaggtggatcacttgaggccaggagtttgagacgagactggccaacatggtgaaacccagtgtctattagaaatacaataaaattagctgggtgtggtggcacacgcctgtagtcccagctacttagaaggctgaggcatgagaatatgagaatcgcttgaacttgggaggtggaggttgcagtgagctgagattgccttactgcactttagcctgggggtgacaaagtgagactctgtctcaaaaaaagaaaaaaaaaaagaagaagaaaaataaagaaacctgcctcggtggcattgtctgggttgaactggaagagagaggtggggccaggaggctagagtggaggccaagccaatacaggggtcagtgagttctggagctttttgagaacttgggaaaggctggatagatgagaacagggaagggaatgtctaggtggctcaggcttggactggggtcaggggtgtagtgcagacatctcagtaagtcaggatctcatgagggaaaaggctcatggaaggctcaggaaagctgggcgtgggtgggctgaggtagtgggagagatctttgtagtgtttctagctaggatgcagagggtcagagatcatggagccatctcttgccagacagggaaactgagactatggcttcatcactatcctttggctgcaaggctggggctcaacctcttcatcagacctgaccctcaatatcattctccttcaggccctgcccggaacctcttggttgctgagcttggtcagctcagtgagggttaattgtctttatgctccctgcacccccaccccccgcagtcattccccctgcccaccaagcagctcctgccactcttcctgcttcccactccagcctcctgtccccagggactgctgatggcttggctgggatctagccaaatggtggggggtgggggcgggggtggggggaagagctcccagcagtcctttaccccttggtcttaatggactgggagtctcaccctcagccatgctgctgtcaggccaggcctgcgctccccgggcttctgctgcttgggcctatgaaatctcccgactcagcatgattccattgctgcattcattcattcaaccactcaacaggaacttctcagtagctgcttggtgcccacttggcttgtcaccggggacacagagcagacactgactgagtccctgttctcagggagtgcccagtctgatgaaggagaaagaaatggaaagctgcaaccctacagggtgagcagtgctgtgtaggaggtggggggcccacagcaagcctgggcttcagaggaagagacatttgagccggaccttgaaggatgggtaggaatcacccaggcagggaagagcagagggaacagtttgtgaaggtgggtaggaaaggcacagggctaggcacctgactcagtgcagcctctgggtgggagaagacagtaagggcgtttgggtcattttctagcagttgttttagtactctctacaacttgccctgcagatctatccagcctgctgtttgcatacccccggacataggatgttcatctcttccctcctgggcagcccttcccttgtggtggttatatctgtcctgggtcttctccgcagggcccagcaactccaggctacccagcctggccttatgtcctttctccgtcctgtgtcactgtcccctgaagtagggccaggctggggcacaatgatccaggagtggcaagaacacatctaggcagagagtgggagaaatgcgcagcctttattaacaaaaatctgagatgggtgcaggccctgactcctctccaaaaataatgataaagaagcaggcatggccaaataagggagtgaggacagacagcaggaagaacttcctaccaatgcagaagggctgtgagtctcttggttttatgagagtgggctgtacgtgtgaaagggagggtctcagaggacaagagggggaattggaggcagaggcactgtcagcctctgactctcccataggtgagtgagtgaagtcatccagggagagggaacagaggagggagatcaggactcatcattcattcattcagcagccgttcactggccctaccaaacatgacacccctgggggcagatggacagagccagtgaccacgtggatggaagctccgagtctttcctacctgtgttaatgtcgcaggaaggtatttaggaggaggggccattggggctggccttataaggaagagccacttcaggctgagttgagggacagcactaggaagatggaagagcatttgcaaaggcctcaaggtaagggcaagcaggattttgttcacttagcactataggagttcagagtggcctaggcatgaagtgccaggctggggggaagccctgggccgtggtggagcaggagaggagtggggaattgagcctagactgtaggaagcactttcttccgtgaaggtgtctccaacaggcttgatgtgtaggcattattgtaagtttgcaacttcttggtctctcctggtgctcgtgaccagagcttgctgagggacccagccttgcttgagaaaggggtgttcagtgaacaaaagagaccctggaaatgagagagaagcagtggctgaagaatgtgggccccttccagaaagtggcgtgcaaacaaatacaaagcaatatgcaaatcagctggctagggcttggcagctttggttggaagaaatgagccatcaccccttattatgccggcctcctaccccctctgccccagcctccaggacagccggaacagccttgtctgctccttggagcgccccagcttttctgagacacaggattgtggcctccagggtggtggccgtgggctccctgtcagcaccctcgtcctcctgggaagtcgatatatttagtaacagaaatgttttcacacatttatctcctattgttcagctgcttgctccctgggaaaggccaggtccccagtgatgtgacccacttcttgaagtccctgaagtcacccttctcactgcccccccaccccgaaaaacaggaggcaactggggcttggtgcagcagaacagatttgagtcaaatatctgggaggacttcccaacagtgtggttgctgagatgtgtggaccctggatttctgggctttcattctttggatggttgccttgggcgcagaggaggctttgaagatagagcagagaaggtggcaggcaggcttatgctcaaatttcagcatactgaaagatgtactgttactctgtagctgtgtggtcctgggcaagttacttaacttctctgaaccttgtgtgaatagtggggtggagataattatcctttcttggcaggatgattctgaagaatctggaagtgcagagcttagcccctggcatgcggcaggtgctcacaaaggttagctactgtcattatgaaccacccacgatcagccacactttcagaaagatttagcggggcctggagagggagagaccagagctaggagctcagggctgtcatcgtgtgggagggaccaggaggcctgaaacagagctgtggttgtggctacggtgagaagcacaaagctctgtgggagggaccgaggtttctcagagaagtgtggccacctcattaagttgttctgactggtctgagaccaatccccagataatacaatggaagaaagggcttggtgaagaaggggttaagtctgtggccacacccatgcagtctgtgagccattctgggagctgtagtctgttgtgaatttgcagtaagcatagtttgtactgcctcttttgatccaaatccacaccctgctgccaaggctggccgagggccggccctggtgggtgctgggctgtgtggagcccaaaggtgaagcagcatcgacctcttccctcagggaccccctggcttgctatgtgttggggggtgcaggtaggagcagggatagaagtattaagccataattacgacttctcacatgttcacacagaagtttacagcttcctgagcactgtttccacacctgtgatctcatttaatcctcaccacaaacccaagagactgctgttttctggatgaagaaacagaggatccaggaggggaaatcgcttgcccacaggtattcagccagtggagccagacctggggcacaaatctgtctgcttccagagctcctgctctttccatacattactgttccagatggcagacaggcaagatgtggacaactaaagttggatgtgagacatctcggcagaggaacagctgagcagagagctgctgattccaggctgagagtttggactttgtgttgtggcccaccaggatccacccaagggttttctgattagagctgagctttgagagaattggtcttgcagcttaggctgaatggattgaactggagaaaccaaagtcagactgaggcttctaaatcccatccttggtgcacccagcactttgctgctgtccctcctccatgcttcttctcagtttcttccttctcctctccttcatcttcttccctcaccctttttttttttttttttaatagagacagtgtcttgctggctggagtacagtggtgccataatagctcactgcagcctcaaattcctgggctgaagctatcctcctgcctgggcctcccaaagtgctgggattacaggtgtgagccactgcacccagctcatcttcctctttctctcctactcctctctgcctcaggctgaggagtgatgacttttataccatagagctgtgctgtaatatcacatgtctccagaagggggtgctgtcacatacagtccattccagcctgaatcttcgttgtgtttgaagggccagtagaagtgttggacaagtggcagagatgaaggatggagagaaggatagcccattgttctccacctccattgagcccaggacatgagggccctgctgaaatggcactgggaggaatgaaggctgaggagaggttggaccccaaccagaagggacagacatactgagttaagccagaggaaattttctcctcatggttctgggacaggctaagatttggaaatgcatctagaatgacattgcagttggggtctgggtttcttttgggtcatgacttgcttgatactgaggtgctggggatattgcttgtgtctcagtgtgtgtatgtgtacctgaatgtgagcttccagttgtgcatatgtgtatgctgatctgagagggtgagaatgtgtgggtcagtgttcgtataaaagtgtgaacatactcacatgtgtgagcatgtgagtgtccttttttttagtttagttttgagacagggtctcacactctcacccagactggagtgcagtggcgtgatctcggctcaccgcaacctccgcatcccaggctcaagctattctcctgcctcagcctcctgagtagctgggactacaggcatgcaccaccacacctgcataatttttgtatttttagtagagatggggtttcaccatgttggccaggctggtcttgaactcctgacctcaaatgatccacccaccttggcctcccaaagtactgggattacaggcatgagccactgcacccggctgtgactgtccatctttatgtctgattttggtaaacagttatatgcatgtgactgtggcttgtgtgtgtgtacatgtatgtagagtgccatatacatatgttctagtgaaaccgtatgtgtgttccctgtgtatacagatgcctgtgtctcaatgtgagcacagggatgaggggatatgtgtgtgtgaaggcccagacacctgctgtgctaacctttaaggccgcgcctaatgtctggctattcaatactttttctcctgggtcgcgctttcctgtaggtagagacccttgaagggctgggcttccttcaggggactctgggccagagtcaggctttgtgttcagtctcaggttgggccagccagggtcctagtctatcggattgggcagctagacatggctgggaagtgtctaggttccattctccccaggaactcttaatggtcacacttaaagagtttcagggactcccagcacggtcctcttgtactgatgcaactactgaagttcagagaggtgcagtgattaacccaaggtcacccagcaggacccaggatgagatgatagggcttgcagcagagaggggagtgtctgacctggaaggctgccctccctccagcccctagagcaggtggggagctcagaggagagccaagtctgtggtgtgaagccacctcctgcacctggctatttccatgcctcctgggcctcagaggctgcctttgaagtttttaccagagcttctgcatgctgtgagattcctcctggggacgtgtgaagtcgactgttccatggagcatggagactcgatggagaggagcccagtggtgaagtgaggccagaggaggggcttcctctggaagcctcaatttcttctttgcagtagttgctttttttttcgtgttttttttttgttgttgttttttaggttttcaccgttctaacattcaaggctttctctgttatctctctttgagctcttagtactgagacagtgctggggtttggggcagtcctggaggcctatctgggctcaaagtgagggtggcagggcagtcccttagggaaagggctgcgtgggagacagggatgagcttcctgcccatagtggggaggcatgagcaggggctggacagcctggttagcaaggctgtatacaaggtacctaccctagtgaggaagttggttgcagattatcttgagtcccttcaagctgtagctgccatggggggccagagaagaacgtgcctcagctctcttgggcctggggaggattgagtccacagagtgctcctggtgtcctgggcagtggaaggtgcaaggttagactgtgcacctggaagcagagagatcccattccctggagaactgaagggaaatttgtcttcctggaggtttggggctggaggcaggggctggatgggaggacactctggggtggagtgggggtgggatggggaggactgggcaagtccgaggcggctctgctgttcagcacccgcaggaaggagcagggaggcatatcctgaatcatgcagggctctagggtgggaggcccatggttgtggggctcaaacatgggctctggttggggcagaggagaggcttcctggggttggggtctgggcaggaattggggtagaaaaggagagaagcagcaattgggtaccacctccttcccaggtcaggtaattcggagttgtcttaaaactctcagtgggccaggcatagtggctcgcgcctgtaacccaagcactttgggaggctgaggtgggtggatcacctgaggttgggagttcaagaccagcctggccaacctggagaaactctgtctttactaaaaatacagaattagctgggcgtggtggtggatgcctgtaatcccagctactcggggggctgaggcaggagaattgcttgaacccaggaggcggaggttgcagtgagcctagattgtgccattgcattccagcctaggcaacaagagcaaaactctgcctcaaacaaagaaacaaacaaaacctctcagtgaggggggatctggggtccagatggagagaactaatgtttacagagtgacctttaagttttaaaaatgattatttaaggaggcgattaaacaaatcgcctccttaaataatccttccagggaggccgggcacggtggctcacacctgtaatcccagtactttgggaggctgaggtgggcggatcacgaggtcaggagatcgagaccatcctggctaacacggtgaaaccccgtctctactaaaaatacaaaaaattaaccgggcgtggtggggggcgcctgtagtcccagctactcgggaggctgaggcaggataatggcatgaactcaggaggcggagcttgcagtgagccgagattgtgccactgcactccagcctgagggacagagcaagactccgtctcaaaaaaaaaaaaaaaaaaaaaaaaaatccttcaaggggctagccctattttgtagaggggaaacagatgacaaacttaaatggtttaactgaagacagttagtgaagcaagtattatggagatggggaaggcttaagggaaccagcaggacatgtcaagttactcaggactggcatccaaggggccaggggcgttggcagaggggggccgaggagagtgccccagctccatgagccagagccctggagatggggctgccctgcaggagctgtggctgcagccactgcttgtcgaaggaggcaggtgggtgagggggtgaatacccaccatgagcctgcatgcttctcaccctttgctctcctgccagtaccctgaccctcactggcagaatttctctggatgccagggggcaagggagccctggatgaagctgccacttagaagtcggcctctggggcacacaacccagcagcaaaagttagagattggatgtggagggacaaagagatgatgggaaaccgaagaacagagagggcatggacttgcccaaggtcacacagcctgttgatatcagaattggagtcagaagccaggctctgcctctgaacactcacttttttgtttgtttggttttcttttttttctttcttttttttttttttttgagacagtcttgctctgtcgcccaggctggagtgcagtggtgcgatcttgtctcactgcaacctccacctcctgggttcaagtgattgtcctgcctcagcctcccaagtagctgggatcacaggcacctgccagcatgcccggctaatttttgtacttttggtagagacggggtttcaccatattggccaggctggtctcgaactcctgccctcaggtgatctgcccgccttgacctcccaaagtgctgggattacaggcgtgagccactgcacctggcctgaacactcactttgtcacattcactgaggtctcctgagtggactcatatgcgcattatctactctctggctgagagctgcttcctgccgtgatcaccgcgctctgtatctgggcagcacaggggctgctgaagaatgtcattctcagaacgcagtgtgccctggagccccccaagccacctgttcattcatcccaactggccttgagggtgccctggtgtgccctgcctgtgcttgtcaccctggccatggagatggacccaaaagcccttgctctccgcttcattagagacaggcacacccagacgcaggcaatcaattttgtcgggtgagtgctgggaccgctgatgaggacccttcctgaggaggcgatgctgggtcttagccttaaagaacaactgagagttttccaggtggaggagaaaaggaagggtattccaggcaaaaatccccgtaagagcaaaggtgtgagcagcaagaaatcaagggtggcaggttcagggctcctgggctggaggaagggcctggcggtggagaggaagggagtgaaggcccagctcacaaagggaagcagaggaaagtttaagcagggtcaggccatggttagctttggggttaggaagctccaaatgatgggtgaagtaggggggctagacccaggtgagaggcagtattgcggttggccaaggacatgtgagttgcataaatgggccagaggaggggtgacagccgctacttcccggctcacctgcctgagctaaggccctagttcctcagtgtctgcccaccaatgcaggtgtgtggcagctctagaccctcctctagggacatccctccctgcctcatgctgcctgtggctttcactctctggagcactcatccatggcacccataagccaccccctcagacaatggcccctaaagcaaaactgtgtcaccgttgcatatctcttgataacactctgacccctccactgccaaatctgataaaagacctccctttgaagaccttcctcctggagtcggatctcagtccttcttgctgtccagagcctgggccttgggcctccctgggaggcgagtcagtgagggcagcccccttatggtgctgggagttgagggaccttggcccagccaactcatccctgttgtgtcagcctctctgggcctgggcagccaactcattttcagtgctaattagcatctcccctgcagctttctgccccactctaagtgcttgacaatcattaggtgttactgtgtgcaactggatcccagctccggcacctccctgccccagcttctcctccagaccccagctgcctgagataagggacctggccacaaacatacaacacaccgaaacccggacacaatctaggcatagggacttgaacaccaacataaatatacaaagaggaaaaacccaataacacagaagaactccccataccaggaagcagaccatagcacagacagagacccacagtacacacacaacacagacaccaacagatgctgaaaagcagacacaggatcattccaaaaagtgacccagaaacgaaaacagaacaaatgggaacatcaatgcacatgacacaggtatacacatctagatatgcaacacaggtacgattcagcacatgtgtggcgcatcgcagggaagcacttgcacttgaagtatacacagatgccaagatagtcagagggagccgcctgtggttccccacctgtgcagcgtctctcgcctctgggctgccgcacatgctgttgcccggaattcccttccccaaggccctcctctttttacctggctaattcctgtcattcttcagatcttctaggaagacttctgcctccttgataggggcctttccatactccccagccttggagtgcttcctgccacatggcatcactgactgttttccaatgagtttctgtcaagttttgggatgaaggattttgcctgtgctcgttgaggtggtgactgtgggtgtgagtgggtgattagggccaaaaaaaccccccaaaaaactggacagaggcaaatttggggggaaatgagttaggaatagctgtgaggagccccagctactcagggcctcagaagatatttatttctgtatttatttatttattgagacagagtcttgctctgtcacccaggctggagggcagtggcgctatcctggcccactgcaacctccacctcccaggttcaggcgattctccttcctcagcctcccgagtagctgggattacaggtgcgcaccaccatgcctggctaatttttctatttttagcagagacggggtttcaccatgttggccaggctggtcttcaacttctgagctcaggtgatcctcctgcctcggcctcccaaagtgctgagattacaggtgtgagccactgcacccgacctcagaagacattgaaacccacagagaggacacagccagatgccctctgcctcattttctcagaccctgcctgatttctcttatgtttcttctaggcttgctccctgacccagttccctccttcccagagctggccttgccccttgccacctctcggagctcacacatactcactcaccttctctgcttggctgtgccctacccctacttctacgtgcagtgaaatccttgttattcaaggcctgaggtcagtgggcacatcatccatgcctggcgtcctaacccgtgccactgagtatcgtgaagggaggtagtggagggacgtgcttgggagcacaagccttgaggactgtctcttggttcagatctctgctcctctacttcttagctgcaggattgtgcaagttctgccacctttgttccctcatctgtagaaaggagaggataatagagcccacctcattagggcagccatgaggattaaatgagacacagtgtgtaatgtacctggctccctctccaggttgcgtgagagcagggagaaagctaatgagatcaaggatgtgcaaatgcactcagaaggtgcctagtgagtccttgctaactggcacttagtgaaacaaacacctcctgtgtgagcacctaatatgtgcctctgtagtgggctctgtgacccgcccctccttagtttctgcatggctgccagttctgcacagctgttactgctgtgggggcttagaaggtgggggtatgactactttttctgaatttatttttaattttttacatctgttttatggaggcataatttacatacagtaaaatcaccaatttaaagtgtataatgagttttgataaatatatatggtcataaccaccatgacaattaagaaaagaatatttttatcctggcaaacttcccttgtgccctttgtagtcagtccctttgagggggacttcttataggagtgtgagaagtactgggttttccttgggctgcaaacctgggcacatggagtgggggtgcctccaacatgctggaagttgccagggaactgctgaccctctctgggccttggttcctggcagaggcagtgcagccaggcaggggaagggatgcttaggccttggtctcctgagggcaagccttggatgtgagggttggatcagctggaagtggtggcttcagaaacccatagagtgggtgacagggtagggacttggtgtttccacaaacccgcccctcctttgaccaggtgtgccctgtggtcctggtggaaatggctatatattgtccagactgtagcaggggctggccaagatggtccactcctctccccatcctcctccaaccagaggccataaaccccactctatagattaacaattccctgaaaagaagggggtcacttttgttccccagttctagaactaaatattaaagcaattatgtaactagcaataaattacttaaagtagtgactcactcagcttaattagagcgcaagcagggagggattaaggtatttttagagcacacacctcactctctcctgtgggggaggcctctgtgcaaggtgggggtggaaaaaaggctgggaactcatgggagcaccccaggtgtctgcaaggagatgaaagctgatcctccgccccactgaggtcctaaggaagaaaggccgagtcagagctgcagcaggagggattcggatcagactcaagaacacttcccagtggtgcttatttgagaactgggacggcaacactagattgtaaactctgtgagggcagggattaggtctgtgaccgcctcctcacccagcgggagaccaagaatgagacttgggagtcagacacaactgggtgtgactcctgcctttgcgggttgccagcacgtgggcttgggcaggttcctttatcaccagaagctttgccgtctcctccactataaagtgggcacaataacatccacctgcatgcatattataaggattgagtgggttaaaatgtgcaaagcaagactttgtgctcagctgggcacagcggctcacacctgtaatcccagtactttgggaggctgagacagagtgcttcagcccagtagttttgagaccagcctgggaaacatagggagaccctgtctcttaaaagaaaaaaaaaattagaagactcggtgctgactctgctagaccaaaagcccacaaaggcagggattaggtttggtttgtgttgttcattgttgtatctcaagcttcattcataggactgcacaaagtaggtgttcagtaaatgctttgttgtgtgactgcgtgttaattttgttcccattctcctgctccaaaaaaaagttcattttcctgaggttgtgagtgaagaaaataggcagtgtgggctgggtgtggtgtctcatgcctgtaatccccagcactttgggaagctgaggcgggaggatcacttgaggccaggagttcaagaccagcctgggtaacttagcgagatcccatctctacttcaaaaaaatttaaaacagaaaaaatctagggtgtgtgggggggcaggtggggaggttgcaggggtgcctcacaggtgggagtctggcatttctcctccaggctgaggaggtggtgacttccagggaaagtcctgggagggatcagaaccacagctccagcctgcttggatgagggtggtcttctggctgccaggagggtagctaggtgggaagatctgcccttgtttcctccataacctggggtgggaggaggaggagctcccagcccaatctgatgggggagaccagaaccctcacccaccattgctggcagttcagagaaggcagcgataagtcggggtggggcatcctgaaaggcttcccagaggattggatgggaggattagctgagaagacatccggcatccgtaaaatggagtaatgattctgaccctgcaggttttctgggaggattaaatgagttacattttaaagatgcctggtacatgcctgccaggagaaggcacaacatatgaactccctccctcttccctccacccctcctcagctcctgtgacatcaggagggacatgccctgccctgctcacagaggctgggtgggaggctcccatcatggccttcactgaggctgcctctgcagttggaccaagctggacacacagtaggtgcacataacagatgggggcaggtctgtgcttgttttaccagggtgttgggaggctgagggaagggcacagctggattggggtgatggagttcaatccctgctcctcccccagatccaagatcctaagacgcctatgtccagtggctgctctgatcagctctgaccagctctcctcacacctcataggccttccagggttcaggtgatgaattagtgatgacagcatccagcatcgctatgacaaccacatggcactcttagcctccagtcagggctcagccgcagaggccagagacccctttggctctgggcctttgtactggcgtgtgtgagcggggctggggcctgagggagatggaggagtgggaggggcaggggccggggcatggggctgcatctggcatggactggagttcattcagattgttccatccagagggaccttggggacagttgtttctctccttccttccccctttcttttcattcctccatccctcctctttcccctcctcccacttcttctgagccttgttcctgtttgaggccctgggctgccaacccttttcccctcctctgggaataaagccaggctcagccctcaccccggggagctgagtgaggtgggggacagccaccttctggtctaggcctcagggaaggtgtgtggggaccactgatggcttggtgagagggcctgacccagctgggccaggggctgtgcaagtggctgctgaccctgatgagtggggaggaggttttcagtagagaggcagggtcagagatgaagcagcgtgggatgggggagcgacagatgttcagagtggcctaagtgtgagatgcggagcagagaacgtgggaggaatcgaggctcgagaaggactgggagagagtggatgcagtgaggagtttgaagtttgtccctgggggaagaggagccctgaagatttttgttgttgcttctttgatttttaaatgggagggttcattttagagatggggaaacaggcccagggtgggaaagtgacttgctcaagcttaagtcactagagacagactgagagtacaggctctgcttgggtcctgctggactctagctgggacctcttgccccagacttgctggccaggattttcccaggtaatcactacctccgagaaaggcgaggagagcccatgggtgactttgccctcagtttgaatgaaatttgcatcagcaagggctatgccgatagtcctttctgctcgtgtctggcctgtttgggggtgggagtggggtggaggtgagcatccagggaaggatctgggaagtcaggggcttgccagggccagcaaggcattagggtcagagatggattcaaacttgggtctttggagacccagcccagactctgtgctccatctccttcctccgtctctcaggagcctttggctgagttaggcacctacaggaggcaagggcccccccgagcccctcacattctcctcagggctccttctggccctggggcctgatattgggcctgctgtgctggaacttatccaggcagaataaacctttagccccattgtcctgatgaagaaactgaggtcccgaggtaacagtgactcattcagggttacaacaggtcagtggctgggctgggcctagcgtctggccctcagcttgtctacatggcccccctcgtggctctcccctcgcctctcgcaccccactgtgcagcatggttgggcctgccagccttgatggatggctctgcagctcaacctccctcccattcctctccagatgccgggccgtgagcctcctaatcaccagtcctgcctggtggccgccaagccatccatctccccacacagccttgcccagcacaggtgattttgtttggggagaaggggggcacagcaggtcttcctctgaggctgagccaagagtttggctgcagcccccactctggggtgcccgagggttagggaatagcctgcactcccttgctggagtgtcagaaatccctcctgaatctccctagggcacgtgcacatgcacacacaggcacacacactcacagtaacactaataaaagctctcgtgtagcaaaagaatattgtatggcaagtattgttgcagagccatatgtatcatctcattcatcactccactgtagagatacagaaactcaggctcagagaggttaagtgacttgcataggctccatatccaggaaatggaggagctgggatttgaacccacatccttatggctcacatcttgcattcacaactcctgctctactgactcacctgtgcacacacacacacatgcacacacacacacgtgcgtgcacacacacacacaggcactcacttgcatgcatgagcacgagccaccattttggctcttgtaccatccatctacctgggccaggttcttgaggagtgaggagaatgctgggctgcagagggcatgaggggtcactgctcattgtccccaggctgccccaagctcattgtccccaggctgtctcaccctggctgtggcactggctggctggggagctgcagggaggcagcagcctccaggcagtggaaaggggaggctgggagacagtcgatcgatcatccctgcagtgcctccttccaggaactggggcccaggggagtgtggcgccacgggtcgatgttctgggcagcagcacagtctctgagtgcgtacagggtgtgtgtggggcgaggctggtgtgcagctgcccgccttcccctggctcccttcccctgctcctgccttcctcctgccattcacctgccagccccacaccttcccctgattcccccactgtccccaacctgggcactacagaggctgagaatcaaactcccagttcccaggcacctgtgtgcctgctgctaccatcccgccctgccctagaggcaggtctcgggtgggtgctgcaagagtcaccctatggtggttggggatgggtgggtagggggaccgggggctggagctgtggggatgtgaggcaagcccacctcagagcctttggagacctcgacagacaaaacgatgagttaagaaatgtaaaggggcacatagtgggtgctgaattcatcttgtctcgttcctccagtaagagtctggagaaaccaagagcagctgggtgcctctgagggcacaggagctcccagggctggctggcaggtgcagctaacagtgttagcaatcccaaggacaggtagcttggggcggaggagagcatgctgtcacccatcctgatgaggggagagatgtctggtgctaggagcagtggtggccggaggagggctggggacccaccccaggccaccccacactctccctctgggaggggctcctgagcaggcctggtcaccttgcttcttggctgcttcttccccggcggaggagcctcccccaggctctcccacctgcactggcctcaagagagctgggattgagccccagttcaggcacctgctggctggcggaggttagggcaaatcactttcctcagccctctcatccgtgacaggctctggtgagggttaaatgagatgttgcccgtcaagtgcctgccacttccctgacgccgagcagctaggctgctctgggttctctagcacctgcctcccctggtcccagcgctgggtgggcggctgtgttctaccggtcactggtgggtcctcagggccccgacacagggcctgctattgggaaagagggaagtaaacatcccagggctggagctctgcccactatggaggtgttccatcttaggctctgtaatctcctcattcactctggtatggggacaaatgtgcctctctgcactaactgagcccccatgggcaactaggagtggtgtcacttggggtggaggtgggcaaggatctctggactgggatttccaagccctgacttcctgttatttcaggcactacctcattgttccatcttgggcaagacctgtccccttgagggtaagagacacatgtgacctctgacctccagagtctctcttctgagcttctgtgcccagatgattctgtgttctaggggacaggcgaggctggggggtgacccccatgccactgatgggcagactaaggagcaggggcccaggactggggccagctcaggactctggtggcctcggtgcccttgacctggtattgctgccgttttgccccactgctgtctgtctccgcgtccgagtcaccacctgtccctctccagtcctctcctctcttcctttattactatctctatattgcctcctgcctcaggcttatctcctcctgtcatgcctctatccacctctgtcactcccctgcgactctgcctcactccctggcacaccctctccctccctgggagtcgggagtggagcctcgctgggaatcaggacccccctgcctctggtctctgtctaagcagtctctgcgattctggccagctcttatctttttccaccttcccgaatctctcttgctgtctgatggtgtctctgcctttcactgtctctgaactccctttgtttttctctatatgcttctctctgctcttatctctgggcctctgtctctcagggcctgactggtcttgacctctttgcctccttcttcccctcgagagcccagccaggcagcaggtccagccctccagcccagagaacagatggagtccaccctccctctctcttgctggctgcctcggaagccccaaacaatggcctccgccctgcaccgtgccttgttgctaggccttgggctggcagcacctggcttccatagcgacgggtgcttagaaacagaatgccacatctcccagtcccaccacaggagcctttgccgattgagcgagtgccttttgatcaatcaggaagtgtggccaggctctaggttgcctccaacttgaggaggcaagagaggaggggactgtggtctctgccttctggagctggggggactgctgggctgggaggagttgctcaagtacagccctgaagccaaggaaggactgggggaggccctgggctcttttccccaagtcagcctgctgcaagaggcacaagcttgggagctggaaggggctgtgttgaaattgctgttccatcatttctagctgcatgactttggacgaatgacctcaggtcccagggcctcagtttcatcaactgtaaaattgggctaataatatcatgaagattaaatgagagaatagatctggcacttagtaggtggtcatcaatggccattcccctcccttcccctttaaagttgtttaaaatttaattgacagagaggagaaggagggttcttcaggcctgtggaatggtgtaagcaaaggggtggaggctggcatgcacctcacatatgctggagtatttagggaggaccaggggccatatctggaaatggttctgccagaagcagccaggccaagctgggtgccatgtcatgcacctgtaattccagctactagggaggctgaggcaggaggatcacttgagccctggagttccagatcagcctgggcaacatagtgagaccccatctcaaaaaaacaaaacacaacaggcaggctgatgggcccatggagaagggactctgtctcctgggaggtatattcttgccaggtgcaaagggatgggcttgactaatttctcctctagcatttggggctgctgggtagggagctacattggggtccccttgcttattctcatgctgctccctacttctgccctgtcacttggtcccaggagaggggctcccactggttccttttccctgccaggcctgcccaccaaggccaccatggccacacagcctgaatcctggggccagcaagtgtccatggaaggccccactctgtcatcgtagagatcaggaaacaggctcagaagtaggagggcttcctggtcctagggcccagctcttccctcttttcaggcctgtcttctgcactaaggacttcaggccaccagggaaggtggggagggaggaaaggagatgagatagacttgggcgggggcctgaggacagagtttcatgtcacttgggcagccaggaaagggttaaagatcccttatcccaagccatgggcactggcactgccagaggatgctgaggcctgctggggcataaggacaacaagcaacatccttttctgagctgttgggagtgccaagctctctgttaaatacttttgagcctcttctcatgtattcacagccacctttcaaggaaggccagttgatccccagtttagaagtgagaaaacggggtctccaggaggcacttgtctaaggtgacacagctggagagttggagatggtggttagaccgagtcacccccccagaccctggcctctccctgcgtgccccttccaggacacccatcactcccttgacaccccttgggagtgggtgttcatttccttgggctctcccaatcccagtccttggtatccccaactgcaggcagacacaggtgcttgctgctgtgccctcccctttacctggcatcacagagactcaagcccactgaccattaggctctcaggggcatagaaaccaggtgctggagtcttagagtcctgcaatcaggcatctcaggcagtcaggacattagaatgttagaatcttgggcttctacattctcaagaccccaggttctcgcattcacagaatgtaagaaaaacagactttttgaatgatggggtgttataacagaagctttgattttctaagaacatgaagctctgggagttcttggagccttgaagccatagactggggcctccctgtgtgatggtttctgagttagcagggagtgttcagagtatggggccttggtccctgttgcttagaccttcttgccttggtatctctgatgggctcagctcttagtagcctttgtgtatgtgtgtgtgtgtgtgtgtgtgtgtgtgtgtgtgtgtgtgtgtgtgtgtgtgtggggactggggtcaggggtcagggactgactctaacctgaggcacccctggagtggggccagcccaggaatagcaggtggaggaaagccgggcagcctcagggctgcagctgtctggtggtacagggcagggctctgggtggctgcctttggcagaggaccagcctgcctccttcgtcccctacccagcctgctaccaggatcaggaggaggcatctccatgggactcctagggctggagtcagagcagcccctccaggttctgcagcctggacggtaggaggtgccactaaggggaggagattggggaaggattgggacctttatctgcggtgaggtggggcacggggggatgagagatatagtgggagtctttgaagggtgtgggatcagtgaaggggctggggatttagtgatgggctggggcttaggatggagccaagggctctgtgggtgggagaccttttgagagggtggagactcagagagaaggatgggggctcagcaaggggatgtggctcagtggaggttgctgaagagtttcttggggttggctacacgcggtggctcacgcctgtaatcccagcactttgggaggccaaggcggatggatcacttgaggtcaggacttcaagaccagcctggccaacatggtgaaaccctgcctctaccaaaaaatacaaatattagccgggcgtaatggcaggcgcctgtaatctcagctactcgggaggctgaggcaggagaattgcttgaacctgagaggcggaggttgcagtgagtcgagattgtaccactgcactccagccctgggcgacagagcaagactccatctaaaaaaaaaaaaaaaaaaaagtctcagggctgtctctgcactgctccaggttcctgaggacggcggttggggctgggggagtcttctgtccctggggtaggctgagaagcaagagctccttttcccaactctgcccaaagctggaaaggttgttagagctgctaagaaagctggcatctgcctctccttttgctcatcttcctttctggtttccatgggaatctgtggctcaggatgatcaggggttgacaggatggcgctgtggaaggagtctgtgtcaggcacagccatcccacatgggaaggagccggctggtaagaaagtgagttccctgtccctgggagtgtgcaagcagggtaggggctgaatggctagagtgactccagaaaggggttcagatggggcagaggaagcagtctggaggccacttccctgagacaatcatgttttgtgtgattggctctgggggccccaccagccccaccttccagacgtccctgggcctcacaaagggggttgctgcaccctaggcactgcctctgatccagccccaactcctgtgctctgtgcctggcctatgctgaacacggacatgtgcagctgaatcagattcagtctctgcctagaggagccccagtctgatgggggaggcacacagggacacaaatatagctgggtaagtcctacaaaagggggcatacctggctgggaggcagttccatcactgattcctgtagtctgtagatgtctttttgagcaattcttctgggtcaagacttgttcttatttgctgggataaaacagcagtgagcaaaacagagctgacagcatggtgggaaggttgagctcttccagaccgtgatgagaagtattggtgagtggtggggagagtggccagaaggcagagtgtgggcgcagcatgagaggaggctttgtccagacttaaggacctggaaggccttgaaggccaggaccagggctccaattgtcctgctggcaataggaagccatatgggtgggggtgaggcagaatcagatttaggtgtggaaaagatgactccagccagtgtgggcatcgaagaggaggcacagaagcaggcgtggccacctgtgcctctgtgtaggagctgtgtgagcatgtgcttgaggatgtgtgtctgtgtagaggactggggtgtaggcgtgataggaacatggacgtgtatctatggaaagactccaattgtgcataggggtgtatgtgtgtaagattctgtggcccagggcagcctgtgaaaaggaaggatcttggggtctctggatgatggggagcagagactaaggcctaaggtatgctggggctcgagccccctggactttatcccctgtgagctggcaggtcttagactagtcctggactagaatcctatgggttcccttcccccagagggtcatggggccagccatctgctgcagacaagacaaacatgcatgcaaatcacatgaaaatggatgaggcctgtggctgacccaccctacagcccccatcccctgggcctgagttcactcagcctgtacccttcctgacccagagctgctgccagggctctgggaacaggccttgcccactaggagctgaaattcacattgtccccagcacctgcccgtggccacatcctctctctgtgagggctacccccacatctggagccatagccagcggacacagagctggatctggactggtggccatgggcagcacctctggcaggtgctgaggtggaggaggcagtatccaggcaggcatccctgggcagaaggtacctctcctgagcagacaggccttcccaggcaccaggcccaaagataggggcaagggctagatcctggtattggaggaccctcaggagaggctgtgtgtgacttgctctctctctgacctgggctagagcataaacacgtgtcacatacttgcacacacattcacacgtgaaagcacgcacatgctattcctggacacttgtgtacacacaccactgcacacatatacctgcatgtgtgaatatacactcacttctgcacacagacacatgcctatctgcatagacacacccgtgccaacccctatagatacacagacatatctgtgtatacacatataagttcagctataccactgcagtatcacacaccctcacaaggatacaaacctgtgctcacactctcttccaccctcacacacatcatgcttacaagcctgtgtgcagccttacacacatgcacacacgtacagagcagcctaagggtggctcacccctgcccaggtgaacacctgtgcccactccagggctggagtgttgaggaaagggtctggatggaggcagaacctgcagagatgtcagtttcttccaggaagcatcttggattgtcccttcacagagcccttggaagtggggccctcttttagtccatgggctctagcccaggtcacagagagagcaagtcacacacagcctctcctgagggtcctccaataccaggatccagcccttgtccatatctttgggcctggtgcctgcgtaggaccatctgctcaggagaggtaccttctgcccagggaggcctgcctggatactgcctcctccacctcagcttcctgagcactcaaagagaagcaggccaagcttcacggctgctgagaagtctgagaccagggagggccaaagccttgcctgaggtcacccagcatgtcagggaagggctagggtttgaacctgggcttccaggtgggggtgtaaccatggtccatggcaacaggatagatgcatgtcaggcagcagacaggcccttggaagcaagacatgtggtcatgggggataggaaaagacttacagtctatggagatctgccaggaccaagtgtgtgagatggagagatggtgcttcttcaccagagctcactgggcaccacagggctcccagcttggctggaccatggggactcagggaagaatcagacaggccctgctcttgagggagggctggggataggtgaagaaggaagagggcattatagactggggagatggtgggggctacttctcgttggatggcagttttcttcctgcatcttgaaagatctaactttcaaatttctttaccctcaaaactcggcatggagtacattctcagtaaatatttatggcatgaatgaattaatgaaagtatgatattggcaggcagatatgcctttggaagggtattcaaaatgggagggcaacaggttgggcaaaggcaaagaggtggaagaaaagccagaggttcagggtacagctgagtcaggcatggctggacgggaagtggtaggagaagcagcaggaaaaagtcacgtggggatgagccttgcatcttatactgagtttggatgttgccttggaggccatggggagcccagtgaagattatgagcagagggtgaacatggtcagagtgaacctgccctggctttggggggtcctgggctacatagtagctgcttatccttggtgcaaagagcactgggtttggagtctataggccagggttcacattcctatagtaaccagctgtgccatctcaggtaagcatctacatttctctgagcctcactttccttatttgtaaaatggggctaatgccgtgcctcctgaggctgttggatctggcctgggtgaggaaatgctttgccagcacaaggccctaccaatgagaggtgtcatttttattaggaacaaggcagggctggttcctagacagggcctgaggttgagtgggcccaggacccaggctgacagctgagtcaccttttccaggccaagtggcctctaaggtgggaagacaaaaagagttggctagaggggctgggctatgcattcctaagctggagctgggaggaaagctggggctgggactgggcttcctggtgtccgagatgggcagagggtgcagacaccgggatagtaggaccctcagccactgcattcttggggacaaaagaggagctgggaaatctgatttccttacctggctttgctcaagaagcaaggaatgtatttaaggcacagactggagtgagatggcctgggtttgaattttgactacttacaagctatgtgactgtgggcagtttactttgtgcctgagttttccttatctgtgaagtgtgactaataatagatcccaccctataacattgttgagaagatgaaatgtgaggcacacagtatgtgctcaataaatgcgaaagcctcccagccccagatgtatacactcggccagtaggggccagccctggccctcacctccatgggacagaggtcagccagggaggagatgcatctactccagggttctctgacctggcagcaaattagaatcaccgggggacattcacaaacatctgggatgggggttccagatatcagtatttaaaatgctcccaggcaattctaacatgagtcagggtgagaacccagaacaggatcacagattgtgcagttggagtgaggtagggatctgcgtgtgagtggaggagtccttggagtggggtcactcctagctataagagctcggcaaggcctttaaatgtgccaactcaaggagccttggttgccccctcaggaagggtgctggttggggaatttcaaggattgtgtgagagggtttttctgaaagggctctgcactctaccaagcactggaagaaagcagtgcacttgtttattgagtctagtgtaataacatttcacagatggggaaatagaggcctagagaggtgctgtggcctgctcagaatcccacagcaagtctatggcacagttaggactcaaaccctctgaggaatgcttggatctgaaaggttgacacagaaagactctttgagctgagggacacatagagcacacaccagggaccccagtcattgagctgtagtttgagagattcaagtaagactgaagaaataacttcttggctgggtgcagtggctcacacctgtaatcccaacactttgggaggctgaggtgggtggatcatgaggtcaagagatcgagaccatcctggccaacatggcgaaatcccatctgtactaaaaatataaaaattagctgggcatggtggtgcatgcctgtagtcccatctactcgggaggctgaggcaggagaattgcttgaacccgggaggcggaggttgcagtgagctgagatcgcgccactgcgctccagcctggtgacagagcgagactccgtctcaaaaaaataaaataaaataaaataaaataaaataaaataaaataaaataaataaaataacttctcaagaggtgagtgccatggaggtggtgcctggagttgggagcccaagagatggtggcggtgccaggccagggtcggctgttgaccatggtctgaggtggcctcccctgaagaacaagtaactctggccagtggctgtaacagatacctcccgggcacctgtatctcacccagccttgtccagagcccaggactgagccagtgacacatgctcagaatttaccaagagacttgtgcactgagctcagactcagacctagtccttccaacagcccttacatgggtcatccccttttacggaagagaaaactgaggccaaaaataggaagggaggccctgtgggggccagaacctttacacatcttagcccaggtaattttttctacagtgttaataagtaggatgaattgcccctgtttggaagattcagtaaaatacattgacttggcccagatcacttactctacacctctcctaagtccccagatgtgactcccaggaaagacacaaaaaagggctacccagagggataaggtagtaaccagggaagccctcccagaggaggtgggccttcaaatggcccctaaatgacaggcaggagggaaggatctgggagggtattgggggtggggtggcatgggcaaaggcctggaggtgagagtcagtcagtcattgatgtgagaagagcaagaagtagaaatgtaaggaatggtggggaggggagtcagagctggatgaccaagcaagggttcagctgtagagggtctggcccgccaggctcagggctcgggctttattgtgctggtggtagggagccactgagggtgagtgggggagagcatgccagagcatgcctcagaaagaaaggtgggagaaacgctggcatggagggccgccccctgagttggtggggtggccgggctctgccaaggctatgtgccagctgcctggactgtgtccaggaatgggcacaatgactcaacattgagaaaatcactccccagggagaaagggccctgatgaatcacccagctgaggtggggaggctgggaggctgggaggctgggaggctgggagctcactgagtcaccgtccaagagttggtgaggaggggagctgcagagagaggggccggcagtgcagttgacggggggattcaggtcagaccacattgagggctgtcgggggactctaccttcccgccattcccgggtttggtcctcctggccgtcctgtgagggagatgagaaaactgaggcccaggaagtggggggaggggatccgagcaaggtcatgcggcaagtcgctggcaaaggcctagcgagacccaagcgcaccctccagtccagacacgtcctgccgccccaaccgctttcatgccaagcagaggcctaagaaccgggtcggtccgggcagggagctgaccccggtgacccgctgaatccccggacgcggcccctccgggcagccggcaactgaggccggattgcgccgccgcgatgggacggcagggggcgcaggagcgtcgcggctgccgcaggctcctgaacccagaagccgctctgcggagaaacgcgctcccggagcgcgggtcccaccgcggaactgcggaccgtgtggccctggggcctgcaccctctccggctccggggacggcgacagagacctgcccacccaggcctgggggccccagtcagtggcggccgccgtgtgtgcgctcggtgtctgtgcgcacgtgtctccctcgcagatgggcgactgctccagggcctgtccgtctcacagcgacctccaacattctcccgacttccccctgcctcctaggctgagggagaggagcaagcccgaggctcctgcggtgtccgcggcccctgccccccttccccttccctccccaccccaccccactgcgccggtctctgcctggggctctggccgggccccggaccccagagtggtggcggggaaacagggtgcgatcagacagggtggaggctctgagagcggcccctgcgagatgcgagagaagtggcgacggggcgaggggcagcgagcgcaggctgacagcaggccagctggaagggccgagggaacccagggcgagacagaagcggggtgacagcggccgggtgtccggtggggtcggaggatccgacgggccgagaggtgcggtccgcggtggcggggacataggcggggccggggcgggccgggggcgggcggggggcgggccggggcggggccggggcggacactcgggcggaccaggcgaagctgtcgcggacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcaggtaggggggcccccgcgctgggcaccaggagaacggggtgtccggcgagcgccgggccgggtctgcccgcccccgaacccttctcagggaggagacccctcctctagttctgaattctactcctgtgctgggacggcagcgcagaccaagagcccttgaagccccagctctcagtccacacgtcaccccagactctgaactcctttcggatccggggctccaccccaagcactgagcttccagtccacggtgggaccgcagtgcacactgagagctgtgcccaagcctcgaattccctttccttagattagtggggaccctgcccacgcctcggaaccttcaccatatatgtggggctcccggcacacctggagcacctgaacccccagctgtcatccaggactccacctcagagccggcctcacccaaagccccaaacctccattccaagcctcaactggacacccgctcagattcccacccaaacatctggacttcagtcctcagcctggaacctaccccagagtccaaatctctccttccatcagggcttcactggctttctctgtgggacccactccccgatcccttccctccctcctgtgttggagatctccgagtctttcctcgtggggggcccctcctcttgttcctctccaggtacagtggtcccactttattctctgggcttctcctctggtttctcttcaagtatttctgggctctctaatttggtctgttgccccatgtgcccacctctcttggtctatcttggtctctctcctgtttctctaggtctccatcttcgttttggggtctctttctgcagccaccccttcctcttgtatctacctctgctttgtggtgaggagggggcaggctcagagagcagggctagtgtccctgggacacccccgccccccatgttctcaggcatggcatggtgtgggctcaggtggaagggcctaaatgtggagtgtgctgccctcaggcgatgcccagggatctgaggtggtggggggatgatgtggtgggcactggcttttgtaacttataaagcccctcatcccagctgccctggtcttgacgggggcggctagggcttgagatagggaagagtaaactgcaatctggtgtcaacctgcggtgggatgtgtccaggctgggtgggtctatagtgtatgtgtttgtgtgagtgttcctgtctgtgtgtagcacgggctgggttgcatgtgttgggtgtgtcttgtgtgtaatcatgtgtgttgtgccgtgtatgaatgtgtcatcgagagtgggattatttgtggggagattatgggaattatgggtctatggcattgtgtgctatgtgtggctggggaggcagtgttgtggctgtggagtggtagctgggtgtgtggctgttgtgtgtgtagagaacttgtgtgtatgtggctgtatgtctgttattgtacagtggagttgttgtagggacagcttgcatacaggattctatatgtagttgtgtgtgttactggctgttgtgtgtggccaggaagggccactgcaggggcctgatggtttccactgggtgtcttgtcagagaggagttggggcagggggtgccgtgtgtgccaatgtgtttgcagcctaggtggctggcttagagtcactatggcacatcctgggattgcttgggtaatatatctattaggacctgagtgctggtgtttgaatgtcatgtgtctgtgtggtggctgctcccgcgattctggacaggaaagggttgcagccagggctgaggggtctgaggtgaggagccagttgacaagtgtgtgagtgtgtgagtgtgtgtgtgtgcgtgcatgtacacgtgcatatgggaatggggtggggtgggaggaggcagtgggccagcagcgctgtctatgctgaggggctgtgtgtgcccacaaacgtgtgacattaggtgtgcacattatctatgcaggttgtgtctgcatgtgtctctgtgtctaggtggcgtgcgtattgaatttaattggatgcatacacctgtggctggggaggtgagaggtgtgtgaggtgcgtggtgggagacggtgtgagtgtggtgtgaagtgagggtgtgtgagctgggtgactttttggtgtgacgtgtgaattatgtgatcttttctccccatgagctgtgtgtgcctgtggtgaggagtgagtggaggatggccagtgagctggcggtgtgtgtgttgggggtgttgaggactgtagaatgtgctgcggtggcagtgtgtgcatgaggtgtgtgtgaggaatgaggtctgtaacatttggggcgtgtggaatatagtgggtgtccccataaatgtctgtggagtgacgcatgtgtgcaaaagggcttggctgccatcctgttcttgctcccctcctgatcaggtccctagagatgccctggaatgttctccatgcccccccaaccccagctgcccctaccctttgcccttcatcctccttgccttgaccaagccctttgttttgggtttccggcggagcaggcgctggacaggcgggcggcaggcaatgtcgtggtctgagaacctttgttctcttagtttgactggtgtttggggccttggtttggaggagggtgtggagaggatgcacgtggcagcaaggtcactgtgtttactacaccacttcgtgctccgcagaggggaggcatacggcgcaggcagtgaggcctgggtggtgtctttggtggcgcctgttggtgtaagaacagcttaggctgggcttggagtttgccagccatgcagtcttagtccatagtggcccagcgcccttcctggctcatgtcagcggggctgagcagccgagcagccaagcactcacttctccaagttcacctgccctcgccccttctctgtgtggctgcagcccctggagacaaccaggaagacctcgatttagttctatttgtgttcactccaggtcagatggaggagaaagagtccccatcctcacagagacacttatctgaaaggagagagctggtcacacctttggggaccctctagactgacgcagtctgtagggggatcgaggtcataccttccagagagagctgtgggaaaaccctactgggctgcctcccagcaggtgcttgagagaagaaacatccaaggttccttgagattggaaggcttagagaagtctgagtcagtcagggaaggggctggggtcgatgccgcagtgtcacataccagaaggttctctgaaatgaataggcttgaactggaccttgaagggggtgttggggtgggcagagaaatgcagcctggggctgaggaaggttctggcctgactggcaaaagggatcttgctggccattccccaggcaacactgtctggctttgggtagccatccctgggcctccagccttctcaagctttcacggtaccttttttatcccattgtctctggctggaattatcttcattgtcgttgacattgtcatcttcatcatcttttaggcagttatttccaaattccagggtcctttcacaaatgtctcatttagcaggttaactcatgcaattgtccaaaagtctttatggaacactgctgtgtaccaggcaggcacagttttaagtgccggggtcatggtggtggccaaactggcctcatggagctcctaccttctgtgtccagccatgctgtcagttgcccacccttctgtgtttcccccagtctggggcgcctggttctgtggggctccgcatgtgcaccctctggtgctggggtctggctcctaccagaatgtgagctctgcagaggctgggcccgggtctctcctctacccaccgtgtgtgtcctgagctgggtctggcagagtccagatgctcacacctatcatcaagtgactggaactgccatgtagggttggcagtccagctctgtctagggaaactggggtccatcggatgaggggactctcatctcatcaggcagcatctcatcaggcccttcttttaccagtagctccagagaccaagaagggtcaggtgactggtgcaggtctcacagcagggtggcgcggctggtgtcagaagacagcacttcttgctgccaggttgggctctggtcctagcaccatgctgctctctggctggcctctgtgctgcctgcggcgggtaaacgattattaatgacccccctggcaaggagacaggaaatgtttcccagccacagctggggacctgctccctgccagccccagctatccatacccgtcctgaccatggcatcggtgctgatgttatcttcattctgcctcagtcttctttactccttctgcccatcccccgacctccctgatcttgacatcctaagggtaaatgacgagaagctacagagctttcttttccatatccctgtccctcaccactttctccaacctgactcatctctaccttcttccttgtcccatgccagccagaagtagctcttcctccaagaaggcttctctgaatgcacagccagctcctccagtgtccactaccctgagcccgaggcactgagtccccctcattgcagactctagtcctccactgatggtttgctctgacagccctagggctggcctgggcacttcccgcagactgtccctaattgctgccttaggactgacatatgaagggtcctcccagatgctacctccaggaagtctccagttccactcagcccagggattcttacctcctttgagcacagtgcccttcctgtctgagtcacacatgtgtacttccaggacttcctaggtggacattagtgaacacctgctatgtgcccagcacagagggtgggaagagatgagcaggatgcaggccttaaaatccccacaccttcctccaagcctgagcaatgttgcatcagccccttggcaggtggcacagacctaggtactagggctgggggaggggaggcggagaaacagggagtgatgttggtagagtgtgtggggagggcaacgagggagataaactcaggggccatggtgatataaagcagggacccctatttcagcccagagtgggagggaggggcatgttggggagcttccaggaggaaacaaatctgaactgagagctaaggtcaagccaggagaaagttctggacagaggggagagaatggttactgtgaaggttcgctggtggcagacagagggaggagagcctgtggcagcaccactccatggagcaggcccctgggtgccagccggctgggtccggggggatggggactggtaaagctggcccagccagatggtgcaggacttgtaagccatgttaaggactgcggacttattctggagggaaattgaccctggggaagagttgagagaacggatatgacagatcagatctgcatgttcaatagctccctggaccatggtgtggagactgaaggggaggctggtgtggtccaggtaagcgggggtgatgaggcctggacagggaaatggctgaagaatggaggggaggggacggagtggccagggctggtggagggagctggacagctgtagacgtgaagggcaagggaggagaatgctgccccacccaggtgtctggatgggttttgtgcagtctctgagatgtataggagggaagacaggggttagtggcagatgcctgggcctgtgtcagggccctttaaggaccaaaaggtcttggaaaagcctcagaggagatcatgagctttgagattaaagggagacctgaagccggcccagggctgctacagcctcacctgtaacatgggaacttgagatctgccctgggcaaagggtgttcagaattcaataatcaaaacaatctgtgaaatgtaatacttaataaaattcaaatccaaaaatgtctgagtacattccaaaatgagtaaaaatgtaaatttatgaaaatgctaaacatgcgtgattgttctaatgtaaattgtaagcctcagctgcttcccagaactttggatctggctcccttgaagctgctgcctctgatgtggctgccccctgcagctccaggaccttcctgttcagctcccttgagagtagccggcagggcccctcctctgcagagcctgtactctggctggtggcttcagggggcaggcattctgcctttcctgtctcccaccctaagggagttggccttgcatgcctcccatccacggttgcctctactgggggctgccactgggagacaggaagggcatgggagtttcgggagctcagggtaagaggggctgagatctcgtggtgtggagggggagcgggaaggtcgggtggccgaaagaatggagagggccgggagtgagagcaaagggagacaggcagagctgaagagcagtatcgccccaacatcaatactggtatttcagaatgggaaagctgttccatttcccgaaatatcagaatgctgaggtccgatcttgcagtctctgagctgggcattccttggcccccactctcgggtattcttgcacaagaccatttttctgggctgcattttctcacttgtaaaaggaggaagttgggggtcaatatctccaagcgatatatgagctctagctctaggagtataggattttgagaatctggaattgttagtctgtggggttctaactgggacaattctagcattccttgactctcagctcccagccagggctgtgtggatgcgtggttgtgtgattccgacattctgagactttaagatgctgaggctctaggagctagagatacggacattctgtgaatctaggattctaggatttgatggtttgatgattcaatgattctaaatggggctgctgggaagagctgcaaccacctgccttgttaatgtcaatgttcagttattaaaaacataacaagaagcaatggagacagatagctcagaatggtgggcgctccctccactcccagtgagggaggacagaagaggctgggctggccttagagaatagagaccttttcaacctgggtcacacaggttgtttctcctgtcacaacagaactggtgtgtgtacattcgagagagcttccactcccaaagcttgcagggtaaggggctcatttccttcagcactggcctctattccttaaccatttcagactgggcagagagaggggtaactaccctttcctcccagccctcgaagtctctgggcagaaatggcagcagtggaggaaggagaggtctgctcacccccgccccttccctgacagcctgagggggaaaacaggacatgaatacttcctggacacagacatggaaatgcatgaacccctgccttcgagggccccgcgtccaaaggctcagacaagggcagaggccaggacagccagtggggtcccatcagcaccctctcagtataggctgaggagggaagaccctgttcttgccccaagggtgacagtgagaaggggtcaaggaaaggagtcccaggtcagggactggaagtgctgacaggtcctcccctgtgtgcaaggccacagtccagcctggcagaaggccagcccaattgtccagtgtttcactgcctcctgagtccttcttatgccttggcacccaggccagagttggggaggggtccaggctgcaggggagggtttccttccagagtgcccatccctgatggatccttagaagcccagtacagctgcacagttccaagggcttccgctgcctggtaggttcacagaccaaagctggccctggtcacacagcacaacggggcctgaaatcaggcttcctgattcccagtcctgggtgttcctttttgcccacagcctcccccacttcccctgggacacctgaggggcaggagtggaggtggggctcaggttagggagcagagcctctgtccatcatccctccgtcttcctcttcccacaggccagaagcaggtgtggtggtgacagctgcccccagtcctccacaaggctccattgtccccggcagggagcccctccccagctgcaggccagaagtgtgcctccccgggccctcctgtcgtgactctgccacccgcttcctcctgctgccccttccctcttctcatctccgcttgccctcaggccctccccatccccgtgaggtctcgtctctggcgctctctgggtttaagcctctctccagtgaaagttagatttggaagggccctgggagatcaccaagtccaacccttttattcttcggataaggaggccaggtcagagaggggaaggtcctgtccaaagctgcacagtaggctgaggcagagcccagtgctgtgctcccttcagcgctgggtcatgggtgcacactgcccttggcatcaggcgtccagggtttgagaactgactgtgatgatcagcgctaagcacacaggcacctacagaaatgcggtagggggcttctctcctcagcccttcttcacagccctgagctgccctcccttcctcttctttgcccagctcctctctccttcactatccctgctgtctgctgactcctgcctctggcagacactgtccttgggacacagactagagctcaggcctccaggactgggatgcacacccatgcacccagacacagacacataaacatgtgcaagcgtgtcacggggtccataaatcccagctgaaaactggtcagaccatcaggaggccaccctggaacccagtgtcctcctcttcctgtcaggcctcacacacctcctccaggaagccccttaggacccctgaagaccatcttcatccaactagcccctttgtgacaactgaactctgtgagcctaggttcctcctgtgactcgaagggcaaggctgagtccccccttcagtcctggggccactccttcagtgtcttcaggaggggctcagcttcctgttgctgggtggggagagccctgaggtccccacaggacgtgggacaatggggaggcggtgacagatgagaggctgagtcttccctaaagcagactccaccctcccctgacctccctggctggtggcttggacacagccctggcctggactagggtcctggtctgaccccacaatgcagaggtctgggaatcagaagccctggttctccagcagcagttctctaactggcggctatggagtccaggcctccagggcactggtaggttattggcgggttggtgcagattccagtgtccaggaggggtgagctggcctggggggcctatgtacaggagataggagggtgataaacacaggctaggtgggattacagggagctgggaatacctagctaagaatcccctcatcctaggcactttccccacacttgaaattggctggagggggaaccagaagttaggtggggttggggagggacaggagccagcaccctgcctccacctccgggcagtgcctctgctggggggagggaacctgtcctgggggtggtgggaggtgtgaggggggagctggattctccagtgaaactggccctccctcctctcaggggaggggagggggctgtccctggctgctcagcaggtagcccatctggctgtgggtggaaaagaagactcaggctttgtggataaaagggacagccctgggtcaggcacttatctcaaccctcgtcatttcctctgccggacatgactgggtgagtggggtcattgcacagagggaaggaacaggccagggccagtgcataccaggccctacaggagagtcaggcacatgggtgaccctgccacaccctgggctgcagtcagcccctcatagaggcccagacacacaccacagtcactgccggagatggccacacctagaccatcacaccacacacagacccagtctctccaggtgacactcaggcccagctgcaggcgcagctaagagggaagaccctgcagggcacagggacacgtgggacaaccagacgccctgcttcggccacaccacaagcctccacacaccaggtgcagctcctgtcacccctacggtcaacccaaggagagccagagattccagtagtcgtgggcaggtatccagtgcccaggcgagaagagggggacaccagcagggaacccagaacctcctccatgccagactgtgccctccccccagctcacagaaggagtgcctcaggctgtttatttcctagcagggactagcagggatgggtgtctcatccccctccccctcccagtccccaccacacgattctgaagctgccaaatcaaatcagcccctgcacccgcgccaggctggcatggcggccagcagctgacgggaacgaagccaggctcagaatatcccaccgcctgtccgatgcctgagtaggcttgttgggtgggggtggggaggggcaggagcctggcagccaggccctgggcagtgcccctcagagaggctgggggtttggaatgctgcagggtggtgggcttctggagaatgagtgagcaggtctctgttgtgtctccaggctgctgtggcagtgtctccaccgctagcattccgggaactgtggaagtggtgctggtaggatacaggtcgggggtctgatcccagtccagatgactgggcgccaggctggggtaggggggctcccacatggtctcacattcatttgagactcacagcacccaggttggaagccccttggttgtctgtcagtaaaggcccaactcactgtggaggcccagtgactgtgtgaggtggacattacggatcccattttacagacagagaaactgaggcttagagagggctagtagagctccctggagagaagcagaagtggaggaggcctcagaaagagtaaagaggtggtcatttccactccttaggagccctaggtggaaagaaggaatatggctctgttctcagagtcaaggaacagagaatatggcagagccagaggtgcccatgggaagcagagaacaaggagggagtcttgggagagagcagggtgcaagcaggcaaggctccctggaggagggggccatccgtgggcttgctgggggctaatgggaggacagtctggggagaaggggagaaggcctggccggcctcagcccctgaccttcttgtctctgcagccagcctggacccccttgcaaaggagccaggacccccagggagtagagacgaccgactggaggtgagagctcagtggagggagaagtgggtgggcttgagggggtggggcgcagactgaagatcagtctgagtggtgccctcccccttgggaggacggggaggctggagtcacatcccagccccagccctccagactaggaccacccctatatcaagaccatctcccctcaccctatatatccccagcctggaagtcctcccatgaggattcctcctcccaactcacctggggagtcactacagactcctcccttgtcctccccaccctcacccaacaattcccgttgattctctgccctgagtatttcccgagttcctctcctctccattctgccgcctgcttgggtccaggctccctcaactctcccctgggccactcactggctgcttgctttcagtttcccccatcatccacgtggccaccaggaggatctttctaatgcacagacctgaacttgtcactctcttgccccagaatcctccatgctccccacccccatgccccctccacaaccccagcctggcaatcgttccccttcatccattcctgcctcccccaaactgctcctgctggcctcttccccactcagcttcctaaatccttcggggatcagctctagcctcctttcctctgggaagtcctctctaccccttgaccatgggaccaagctcactcctgctccctcctctgagctctcctgccctggcagtcagatgccagggcgctctgctgtctgtcgcccaccgtgctgtgccacgagcaccctgttttctccatcacgtgactctgtatgtgtgtctgccttgtcttctctgcactgtgagctctttgagcctcgggactgtgctttcttcattcctgaaccttctaccacccttggatgggtaccggtgcagggctcagccagcgcatttcctgccctgcgaggggtgccatccccaccccccgaccatgccttccttccctgtgaggggtgcctcataggactcttcagtgctcaaaggggccttgacgagcaaacaaggtgggctgctgatgttgaagatcggcacagaggagggtgtgtgtgtgtgtgagagagagagagagaactggacccacagccagaacagagtctgcccaggcctggctgagagggagaggaagatgatgcttgtatcagccctcctgtgtgccaggagcctttgacacccaccttgtttaattattacagcacccccatgaggtaggggctgctattattcctatttcacatttggggaagctgaggcccagagggatcattcagcaagtgagttgggacagagctaagattggagcctagatgtgtctcaggctcgaggctcactctttcccggcccctgagtaagatgggaaagaaggtgcccacacagggcctggtgcacaggaggggctcagcacaggttccctgctgggacacagggccaagacctgagaatgtgcctccaagtggggctgggccctgctgctgggagctggcaaagggagctgggaggggagggcctggaaagccacattattaatttatttactgccatggcattccccatggggcggggctccccccagagctgggacagatggtgttcctgggagcctgcagtgtctcagcagcctcggccacccgccaggaaagactggatttgtcatccacccagggagccacaagaagagggggctttggcaaagctgagaccctcctgggcaacggggactgtgccctgagggaaggagtatggctccaggcaccctgctatgcctctggggcagcccccgctgcctaggccatctgcctgccctctgcaggttcaagttctgctctttgtccagctccaccggcctcgtccttcccatgaggcttccctgggtcggccccacctgctcctatccctgtattttctctgcctttccttgagctgggtcctgctgcctcttccctctgaccgaggatctggagccatgagctcctcagccctcagctctgtcctgaccccatccccacactcatccccaaaacagttagtgtctgcctggactcttggcagggcctgctggatttctgggtcctgccagcaccccacccgagtgcccaggcctatactcagcactgctgggaagagatgggctgcctgaggggacgctgccaacatggagagggcaagactggagagagtggggacccgagggcattgctcagaccacaggggcagctggagggaaaagggactgggagcctgaggggccctcctgtcagggtggatctgggaagccaagatggcctcatatagtggacaagccacagggtcagatgagcacgggttcaagtcccaactcccttgcttcctaggtgtgtggccttgtgcctgtcacttaaccagcctgagcatcagtctcctcacctgccaggcgggataagaacgtctatcactgccgggagcggtggctcacgcttgtaatctcagcactttgggaggccaaggcaggtggatcacaaggtcaggagatcgagaccattctggttaacagggtgaaacctgtctctactaaaaatacaaaaaattagccggttgtggtggtgggcgcctgtagtcccagctacttgggaggctgaggcaggagaatggtgtgaacccgggaggcagagcttgcagtgagccgagatcgcgccactgcacttcagcctgggtgacagagtgagactccatctcaaaaaaaaaaaaaaagaacctctatcattcttggatgtaatcactgttattcaacattaccacaatagagctgttgggagaagttacaaagactgtatgtgtggggtgcccggcgcaggcctggcacatggcagatccttggggagagttagcctcctctctgtttccctcaaggatgacatccttagagccaggactaggctgtacccctgtgagacaggatgctctgcagagctgggctgaggcttatggaagttctatgggcatggcacactctcctggcactggctgggcagcagccaagaaagcagagctgccagcacccatccccacccagcaggcgtgtgttcagcacaccctcctgggatggttacctagcccctgtgccagcagctgacttggaggaggggctcttccagctcagcctggcatcctccttcagggccaggcctctgcatcattactgtctctctgaaagtcaggtctggggcagttcaagttggtgaattgagcatgctgagtcaatgccctctttgtgatggctctcagggcccagatggcggcttgggagccttagctgggatgggggcatggggagaggcggacgtggatgagggcactgacatccacaataagtactgaaatgcactgcccaacaccggctcctctattgctgcccttgggacaaagaccacaccccttggcagggcattgctggccttgcctgctgggtcccctcatgtccccttgtgtccccttatgccctgagacagccagcgctacagccacattgttgtgttcactcccagcacacagcagctccccctgcctccctgcctttgctcacactgaccacctgtctggaatacctttcctttctttctccacctactctcttttcaaggcccagatgaaatgtcacctcctttgtgacgttcctcagactggtccctctacctcaggccgagccagtctcctcccttccctgggcactcacagtccccatttccctgagcccacagttgggaaacctgttaccccacggggtgctgtgggtagtgtatccttccccatggggttgtaaacacccaggaggcagaggctgagactgagtctcctttgtctctcttgggcccatgtggtgcttggtataggcctggtatatggtaggtgctcaataaatacttcttgaatgaacaagagtggctgtgagtagggctggagtagttccaagaaggggcacagttgggttgggcggtcttggagacttggaggaggcaaccttagaactttgaaggatggagagggtcaagggcaccaaccgaagaagccagggaccagctaggcagtcagagaggtccatgaggtcagcttctgacagcagcagctaaggacaaccaggaccagaacaggactgggaaaaagcagatagaggaggctggagcaaggactcagccccagaggaggctgcaggaggttggctcatgctcagaacccggctccaaaacactctgcccatgagtgctgggctgaggaaggcttggtgccagagtcagggtgaggctgaggccaccagtgaatatgtgggcccagctgcgggggtagcactaggcaggggcgggagccaggttggagggggtattgccattgccgctgcaggtggagtagggcttcgctggggaaggagcagcttgtgcgagagtgtgggcaggagtgggaggggagaaggctccgagtatacgagcatagcttaccagcaagtcctggggtgaggctggaggggccgcgctgtaggcagcacttttcaggcccttatctaacattctcaagtgagtgctcctagctgccagatgtgctacttcctcctggattctgcacatcaggagccagtggcctctacaatgccccatggccccaagggagtggctgccaacaagttggccttagcatctggcatccatgggggtcctgaggccctgccatctgtctgtgcccctgttgggctgcacaggcccggggcgtgcagggacctgggaccagggaggcggtctcagctgccactctagcctgtctctctgcctgcccatccactgtccacacccctggctgactgagtaaagagagagatgggcatcgcaggtcctgccatcaaagaagcctagtctaaaggaggaggcataaagcaccggggacttatacccagagaagacacatgctgagaccacgccaggctcgcgggcaaggcctaggcccagggagggccagcctcgtcaagggcctggagttgagactcagggaaaggcaggagctggcatagaggcgcaggcaggtccaaggcagtgcccaggccagatgctgcggccccgggctgaggttgctccagccggccccaccccccaccgtcctgcctggcctttggctgtaaacactgagagaacaagttccgtttcccgggaaatatttatctcaggctgtgtgaagagcgtgtgcactggcctccgtgtgtccttcctgcagaccggctggggcaggaggagagggagcttggcagcgcccttgctggggggagtctgtggggctaggagggaagggtgtgccagaggcccctgcctagagcctgaatttgagtgctggctgagggagaggtgggagcagatgggagagaagcctgttttctccaaaccccacaaatgccctccacctctctcatgttcctttcttcttcctggtccatcctgtctcctccaggttccggcctccagcctggtgtcccctcctcaggctgccttttcctcctcctcctccctgtttcctggctcttagccgctccatctgggaagtcttcctcaactttaaaccctcgaacccttgtcctctgccctccatctcccactcctcaggctttcagcagcttcacgtggagcattgggctggtcctgtccacagttgttcagttgctgtaacagcttgtgcaggctgccctggagccctgttctgggaagcacaggtctgggcaccctggggctggggcgaggcccggagctgatctcctctgtccatcccagtagagccagcaccagtgcagacacatgggggatccaggttggtggaccaggggaggatggaaagtcccatggatccagccggaatgttggagtggggaggcagagggcccagggttcctgctggccagcctctgggcttaggggtgtgtatcccagacaggccaggcctgccaggggccctgacaacaggaaatccttgaaggaacaagcagaggctgaggactctgagcacaacaacaggaaacagccgtgacatggggcaacagccctggcgactgtgcccagttggggtggggacgaggggccaagcttgtgggacccagggtgatgccaagagggacactgagacactgtgggacagggggcgttctgcacatgtgacacggagcttatgacgtgtaatatcaagtacgtgaccatgatcatagggtactgtgtggagtgtgggtgagtcactgagtatgtgacactggctgtgaggcactccatgatagcagatgtgtacagtggctgtgccaccaagtgtgtaacactgtgtgatattgattgtgtgatgctgacaccgagtgtgtgacattgcacattgcatgctaccacgtgtgtgacactgaaagtgacagtgagcacatggagggtgtgtctccatgagaatcaaatacagaaacgtgagcaaatgacgctgcagtagcaggtatggtcctgagtctgtggctcgagtgtctgacactgaattgtgacattgagtgtgtcccaagcatatgatctagtgaggctgagtgtgtaaacaaaggcatgacatggagtgatagcaagtgtgtggaagtgggtgtgtgatgctgtgtgatcttgggcctgacattacatgtgtgatgctctgtaatggttgtaacagtatgcaatgtgcacatacagtgctgtgtaggacactgtcatgggaaggcaccgatgggttcaggcgggaaagtaacaccgtccaaaggatggttttaaaagattgctctggccggatgcagtggctcacacctataatcccagcactttgggaggctgagctgggtggatcacctgaggtcaggagttcaagaccagtctggtgaaaccccatctctactaaaaatacaaaaattagccaggcatggtgacaggcgcctgtaatctcagctgctcgggaggttgagacaggagaatcacttgaacccagggggcagaggttgcagtgagccaagattgagccattgcactccagcctgggtgacgagtgaaataccatctcaaaaaaaaaaaaagaaaaagattgctcaggttgcagaatatgtatgtgtgcgagtgtgcatggtgcgtggcaggggaggggagataagttagggggaggcagagagaaggtgggtagagcaactggaggctcctgcagctgcccaggcaggagatggtggtgcctgtgttaatggaatggcagaagagttagagatatggagcaactttggagatatttgaaaacagaaatgacagaacttgctgataaatgagaagatgagcaagagggaaaaccagagaacaatttccagggttctggcttgaagaaccaagcgatggatggtgaagatgtttctgagatgggcaaaggcaagggggagggtcagcactagtggggtgggaggacaaggaggcagaaaccgagtgagctgttttggatgtgttaagggaagcatccaggtgaaggtgtgcagtgggcagcggggccaggctagggatacatctgggagtcgacaggcatggggggtttgttaaggtcgtggacctggctgggataatggagagagggagcttggcaacagaagaggtggggactgaggaccgagccttaaactctgaatattccattgtctagaggccggggaggtgagaaggagcagcaacgagacagaggaggagggccagggaggcagaggagaccaggagtgtgaagccagaagccaagggaggaaagaggctcaagtgggagggagggtcggtgtgtggatggtgctggcccacaggtaagatgggaaccggaagattgtgctgtgctgggcactgtgggtgagtcaggctaatgggagccatttcagtgatgggctggagccagaagtcagactggcctgtgtaggatggtgagggaggtgaagacgttagcctggagagccctttggagacgttgggctgtgagggctgcagagaaggacatgatcgctggaaagggagattacatttttttattatgggtgattctaagcagacacaataccagagagaagcatataagaaactgccatatactcatcaccccagttcaacagttgctgggatttggcctcatttcttcctctcttgccccctatctgttctttcattttcctttgcttaagcttaaaattttttaaattgtggtaaaatatacataacttaaactttaccatcataaccatttctaagtgtacagttcagttgtggtaggtacattcacactgttttgcaaccaatctctggaactctttcatcttctcaaactgaaactctgcacctattaaacgacagcccccatcctcctctgtctccagctcctggcacccaccattctactttctgtctctatgacttggactactctagatacctcaagtaattggaataatgtagtatctgtctttttgtgactggtttttaagtttacttagcataacgtcttcaagttttacccatgttgtagcatgtgacaggatttccttcctttttatggccacataatattccagtgtatggacagaccacatccatccaacaccagacacttgggttgctttcacattttagctattgtgagtaatgctgctatgaacataagtgtacaaatatctcttcaagatcctgcttccaattctttcagatgtatacctagaagtacgcttgctggatcacacagtcattctattttttggtttttgaggaactgccatactgttttctgtatctttttacattcccacggacagtgtacaggggtttcagtttctccacatccttgccaacatgtgttattttctgttcttttttttcttttattttttaatggtagccatcctaatgggtgtggggtgacatttcattgtggttttgatttgcatttccctaatgattagtgaagttgagcatcttttcatgtgctggttggccacttgtatatcttctttgggaaaatgttgattcaagtcctttgcccatttaaaacattgggttgtttgcttttttgttgttattgaattgcaggggttctttatatattccagatattacctctttatcagataaaagctttgcaaatatttttctcccatttcataggttgcttcgctgaaatatgttaaagcaaatcccagacatgatgtcatttcaccaaaggtagactttttttttggtggggggagctttccggtgaagactgaaaaacctgctagacaaattctaaaatagatgtgactttggatttttgttttttaaggctaggaggtcctggatgatgctgaaatgtaacagtgacacagagccagtgtggaactgtgtctgatgctgtgtgagggtgacatggtggctttgggaacatgggtgcaacactgaagatatgggagactccaagtgagggtgacagtgagagatcactgtgtgtgtggccctgtgacacccagtgacatgggacagtgggacgctgtggaccctgaaatgactgtgtgtcaccgagcaggtgggacctgctgtgtgaaggccacaggtgtcatgtcttcttgtgtcatcctggttgatgagtgtgacacagtgcaggactctgcatgggagtaagagggactgaagctgtgctataggtgaccgggctgcatgtgattcaagtgggctcagccccagcttcagctgctgagtatgggagggagcatggacattgtagggtagatgaggagaaacactgaatgggaacagaaatggtgtctgtgcccagatgcgagctcctcccttctctgaatacccaggaaggcttcctggaggcaggatgtgggcacttcagcaggatgttgtaggtgctgattaagagcagggcctgtggtgtcagacagccctgtctaggctctgacattcagcaggtcattttatctcttgagcctcaatttcctcaagtataaaatgggagctcttaggaggattgcatgaagcagtgctccaatgcatgcagtctctggcacttggtaaatactctatggtctcttggggagcagcaacctcaacacctgcaccccaggtccccaaataacaggagcaccagtaggagcacagtgaaggtgcgctgagtgaggtgtcctcttacacccacagccctcctctctccctctcccccaacttctgtcccctgcttggtgttgtcagcgataccccctcctgcccactcactcctgccccctcctctcccctgccgtccttaccactgtcagcctccagcccaggctcctgcagcctcatccaattaggccaatgcaatttgctcaagaaaaagccccataatttggttaatcacaccagtaggggatctggtcccggtcgggagggtgggggtggataggagtccatacccgcagctgaggcacaggtgtcaaagtgcctgtcttttgggacctttacccacttccttgggctcctttcaggagccaacagagtccaaagcttgggtcttctcaaacccaactacagaggccttgaaacaggagtctggacttcctgggttcgcttgtgttcctgggagggtccctgctactctctgggcctcagtctccctttccaaaaatgggagtggaactggggagtctcagaggccccagttggcctagctctgcatcccagctctggtcagtcccccttgtggcttctgaggggccttctcctgggccttggggagggagcactgaggggtaggtggagagcacagggccccagggaagtgaggaggggtaagtgtcctctgagtctcatctggaatgtgtctaccccagtcctataatcagagaccctctagttccaggctgcacacctgaaggtggggcaggaagaaaggaagctgccctttcttggtcacctgcaaggccaaagtctcttaaccgtgcaggctataccttgcacaggagctccagcagaggtggggtggtgctgaaactgagcccactctccctcaccaagcctttcccctcaggcccgcatctgcccagagaattggggtccctcctttctaatgtgcacacaggtggccccagccccctgctgggagtcagcttaggcaaggtttgatggctcagcttaatcttctcagcagctctgggggaagagaccattttacggatgaggaactgagcccaggaaggtccaaagacttgtccagtacatgtggtgtgtggcagggcaggcagatgagcccgcatctgagggaggcgatgggagaagtgacaggggtgcgcagaggaggagaattagaccctctcagattccaccactctcagccacacgttcactcactcatttggagacaagactaaccaccagcgcattcacagccccccagacagccacatactgactataccactgtcacatggacatcaatgacctgaatcacatatgcatagatgcaggcccacatggtcactcccacgtgcagatggccagtgcacacacatagacacagggtactcacacatgtttacactctcacgacccatgtgggttacagattcctacagagacacagacctacatactttcacaaggaaattctcccagtgacccagggaacatagtctgccatgatgatgtgatggtccgtaggggctcgccactatggaccattaatgggcaggctgcacacatgcttaggtccccagcaaagcgggagttctgcacagagtgagaggagaggtcagttctgatgagtgtatccagaattttgcaatcagaaaaaccacacaaaaactattttaattttcatttccaagataaaatttagtttgaattgtatagagggtccgagggtctggtgggagggcatcatcatcttttcaaggctttggggttctaaggcacccacagattcacaacagtcccacaagatatcccaggctgacatatttacccagcccagtgtgtgcgtgtgtgtgtgtgtgtgtgcgcacgctgtgtgcatgctcatgctggctcccagatcctcgggatgtgaggaaggaaagtaggagagattccagagactccggatgtttgttctctggcttcctgggcccttcaaaggaaaataactctggatgtcagcctgcctgcctggcgggctgggtggagaggtgggctgttttgggaggtgggctgtatgacagcctgcctcagcccctgtggccccactgaccgggaccctgtgtaatgaggcagagtgaccaaggcccatggccagcgtcccatgggctcgtaggcccatcgcctcccctctctggggcttggctctctcatctgaaaaatggaggtgggaaggagatgagactggatgggctttctcctggagactgattagagagacagagactcaggcccggggtccagaaaagacaaccaaagctggggagggcacatgaaggggggcaaagaaggtctgggttcaggggagtgcgtggggccccagagcctgccatgtctccgccaactctctccctcactggaggagggctctgtgccttggtgccccacctgcccagggccctgtggctcagccccttgcttgctctgtgagggggacgggagaaggatgagagtcccagtgatagggggaggacaagaccaggggagagggctgggggtttctggagggccagagcaggaagagcaggagagaagagaggacaccacagtgcaggaaacggaggagcaaaggctgggagtggggaggctggaggggtgcagggaatcagactggggcgctgcgaagaggcctgaggccagagcaggcagtgcctggatggagggagcgagcagctcctcaccctcagctccttgatgaggtaaggtgaccacgagccctgctccaggctgtgtgctgagcactttgctcggagcctgtcactctggaggaggggagggggtgttcccaggagctatgacagtcttgtgcaagggagggacagggtcacatttatgtttaacaaagcactgcgctgggagagaggagctgagagaccccggccctggggagcatggtggctgggaccccggagggcaggcgtgccccagacggaccccactcagaagattgcttatcccaaccccccaaagagaaaggctatttttaggaacaataaaagtgctcacacattcctgcaggggcagagagagggaaagggggcaggagtcagtgcagaggaagagggtggaccccgctcttctcccaactctgccttggtcttcagggacttctcctcaggggcttccccagccagccctgcctctccagcctccgcctgtccctggggttccctaccggctcttatgtctatccctctgcttctgaattggtacttgttctgtccctgtctctctttctcatacttccactttccccctccccctggggtttggggaacagctgggatgggccaagctctgttgagagagccaaatacagtcataggacaaagcagcgggaggctgtgggatacacacatgccgcagagcacagacagagagaggtggccaggcacagagagagcgcccagggaggctgagaggcagggagaaaacacgctgggacagtcagggagagccccagggcaggcatcaccgggcagccagcctctgtgccctgctctctatcttgtccctaagaagaccagcatggctgggcttgcctcccgccatccaccccaccagccctaccccaggctggcccttcctccccgccctctgcaggcccacactaaccctaggccaggccgcctccttcagcatttacctcccacacacaatgggcacagtgaggacataagagacccagtctctggcctggaggcagatactcagccttacccgacatctgagagggctcagcccatcccctggccaaggcaggtattagaggggccccaaagacaagcaggactctgggacaaggtgtcctagtgtggcccaaagggctgggctgaagcatgggtctcctggctccagatgagagcctgggtgaatccttccctgcctcctctggccttagtctaccccatcaagcttgggattggactacatgaggcctgaggccctgtagcccctggtccctgggaattctcagaaggcctgggagggggacaggtgaccacgcaggaaggcttcctggaggaggtgtcctcactcatgaaagaaggtgatagtgacagtgctcctcttggggaagagccctccatcctgacctgctgcccccacccggtctgcacgtggagatgatcctgaagcacaaagggcctcccggcctgcagaggtgcctgggagaggttgccaaaggctctcagtaggagacaccccattcctcaggctccttctctgagactgtaactgtgccagactggggaggctttgagaggtctcagctatctcccctgcctagatccttcctccacacccctcttctccctgatggcatgtagccctcacagtacagtagtcctgggcacacaggagtttacccagtcatttacagctcagcaaacgcctaccaacacctatgaggggctgggtaatgctggagacctggagaggggcaggacacaatctctgccctccaaaagctcccagtctgttgtgggagccagacgggaaagggtggcactgcattgatgcacacagtgcatgccatggtgggggaaaggggggcagtgggagccccaggtgggagggtcagacttgcctggagagagaacaacaacagactctccctggaggggatccagagaagggagatcacttcattcattcattcgtcattcatccatccacccattcaattattcctttggccatcatttcctgagggatgtaaactctcttctgacactgacccagcgggacactcagcgtcctcctcctctcctgcttgagccaccatgcctgcctcttggaggctcctggacttgctttgctcagctcccaacccaccctgagggggtgaggctgaggagggtgtacagacattcagggtcaccaaactcagagctggaggcctgccacctcaccaggggcctttctcagggcacaggctccctggtggcagggccttggcccttgcttgcacacccttggggactaggagccccctcatccatcctgctcaggctctcttttgtggcgcgactctgattcacagtgtgcccaaatctgcctccttgtgactgccgcgagctgcctcgtgggccccaggccagaggacaaggatagctagaatgccaggtgaccaggatgactgtgatggcatggagagggggatgctgtgatgtgtttgggaggaagtttgtggtgtccaggagaatgtgggcagcagaaatgggaccactctcggttcttccctgtagatgaagcagctgaaggtgggagggggtgggaggagacctgagctggctctgccccgcttgatctgatgtctgccttgcagggccatcctccccctccccacactcagctcctgcctccctccctctacccactctgactgttccctcctttcctgactccagactctgggtgagggactgaggtgattccagtgagtcaggccctcagggaactgatcgtgcaggcaactcttgcctgccttctcctgctctttccctcttcccattccttcatccacccccaaacctagctcctgatggatccaagggtgcgggggacaaccgggaggtcattttggaggaggcaggagctggaatagaagctgggactggcttgggaagggcgagaggccggggcggagctggttgtgggcgctggaagggaggagccaacagtgtggggtcaggctcctgtggatggggacacccttgggaggcactgggactggctcaggtgtattctacagtgcacgtgtctccagtgtggctcggaggctggagacgcggccctgttggagtaacaactgaagccggagtctgcgaagggtgggcaggagggtggagggatgggggcatggagcgggagggggtaagtagaggagggaggggaggaagagaaagagggaggaggaaaggtctctggcaggtccctcctttaagactgggctcctgcgctgcgagtggccccgtccatactgccttgttatccatatctccccaccactagtctccctctgtccttccacccccagcctctcccctccattgggaccttccctggggcgtcccctcattggctgttctcacctgagcaaggcccctcccctccagtccttagcctcttcacctgtacaatgggatgacccaaacaggcacctcttgggcttgtaggaggatccaagatagtgtcagtgggtctcgaggtgtggtcccccgaccagcagcatcagtgtcatctaggaatgtttggaaacgcaagttcttggacctcgtcccagacctactgtatcagaaaccctgggggtggggccagcaatctgcactttaacaagcactctgggtggttctggtgcacatgaaaattggggaacggctggtggaaacctctagccacaggaggtgcttgggaaaggtaccttcccctccccaaagcctgatgcctcactcaagcatgacactgacagttgggctagttcagctgcgttctgggtctctgtcttgcctcctccttcagactaagcctcccaagggttgccaagcctctttcctctattctcctcaccctgatccagctcagcctcattgagagaagtctggggctgcaagatcttcgcactcacaggcagttcctctttgcacatccaaggcaccagtgtctttgagaggcgtctccttggccaggtggcaggcgtgggtgtgtggggaggaaggaggaggaaccgccttgttctgctttcttgtctctgactctgcaggctgggggtgctgtaaggctgcgaggaggcatagagtcagcttgggtgctgggctgaggccaggggccgaggctcagctgaagcgggcttctctggtctgagcctacaggatgcctcctttggggcagttctgccagtcaccctgactgggcggctgtgcttgctagtgccagacccatgctaggcacagaggtcgatacgttctcctgtgctcttgaagggccctgtcctctgggaagataagaggctgtgtatattgcccaccggaacaggaggcaggaagcaaaagaggcgtagatgacacttgcctggcaccccctgtttcccctctagctgccttcctgggtttcccattctgtgggcgcttctcttgagttaggtgctttctcccagtgttctcaaggtgactatttggaggtttgtgggaggagtgggctggagacacaggagtaggtgggggcaggaagtatgcaggagagagatggagagtgggaggagaagctatgagaggaagagaggacgcggaggtgggaaaagacgtcaagactcctggagaggaacaggagtgcagcctgggacagaggtggacgtcggccgggggaggcagggaggaaggcagggaggtccacccgaaaggaagggaagggatgatggacagagaatgagagggctccgaggtcctgggggatctagaaggacccttccctttacagaaggggacaccaaggcccagagagagaggagggcctcacagaggacctaacacaagcagagttgcatgaatcagtgtgaacggacagtcccaagagcacagccggaccttgggaggtacttgactcttgagtttgatgttattgccttcctgtaggccagtgtgaggggcactgtgaggcttccttccagagaaggaggcatggagccagtgccaggcagtggggtgagccataggaggacctgtggagatggggaaaggcatagagactcatgaagatgaaacaggaaagatcttatggcagcgaccccaaccctcaggaagggcgttggtcttgtgcttgtggctccaaaggggataagaccaaggtctctggtttcatagaatcttaggctttaagaacgagttagaagtaatttagtccagaccctctcctctccccagataagtgcagaaatgcagatctagcccacggctgagccccaaccctggcttcagaggaggcctgactcagaacaggctcccctttcttggtacctggggtgaatgaaagctaagtccgtggtaatggtgctgtctgtggtgctgactggccttaccttggactacagagctgcaggtggagctggagagagcagaaaggctccatctatccatctacccacccacccagccacccatctacctatccacccaccatccacccacccatccatccaccatccctcccccaacccatcctgcacccattcatctatccacctacccactcatccatccagcctcattgaattaaaccatagaactatatgctgcagagctagaaagatccattttttagtaatgacaaaactgaggctcagaagaggaaaggtgttgcgtaaggccacacagaacttctgtagtcagtctggtacaggattggaaattgcggctcttttctacacaccacaagttctcctctgtggtctgggaaattgcctggtttttatgctgatatctatactgatatttgttccaaaaagctgtgaaggcaggaaatgtgacctccttcaccccatcccgagcctgagttctgtgtgtgtgtgtgtgtgtgtgtgtgtgtgtgtgtgtgtgatgtgatgtgcatgtctaagtgcaaccttgtatatgcattgaatatatgattgccttttgatctgtctgtgtgcgtgtttgtgtgagagcctgtgcatatacgtatgagtagaggagtgcgtagcaatatgtatttgtgtggcatgtgtagatgggcatgtgagcaggtaaagctgtgtctgtatttttcctttcctcttccttttaagatcgaagccccctgacttgagccttgctccccatctgtgcctccaattcaggaatctccctgcttcccattagcagctgctccccactgattctctccttccttcactgaagcagcaactcttccctctgagcccacacctcatgggctttgcaatttgagctatttcctcccctgagttggtgcaatgggggtgaagttgctttgagatctgaggaagattcatggaggagatggcatttgagcaagccttgaaggcccctttgagtgccagatctgaagtggcccttcccagctgcagttcctgcacccaacaccctccattcctggggcatgctgggcaggaccaggaggtggattgacagaaggatgcccacaaagagccctgggcttcatcagtcacattaccatccagtccgctctagcacagatgggaagcccttccctgctgctgccccaactctccccaactttcctttcctgctctccttattgctactatcctgcacttggcctgaaaagtcacagaaaactgaacaatcagagcaaaggtcaggcaggcacccaccaattccagtaaaggacagttgagggcattccccaattgaagcaaagggcaggttgaggagtccaccaatcagaataaaggacagactgttctttctgagcaccctagggtgggagctggggatcgggtgctgagcaggaaccagacagggctagagatccagaggtttgggttctggacctggctctgctctgactggctgtctgaccacaggttgatcattgcttctcattgaacctcagcttcctcatcggtcaaatggggagacttagctctctgaaggctgtggctttgaagaatttctccccctgtatcaggctcactccgtcacctgggtctctcttccccaagtccacatcacatacatcagactccaccaagggcagggcctctcaggagtcagcttgtgggctcctctgcctccaagaaggaatagacacaaaccaacaccaccttctgtgctgtctttagagcccccgtctggggagcgtgcatctggaagactttatcttgggagtactgggggcatcagctcttcctcccctttttagtcttcagaattgaccttggaaggccataatagcctgcgtgtattgtgcacaggtatcactcgagctcttgccctgtgaatctttaaggaactgtaccagtgagaacgtgtgtgtgtgtgcgcacatggatggtgtctgaaggcctgctgggatgtctgcgaggacgtgggatctgtggctgtgtggtgctgaagttgtctgtgctgtgatgaggagtgcctaagggtcaaaagacaagtgatccaatttgggtattgtgttgtctggaatcagtagcttctgatgtctgagggtagacatcttcccatgaccaagatatgtgtcttcatccttgagcagtgggagggaccaaggaagcctgggggttggggaaagcgatgctgagtaagcatctggggagaaggcccactactgccctcctcctgggaacactggattgggtgggggaaggggaggaaactgcagccaagaagacccaggagtgaaatttggagctgaagcctggatgcaagtcttcattgagagcccagcgtggaactttctggcaaataggcattcagcccactcttgtgcacccttgaggatgggaagctcacttcctccctctctcctggtgacctgtggcatgcctttgtagcatggccctacctggaagaaggtccttcagcccactagaccaaggccagcctcctgtgaaatcctatgggtccccaggctgtccatggggccacagagttcagatcccccatctaggagggtctgagagattggagttggagactgataaccctgggtctcctctgctttagatgaggcatccctgggttatccagtcttagtcacatgcaaaacttggtttccaattccctcgtttcataggtcgcctcctctggatgagtgtcatcttgtcagcccctgggacacaatgaacaggggatggtctaactagactataaaagtgggggaactgtcatcttcccaattgggttaacagacctctattaatatggcctgcagtttgagcatttttatttcttgccagtcatgcttacactgtgggctcatgctgaactgtggtcttttaagaccctcaacctcatatcatgttcacatgaatggggacccagccatgtctccttcatcttgcagttaatcactttgctttctgaacacagacccaaccttccactgggaagacatctgaaaggacttccaagggcttgcgggagggcatggctggtggctggtatgagtcacgatcttgccttggccctcgtttcctttgttctgttacctttctctttgatccccatggctctggccaagttaatagagcgagaagcagggacttttgtctccgttccggctctgcaaggacgagttctgttcctgggatgggaaggctgtgagacagtcaaggctgacgtctccttctcctcctatagttgccaggggtggcccagctgttctcccaccttatgggttatgcaccccataggctcttgctactctcaacccagcccctcactaggctggaaaatgagactaggtgagaccaccttccttctggggaaagtgagcgggacccagcttcagcgaatattcagctgagcatctactctgtgttgggcattctgtgaggcacttttaggactctgatttttattttcatttttaagggctcaatttcattttatcttcatgtcagcctgtagggggcaatagccccagctgcttccaacttacagataggagactgaggctcagtgactgaaccaagacactcactgctcatacacagcggagctaggattcaaatttgggtgtttttttgtttgcttgttttgttttaatttggagccttgtggtttccctactgtgccagaattgtcctcgactagagaacaagagacctggggtctaggccaggcttgacctgttgactcactatgaggcctttgctaagtccctggcccttctctgcgcctcagtttccccacctgtaagatgagggtacttggacattctgtggccttaagactgtttgattttgagatcctaagatcctgggattcctgtgcctgaaagactcgggctctggactaagctggggggttttgctcacagtcctttgggcagatggggctgccctggcctgcctggcaaagcctctcactgccctctcctctcttccaggacgccttgctgagtctgggctctgtcatcgacatttcaggcctgcaacgtgctgtcaaggaggccctgtcagctgtgctcccccgagtggtaggtgcccgcccttgccccacgcttcccaccccacccccaaatcctttgaccagctctatgctgtacctcactcagggccaaggaggaaggaagaggcagggtccctgcccagaggactttcatggggaagtgaagggtctggatgggtgttctgagacagctttctggaggaggaagccttaggctaagcatcaaggaatgaacttgcataggaatcctgcaatggctgagccagaaggggccttagaggttaagtggaaaagctgtgtctcagataatgaaagggattcacctaggataacaggacgtggtggagccagctgagttttggaatacatgcagcaggagaagttgagggtagacatgtagaagaacttcctggaagccaggtctgggaggtactagaatagggctcagctttgatgaatagacatgcattgggttaaagtgccctgcctggagatgggaggctggaaaaatggcctctagcagccttttagcagctttctttctgtcccatcccaataccatggatgagttgcaggtttggggcaggtttggggtgatcatggttgcctgagcccagagtgccttactggggagattgtgcccctcatcatctgttccaggccactcccctacctggcttcaatggccactgttcatcccttaggcaggaggatgggtaaaccagcccttgaggcccaaagtagcagggtgttagttgcaccagaaagagggaagcaggggacgtttgaagcctggagaagggagtctgatccagcctaaggggcatggaagacttcctggaggaggagattccctaactgagtcctgatagccttgaatgtcctcttccctactctaaacccggccaagggcagcctctgctccaggaaatatggccaactcagaatgtgaccttcccatccctccagagcccattgtccctgaatctgcttgatggatgaaccaccggaggcccagagagagagggcacttgtcccaaggtcacacagcatgacagggataaatgggacttggtatctaagcagccccattccctctcctcagctctgccttccccaaacctcctagaagttcagagcccaggaggagggctaatgagtgagctttattgagtgtgaaattggtaggaagtgggtggtgtgttggcgcccaaaaataaatcctcctggagaaggacgggactaaggcaacatctggcctggggtgaaggcacatctggaaagggagggtggtggaaactggcaggtcggtttctgtagggctgccccgagagcctctgtggccactgaggctgccgtagggtgggaggaggaagtgactggctctgtttcacaggcagggtgccctggcggctgtgccagcctagatgctctgcaacagattaattgtctccccaaagctgggggctgggatgacagctgtggtccaggttcctgggacagtgggaaatgtcagccctggcccacccaagagccctataggagctagggaagccctgactttcgggagtcctggcttgattgcacggaggggctcagcccccagtgaggtaagggagctgaggtctgctctgctgcccccagggagggaagcagagatggggaggggacccccgcccagggaggagagctgctggcacctggcttcctcatcagcacccattgtggcaggcagccccgaatgcagatggtgctgatgtgtctgaaatggttccctccttctctccaatagactcagctaattttaacccagagggctgagagtaagggggtgggagacatacggacatgcggaagtgaagcgagaatctgtccccctctgcccccatggactacccacccctccctctgcctgggcaggactttctgtataaccccggctggtctcttaacctctttgggccaaataactcaggcccctcccaggctgctggaagagatggatgacaaggaggctagatatagccgaagagtgggcggcctccttcccactgaattctttatccctgaacatcccacttaggtttccttccagccaaacaagagggtgtctgcccctctcactcccttcaggccttatcattcccaccccatgccacacccaccacggaacctggctcagtgtctctggaagtagtggccaggcatctcctgtggtgggggctggctggcgacagctgatgacaagaagagtggctggcaggattgtggacgctctcagagtcatggaaggcaactgcttcttctgggaaggattccacacttactgagggtgggccttcaacacgtagctccactgtcagctcctcccaaagccctccaggataccctcagctgggaggcaagcccttctccatcctcctgcggagaaaacagcagagttgtggacaaggctgcgttgcatgggggttggtcagggatcccgaagggttgccagttctgcttggaaggaatgtggatttttgcctgtaggtcagtgagggcaactacttctgccaagacatggcctggaactgaggccagagctgctctgggcccttggggagggaggattaaagagcaagagctttgatctccctctgaggagtaatcggtccaaaatacaaatctgctcacgtctccctgtgcacgtcctgccctgccccagttctgttcgtaagcccatcccactcagccctactgaccttgggcccagcccctgtgccccttccctcactgtctgttcctaaatgctccatgctttatacgcctctggacctacctgtgtacctgctataaggcctgggagcccattctgcaccctgcccactccctgaatgtgtctaattcccactcagtgacagctgaaaggtcacttcctccaggaagccctctccagccccaccggaggatggcgcagtgccctgctctgtgttcctcccctggctggggttatgggtgtgtggtttcttgtagaggtgaaggagggatgcttcctagaacattctgagccccatccctggtacagctcagagtggatgctcagttattgtttgctgaatgcctgaggctggagtcaggcagggaaatatcccaggtgggaggtgatttgtctgcaccctcagtccttgaaactctttacctggcacattgggttttgggtggtaaaaaaggtcataggttcatgaatcattgcctgcttagaattccttccaagaggagaggacgaggtgcttagttcaccgggtgttttgctgccctggctgcatcttagaatcacctggagagaaaaacaaacagatcattgccagagctccactcccacaggttccatgaccttgccccacagacccctgtgtacaggctgggactgggcagctgggagggcctctccacagggtctcataagtgccttctgtcctaggaaactgtctacacctacctactggatggtgagtcccagctggtgtgtgaggaccccccacatgagctgccccaggaggggaaagtccggtgagccattctctgcacccccattgccctcttgcatggccaaggattctcagggctgaggcaccatccaaggtcatctggtctgaccctccccttccaacattgatccccgcctccctgccaggtgggattccttggccaggttgctgactccagcacagaagggcagaagcaatgtcttctcttccttggggaaatggataggcacagagaaaataccaattgatggtaaattttctccttctaattgcttctaaatggctgcagcctcctcagagcagagtctcagaacattggggctatggggtgtatcagttagaacaccggcatgctgtgagaactactgcgaggctggacctggaatcccagcatgctgggcctgcaggagctcacagtgccaactccttgcatctgagaacagggagatcacaggcagcgtcctgctgagggttctggagccccactgcctgggttcaaatctcagctccctgtttactagctgtgtaaccttgggcaaatgacacaacctctctgtgcctcagttttgtttatgaaatggtgataataatggtgcttataggattgtggggaggattaaatgtgtcacacatgtaaagcatttaaatcaggcctgatccatggtgagggctgtctgttggggattaccattgtgagagaatgctggaatcactgacttcaggatcatgggatcagggcacttggccccctgataccttgatgcccatttaattcagcctcctcatcttccagatgggtggatatcatgagacatgaccaaggccacatgccaggtatgaggcagagccaggcctaggactcgggtcttctgactcctggctgtttaggggaaagtgagaggaagtggaactcatcagatgagaaaaccttgggggcaggcatgctgctgggaggaggcaggctctgaaggatgtggccattgcctgctaagcactgaatgcagggccattgtggggcccagggagcactgggcaggagctgagggcagagtgggcaccagtggggatgtcccaagaaggcagctctctacccctgtgaggagggcttttccagcaggccaggtggtccagggatgtggctttttcaggtagcagctgagcctggcaagccactcacctttcacagggaccatggaaagaattcctgtttgaggatgctggactcatggtcctgaggcccctccttgtgctggaaaccctggtttctaggatgctggtctctcctcagccctttcccgtggaaggagttggttctgctctgatagccaccttcccatttcctattctcccactgagctcctttcaccttcccctaacaacttctccgtcaaggagcatgggaacaaagccattaccacctctctctagcctttgtgtcccgtctgtaagaggatggtctgaaaggtctttagaaccttaaggggaaaaatgtggtcatgtccccctttctcctctaattccaaagaacttcgctctcctccagcatcccccacctctaattctaaagaactttgcttcatataagctccactcctccaggaaggctcctcggagcagcctgggaggccttcctgggagggatgcaggaaaacaggctcaggaggcagcggggagcagcctgcaggtttgcttcactccctaggacccacacatgctcccctcagctgtctgggcatgtagagtgggtgcgtatctgcggtccaggcatttttgagagggctcagatccttggcatcagctgccctttcaacatcctccttccaaccacttcagactcagtaaggcctttggaaaaaataccaaaaaaaaagcaattaaaagtgaatattcaaatccaattatcccagagctcagtggagatggggaggtgagtgcctgctggtagacaggggctgaagattccaggaggagggccaggggatgagaaggcaagagagtgaggacagcaaggacctcccaggggacatacccatcatcaggacacacccgtcatcatccccaaacaggaattctttccatggcccctgtgaaaggtgagtggcttgccaggctcagctgctacctgaaaaaggattgggggaaggcccaggcccagtgctctctctggtatctgagctctgcttgcccacctttgtgcctggtgtctggtggtgagcccatctccacaattagggcggagaggccccagggttggctgggccctgctctcaggagctcccagcaggatggggacttgagacccaggtgtatggacgagggaagagcactggaatgggattcagacaggtctggattctagctcagccccctccctgtctctctgctttcctacctgaggcccggtctattggcttaatggggtaacaggggccaagtgcttggcacagtgcccagcacacagtaggagctcagtgattgctacttgcactcccaagtcccaaccaatgattagccttgagtgaccttgagaaaacgacttctcttctggccttttttctgtgaaatgggtggggttgggtacagggtccttccgatggtgacctttgtggctctggtccccccaggagggagagggactgacctacaggctgccgtggagcctgaggctctagcagtgcccgaggaggtgggggtgtggggagggtgctactccaggaaaccctggactgtgggcaaacagcagcaggtgtggcgtggaggctggatcatagagacagataaggaggcccgaggcaatgggcagggaatgggatcagggcagtgtggggagagacagggtggaaaagggtcaaggcgggagtgaggaggcccccgccagctcccagccccacctgtccctgttcctgccgctgtttgggctctcagatgcccagctgcatccccccagtgtgtttggctttcctgtcttcttgtgcttgtaagggctgcttgctcccttgcaaagaccgtccctgctccactttcatctcagccaatcccattgtaattatctttcatggcctgaccagaagctgtcttggggaagcctgctccacagttccctgacactgagaaggaaccaagtttcagaaaaggggtctgggccatattggcctcccttagggttcttccacaggaagaaccttgggctgggagtcagagacctgggatccaggacaacatggctgcaatcacaatccgatgccctcttcctgggcctccatatgcccttctgtaaaatgatacgctgaacattctgatattgagggctggtgaggctctgaattgtaagggctgcaaacgaccttggggctggagaggagagaatcctggaaggctgcctgggccagggtcttcctgaaaggaggcttcacttccctcttgttggtgccccacctccatctcccagactgtttcaggccccagctctgccgccttcctcttcttgtgtctcctgctatcttaaagcctctgattacctgatgctgagtgcagcaaaaatctcaggcctttcagctgcaactgaagcacccaccgcccacctcggcccaggctggctgtctccctctgctaccattttggggtccccagggcccatccctaagaaatttcttcccctaagctgaccaggtcttctttcattgcagaatctgaccatccctaggggttgtctcagaggacaccgggaacggtctgctcccatctcgggatcctcacatgctgggggaaggagggcaagaagagggtccaggtcctgggggctcagtgagagtggggggcttagtgaggggatgggggcccagtgacagtgggcagcctcagtgaggtgatgggggcccagtgaggatatgagggctcagtgagagtggggtggcccagtgaggggattggggcacagtgagagtgaggggctctgtgagggggtagggacttaagtgaggggatggaggctgagtgagtgtgtgggggctcattgagagggtgggggctaagtggggaatgggggctcagtgaggggatggaggctcagtgagaggatgagggctcagtgaggggatgggggctcggtgaggggatgggggttcaatgaggggatgggggctgagtgaggggatgggggctgagtgaggggatgggggctgagtgagaggatgggggctgagtgaggggatggggctcaatgagaggatgagggctaggtgagaggatgagggttcagtgaggggatggggctcagtgaggggataggggctcagtgagaggttgggggctcagagaggggatggggactcagtgggggatgagggctcaataaggggatgggggctgagtgagaggatgggggctgagtgaggggatgggggctgagtgagaagatgggggctgagtgagaggatgggggctgagtgaggggatgggggctcagtgggggatgagggttcagtgagaggatgggggctcagcgaggggatgggggctcagtgaggggatgggggctcagtgagaagttgggggctcagtgaggggatgggggctcagtgagaggaagagggctaagtaagaggatgagggctcaatgaggggatgggggctgagtgaggggatggggctcagtgagaggatgagggctaggtgagaggatgagggtttggtgatgggatgggggttagtgaggggataggggttcagtgagaggatgggggctcagtgaggtgatgggggctcagtgggggattagggctcagtgagaggatgggggctcagtgagaggatgagggttagtgaggggatggggctcagtgagaggatgggggcttagtgaaatgatgggagctcagtgagaggatgggggctcagtgaggggatgaggccgagtgagaggttgcggctcagtgaggggatggggacttagtgagaggataggggctcagtgagggaatgggggctcagtgagaaggtgggggctcagtgcgggattgggtctcagtgagaaggtgggggctcagtgagagggtgagggcttagtgagggtattcgggctcagtgaggggatgggggctcagtgagaggatgggggcttggtgaggagatgggggctcagtgggggatgggggctgagtgaggggatgggggctcagtgagaggatgagacctcggtgaggggatgggggctcagtgggggatgagggctaagtggtagatgggggctgagtggggggatgggggctcagtgacagggtggggctcagtgagaggatgggggctcagtgaggtgatggggctcagtgagagggtgagggcttagtgaggggattgggtctcagtgaggggatgggggctcagtgggggatgggggctcagtggtagataggggctgagtggggggatgggggctcagtgagagggtgagggcctggcgaagggattggggctcagtgagggggtggggagtcagcgggggataggagctcagtgggggatggagggtcagtgggggatgggggctgagtggtagatgggggctgagtggggggatggaggctcagtgagaggatgggggctcagtgaggggatggggctcagtgaaagggtgagggcttagtgaggggattggggctcagtggtagatgggggctgagtggggggatgggggctcagtgagggggtggagacttagtgagagtcggggggctcagtgagggtgggggttccctggggggatggggttccgtgggaggatgggctcagcaacaggcttggctgcttaatgatgcctgggacctagtgggtgttggaggggggcttctccaaagtagagaacgcgagaaggacacacacaggggctcagagaagtgcaggggacccagctctttccaggctgttggccctaccagcagagaacctttccctcgattctttttccattaaacaaatagttgttaaagggacggaactgccataaagtccacgcctgttcctctctccactctgtgcccatctgtccttatcttcagtggggcaggccatgaccacccaggcacccagtgctgtcattagccttcgcctgggcagctggccctgggttgtggagttccccacaacccccagcatgagcctggaaggcagggtgggggtggggtagtagtaagggaggaactggagaggagcagggagcggctctgagttgagcaaggagctatcgggggtctgagcagtggacgaagctcccgctcccatgtgggtgggggagactcagccttggcacattccccctcgcagtctgtgggcatctttggagacttcaggaggacagcagttctgggagggctatggcagaggaaaggggctcccatgggggtaggttgaggtgagtgtgggctatggggtcccgcaaagccgggggagggcaggctgcagagcaaggtgccgaggctgcctaagaattgagggtccttggaagccccagtgcttgggggcatctcggcttatcaagattggtctatcccagctcagcctctgtcttgtccagggccactaagatgataggaccctcactgagaccaggtttccagtgtcacagtctccttatgtggagagttttacccaggcagcatgatcgttctgaaatcatacctgaccattaccgtccctgctcaaatccctcccagggcaccccctgccctcaggctcaagcccagctccatagggccctggcccctgtctagccttgctctcggctgtccagtcacaccaacctccttgtggccatacctttcagcaggcacacaatcttctcgcctccaagccttcacaattgcaattccctggacatcctttcctgtctgcctcgataacctctgcctgtcctttaggactcaactcaggtgtctccctctacaggaagccttctctgactccatcacaccctgcacctgagtgggctggggcctgctcttcctgcctttggcagagctctcatctcccgactgaagcgtgggtctgtacgttgatctctgcgtgttcttggcctcctcaagtgaggcatatgtctgacccctctgctcatctcagccctcagcactgaacctgacccagaaggacccagtgaaatgagagactttaagtagaatgctccccgaggtttttcatctagaacacttattcttgctctgccatggagaatggattgaagagacccagctaggaggctagaggcttggggagaggctgcttcagggttcagggaaaaggtgtctccatgtgagctgggcagtggcttgggcatagagagcagaggacagttgtgagagacaactgggaggtgactcactgatcggatgggggaggtgaggaaagaaggcaggtttttggacaagccgtgaaggacctggtggatggttgtgctgctttgttgtgaggtggagggagtggagataataattcagatggtatgggggtccctgggccacctcagggacgtggtggggaggctccaggtggcctttgggtatctggggtctggagctcatgagtgagggctggagagtcatgaggccgtgagcacagaggaggggttttgtgcaaaagagaagaaaggctgaggacagattccttcatcagggtcctgggaaagagaggccaagcagctccagtccaggggtgggaggggaaatagttgggagtcggcaggatgaggctgcagtgcgcactgaccagcaacgcaaggaccagtgccaccttgtggcctccggttaaccagattgtctgaggccaaggagctgggcagggtttggccaggggtcaccccctgcctccgtgaagcctcagccttcatcagtttaatcatcaggaaacgtggctcccgttgccctcctgccaccctacgtccctctccttcccggggtgactggcaatgtggacagccgggaactggagcccagcacttcaggaaccttaaaggtcctgggtgtaggggctggaaggtgggagacaccaccggttcctgtagatcctggattacttaaagtggccaggaaggaatgggtttggttcagaatgctgcgtgagcttgaacgagatgctcaacctctttggtcctcgatttgtctagagtctctgacctagtgatctcgtgacttgcaggccaccccctccttttcctcatgtgacctttgctgggcttcccttagtgaccctgtatgcacacagttccccaagtttctcttctgtccaggccaggcagttcctacaagcacaattaagtggaggcagcatgagggatgaagaacccaggacaattaatcatcaaggagtgacatttggtgcaaactcaggtgcttaattaagcgggatgagccagaggctggggggtagaggaggtgggttgtgtggtgggacagagagaaactcattcttcccataccaacctcccctgccttggttcccaccacccctctgccactgtcataccctgccactcacacctgccccctgttcaaagctcacacctccacaggtatttgggaaggttccagcatagtggttagacctagccctggtgccacctacctgggttcaaatcctggctctaccgcttattcactgtgtaaccctgggcaagtgaattagcctcttggtgccatagcttctccatctgaaaatgaagatatctaattcatagaattgctgggaattctgagttcatctatgtgagttgcttgggctgtgcacgggacataggaaatggccaataaactttagttatgatgattacctcctgtgcttagcactaaaagctgatcaacaattgttttctgaggatggtgacagggagggttcttctctctccaccctagttctccttgggaagatcagagaggtcaggtcatgtgcctaaggtcagattgtagcaggcagcctagctttgagcccctgcattcacttcctctgctctcccactgcctggaagatctgcactgggccccacccgagcctttaccagcaaggggcaccagaggccaaactgtggctgcctgtttctccacatagggtccagggtcccctacttttttacttgtgctgtcatcgtgtccaacctgaggcaggtcagcttgcccagatccttgcacatgtgcagggtccaaactgtcctgtgttcccaggccaggcctcgttcctccctgagtcgggggctctcaaggtggcatcatgtcctcttttcagggaggctatcatctcccagaagcggctgggctgcaatgggctgggcttctcagacctgccagggaagcccttggccaggctggtggctccactggctcctgatacccaaggtaagggctaggggctgggcaggggcaggggcagggagggactgtggcccctgcactccaggtcatgtgtgtcttctattcctcttcatctctgtctccttctttctcttgctctgtgtctctagcagtccctccatctaattctctctctattgtactactaaattctctgagcctcaacttcctgactataaaatgggacaatagtatttaccttgagggggtgtttcaaggaggtgcaagtgagatcatgcatgttaggggcctggcacaagcgagggctcagtggcccgtggctgtggttgtgatgtgcctgtgcctgatgctggatggggctgtagttgctctcacattctctctgtcactgtcattggccctatttctctttttcttctcctccatgcctcctgtccgccatgtccctctctgcctcgtgtctcagtctctctaggtctctgtcctctgtctcgatgtggaaagtgcacaagactgggagtcaggagacctgacttgctgtgtgatcttgggcaagtcacttcccctttctagacctcagtttcccaatctgtaaaatagaggtgctcagcctcacctgccttcctccctgcaaccctgggaggatcacaagaaggttgtgagtgaaggggtttccttccatgcagaggctgttgctgtggttgtttttgttgctgcctcaggacccgcctctgtgtttctgtgggttttggggtctctgtgtgtctctgtcctggcctctctttgtctgcatctttgtctcccccacctgggtcccggctcggtatctttgagcctcgccagccctgcaggagcacctcattgccctctccccctcagtgctggtcatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctcccacaccccagccttctgccccacctcgaataggtaggatgaagccattggcccagtcagcagctttctgaggggtgtgcaagcccctgctggactctcagcccccataaggttagaaggcccagcctttggcgtacgcagcactaaccttggtttctctttgggatcctccagatggggtggggataatgtccaggagggcatgaaccaagtgaggtgtgaagagagatgctgcggagggacagatggacataagggcctgaccaatagagatagtgtggaaaactagccagagatttggagtggctggagctgggggccttgaggagagaaaggccatggtcaggccagccagacccagggctgaggctgggcggaagacaggcagctaggggggctttctggagtggctgaggaaggagtgttagtgggaagtggtggatgctctgccagagccccagaacccagacaagcctccctctgcagcccctcgaggagttcccagggtttctgctccgtggaggggattgtggaagtgcagagcctgtggggacgggattctgccgctctttccgtttcttctcctgtatggaggtgggggttcaaactcgttctatcctagtaaccaaaggatgagttccccaaattgctattattgggggtctgcttctgtcgagggggctgccattccagtaaagggcaggcttgggggcatggacagataaatgagcaggtgttggttccccggggactcctctccagctcattaaaatggaattaaacgcttcccaggcgcctgacctttctgagctgctggcaggagagggcagtgggagtcagggatggctgagaggggaggagaggggggaggggaggaggggtacttggctgggtctcctctgcacccatcttcctgactgagggagccaaggccgctgcttggtttctccgcaagctgctccccccacccccggtttctggaacggagctgctgttgcacggagttctcagggggtcgcctccccctattctttgctcttggtctgccccagggctggtcagctttgaggggcactgaggtgaggggctgtgtgcagaggtggggattgggaggtggtggctgggtcacgcacctccttctctgctgagggcaaagggcctggggtgccaggtgcctgagaaggacttccttagattgaggctatgaggactgggtcaggagggaagtaaggggaagacatttggaaggttgcttcccttgtgggcggaatgcttgccatggccgctgctcaccttggctcaggctgggccagaggccaatgtgtgtgtgtgtgtgtgtgtgtgtgtgtctcagggacgctggtgggatcagatcacttacacttaactcacccagtagaactctggtctggtcctgcggcaggctgggtgctggagccgactctgccttcagggagctctcagtctgggggaaggcagggacaccctccccaccacaggccagatgaaatactgttgccagcaggtgttctggtggcaaagcctggagcagcaagtggtacctcatcacagagaaagcatttgtgtggggccttggggcacaggtaggaggtccacaggcagggaagaagggaaaggggattctaggcagaggaggaatgtgagcaaggcaggaaggaggccgggggaaggggtggtgtgctgaggggagagtgtggtcctggggaagctgaagtaggggtgcatgctgttgagcaggatgctagccagctgggctctggctgccaggagttttcaacaaccgtcccttcacctcctcaaataccctgggcagggaagaactcttgaaaggtgtttagattattcacatctgcctctcctctaagcctgcaccttcccactcatgtgtaaatgcacttccctaggatgccccctccccaaggcatacatgtctgacagatgcaccctggctcacaggatctcactgcctcccagaggtagcacaggcagccccagacttcccagctgctgccagatcctgagggcagagggtgcagaaggaagatggagagccacagggtcggttgatcttttgggaaggccgagtcaccagctccttcctggacaagccccattcccctctctcagtctctgctcttagtattcatccactgatccacctacccatccaccccctcatccatcagttgaacaactatttcttgagtacccactgtatgtcaggcatggagtgctaggtgctgggaacacagaagtgaccaagacagattagacaggccctgccttcacagaccatatggtctggagggttggtggtgagaagcactaaagtgagcataaccccagctacttgggagtattccttgagctcaggagtttgaatctggcctggagaatagagtgcgactccatctctaaagacaataaaaataacaaaaatactgcaaaacaagtgagcaaaataaggataggatcacacgtgatggcaagtgctagcaaggaaacccctcgagggagtcctgcaaaggaatgctggggtccagtggcgacgccatcagcgagggctctctgaggaatatgctggccaggtgcagggctgtgtggctgacttctgggcctttacagctcactgctcaaagcaccttgattgcaaattttttgtgtggaaagtctttggctctgttccttaatcctgggataataagtccctttgaggagtggcagcccttggtctctggcatttgatgcctgatttgtgcccactcttcccccagctgcaccagccacaccagctccctgcacggggatggggtgttcatgccattaaccattttgaacttggttagggtggggacctgggggctgtgctgggttttaaccctctcttacagccacagtgcccaatgttgagtgttcccactgggtcccagacacttgccctgattagcaagagcaggtgtaagtgtgtgttcctgttggcgaacaaaaagccatgagtgtgtgggggtgattgtgtgtgtttgtgtatgggggcgccaggtgcatgtgcatggcttttgggtaagtgaactatttcctgtgtacaggcatgaatgtgcctgtggggatgctgtggacactgtaagggtgggtgtgtggatgtctttgtgtctgtgactgcaccgtgtgtgtgtgtgtgtgtgtgtgtgtaccacctccatgggagattgagtgtaagtgcatgtgtgtgagggcctgacgttcttcatgagagtgtaggtgtgtgtgtttgtgcacatgctgggtgcaagtaggccaaggcagcccgagaactggttgcccccacagccttagaggggtcccagccttctctattcttgagagatgggaccaggtggaaggaacaagaaccacgtcctcctccatgtgctaacagtaaaatgccaacatatttatataagccatatgcaaatgaaccatagccccagcttctcctccctcccgcccccgctgtcctgtaggagtcacagattgagcctcatccagagcttaagtttaaacaccatccttgacagcccaggtctcttccaggtcttcctgcctccaatctccctccctcaaattcaccctacaccccacagacagtggccctcagatgctaaagtctgccatggctccccagtactctcaggctaaagtctaacttcttagcctggcactcaaggcccttccttctgtggtaccatggaccacacccctacctggatcctcatctccccgcaccacctaccgccagtgtcctggtctcttcaaggtctacttgtcctccccatgccaattcaggaagccttccaaatgtcctcccctctgagctacccacctagttttctctctccttcctcaggtatgaggctccacacctcctcccagtcatgtctccccactcgtcccaccccagacagactgtgagcttcccgagaacctgctggtctcctcctccccatctgctcctggcaggagacccagagctgaggcaggcattggctgctgactggggagggaggaggaaggaggagcccccagtgcaggcgctgtggggagctctgcaggtggtgagcagctttgagtaagctccggaagctagtgacgcaggtggggagccttgctggcagggcctgtagtgggtccctaggctgccaccctccctccccaccgtctctcattttcctcgacaagcacccaagtaggagtgggggaagggacttcacagagtatgaaagatgggctgagttccctggtgactggcacagggagcttggagagggacaggatgatgggggtggtggagagagtggatctagaggggggaaggtgtgggcagagaacgggagggagtgggtggtgctgtcttcactctgccactttctgctatgtgattttgggcaagtcactccacttttctggccatggcttgcctgccaggtggaggcttgcatcacagtggtgagaatcacatgtaaggcaaagcacttcacgaacccatttatccatttattcattcacccgtccatcctcaccatggcaggtgcatcatactgagcccattcctttatccaagacttaggggcagctcaaaccctaactcagacaggatagagccgggaggctgaggctaataccaccaattctaaaatcaggacctgcagcgctccataatctgtgagctaaaaaggggtctaaggtccctccatcccctgaaccatacacccggactgtgctcttgatgagacagtgattgaaaaggcagagacaaaaaagtttcacgtccttaggttagtcctaggagacttcctacaggagggattttcctggagctgtctgagtggtcagaaagatggggttatcactgaggcccacagactggagtgtgtatgtgttggtggggaccagtgtgtgctgcgcatggggagggcactctggcagagacagacactgagagaggtcacagctagttcccttctcccatccctccaggtgcactgtggccagctgagtgataatgaggaatggagcctgcaggcggtggagaagcatgtgagtgggagtggggccatgtgcaatgaggctgaagacccttatcacagctggtgggaagatggcctggccagggagctggacagacctgggtttcagcttcggctttgctgcttttgagctgtgtgaccttgagcaagtcactaaacctctctgggcctcagtttcacacctgaaaatggggataatgatagcaccgactgacctagggcagtggtgaaacaaaactggtcaaatatcttgtaaatacacacggttgccaacttacaattttcgactttttgatggatttatggggaagcaaccctatcctaagtccaggagcatctgtacttagaaagaaccctccacataatgatactgaggctctttcatgcctgagactttatgattttgtgactttaacaaggacttacgacttcctgagggggctggagacagaaatctgacatcttgtcttggaagaatctaggggctagggatggagatagaccctgtaccctcctgttcctggaccgccggacgctccaggggctgtgggagcccccgggggagccctcaggaaggtagagtccagggatgaggtgtttgggacggcggcggggtccctgggcccggcaggcagagggaacggcgggagcaaaggcaggaatcccgctgcagcaagcgcagcgagcttggggcgagcggcgcgctaaccgctcggcctgccccagaccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggtgagggcccggcctggacaggtcacgagggcggggccgggcagaacttggaggggaggtgggcgggttaggcgatcccgggagccggcggcgggcccggcgcggagctgagcggcgcctgagggacccggacacggaggtgcggaggggccctctctctgaccggcgcctggcccttgcaggggaactctacgacctggatgcctcttccctgcagctcaaagtgctccaatacgtgagtccctgcgcccctgccggccacctccccgtcctgtctccctccggggaccaacttccccttgagccctccatctcagttccaattacgatgtccttccttcctctctcctccacccgcctgaagagccccggagaggggagcaggtggggagtggggtgacccggatccgcggtcaccccctcgccctgcctgtccctctctcagctgcagcaggagacccgggcatcccgctgctgcctcctgctggtgtcggaggacaatctccagctttcttgcaaggtgagggcccaggtccactgtagagcgggggcggggctgggcgaggaactcgggtctccgagggggaaatccattgcctttcctttaaccagccccctgcactccgttcctcaggtcatcggagacaaagtgctcggggaagaggtcagctttcccgtgagtcccgcgtctgtcttctcgttggagtctgcaggggcggttgaggccgggtagacactcctgggatctgcctggagtatttggatcttctagactcttggaatccgatggaattatctggatcttgggactacttagaaatgctgcagggatcacaacctgtgatcagcaggctctattaggaagaatctcttagcatctacagaaaggcttacctgggacctgttcacttctgttggagtatttctggatatggatctgctagaatctgttgacgagaatccttggagtctgcttatctctctcgtagttagggaagactctagagtcctttatagcgaattctgccagactcccctccatctctgctcatcaatgctgaccctgtccaccatttggactgactgaagggttctttgaaacttccagatttgagggtggggacaggttgagatcccctgacctggggagtactgggccctgactcagtctctcctcaccccctagttgacaggatgcctgggccaggtggtggaagacaagaagtccatccagctgaaggacctcacctccgtaagtcatggcctggctgacccagaggggaaagaggagaccccactgccagcccctagagccagggtctctgttacagagcagcctaggaatggggcagataagacctggggactttctactgtcccatctccatgacacagagcttccagccttgcatgagtcccttagaactgcctgttgcaaaatgtgatggagggctggaggagggaagcatactgcgccctgcttccctgccctgacttgcctcgcctttgcaggaggatgtacaacagctgcagagcatgttgggctgtgagctgcaggccatgctctgtgtccctgtcatcagccgggccactgaccaggtggtggccttggcctgcgccttcaacaagctagaaggagacttgtgagtctttgtgggatgatgcagatcaggagatgtcactgagaggctggctagggctccacgagggtaacaatgtgggatgggtactgggcaggggctactgtctcagcagcagtgggttgaacagtgtgttagtgcaagagaatgaaagtcatgttgaggtccaagctagttcctcttctcttctcctgcttcctgaagtttgggtaatctgctcttggggtattgggttccctcccttgccatccctgtttttgcattactgctataaactgctagatggaggggtgggtgtgctctgggttggatgaaccctctgggacccacaaagcatcatcaacacagtggacagtggctaaagggaatatgcttggggactgggaaaagctgtggatcttttgagcccctgacagggcagctataaaaatgatacacaaaaatctctttttttgtgggcagggcacagtggacaggaaagcaggcttggaggcttagttggaaaggatatctcgagaactgaggacaaacctggggtctagaaatggtgtcataaataaatttcatatcctacaccaactcataaacaggcagtaggtgcctgaattttattgcaaatggatcttagttcagggagaaacagtgctgcgtctgatgagccatttctgtcctgggtgcaggttcacacttgggctggcaggatgagcagtttgtgctgtgtcacataggtggggagaagtagacagatgaggggctgagtcctgatgcaaagagatgctgataggatgctggtctctggagtccaagcaaacaggctgggtttcagggcctggagctcctgcaggaggtggacactagagagcctgggactaggtaggtgtcagagcccgggcctgaggtctgctggggtagggtggagatccaggagtcctaggtctgagctgcagaacctaccagcatggaactgtgttgacagttgggtgggcctggagaaacaaagataggggcaaggcagaatcagctgaggcagggagaatgtgggattggtggcatttggaacttgtgggcatcctaatggtgggagaatttatgccattcagcaaacaaatattgagcacttaatgttgccatcccagtgctgaccagatggccttgggaaggcctttggggaagggaaggtagagtgaatgggggtccagcaggggccatgacttcttgctgctggctgtgagattgggttctaggatggccccagagctggagaagaggtggtatcagcaggaaataaggatggggccttggtggcagctttgaggcccagggcaggggcagggctatctctgggtcccacgcatttcagggagtgagtgttgaatgactgcatgagccagggtggggctcagctcagtgcagtgactacagagaagcttcctgaaacacagctaagtagccagagaacaggggctccagaagcccttcagctgtgagtgggatggggctggtggcaaggccagggataggatacactgacgacattagcaaagacctccgaagtgtttcctctgtaccaggctctgcactgggcatgggtgatatagtcatggccccatttcataagactcaaagctcattttcagggcatagagggaagagagtgagaagggtattctaggccgagggaacagtgtagaaaaaaaagcatgaaggtgtgaaagagcccaaggttttctcagaatgatgaggatctttgtgtggctgaagctgagagatgttctgggttgaggggtgacaggtgggtggggctagctgagggaccacaaatgtaagaaaggtgtgcagacagacccaggatggtggggatgggatctagatccgaatcactggatggcaagcatgaatgggggatgccccaccagggtggagcaccaaggccagccaaaaagtggggaagggcttaggcagggacacctcagggcagcgtgatgtgggctaaggcaggctcttcccatgacccacaccattggtccacccagccccatgcagctccccagtgacaaatcatttggtggccagattgaatgacgtgagcaggatttggggcttatcttgtctcaccagagctagctccatgagcagggcaagcagtcctctccacaccaccaccctaagatttctggaggcaccgaatcagggccagcggagtccagggagagtggggtagtgacaggagctgcacaagatagggcagtgccaccgcccctccccaaggctggaggtgtgcctggggaagagcagaacaccagcttgagcccaggcaatctctagtctgagggaggagacccagctttgggctgggtaaatcccaaatcagagacgggaggtatggctctggtttcaagcatctaaggaggactggagccctccccttgggcagcccccagtctgcagggtcatgggggtgggaagctgttccaagggcctgtgcagtggttatatagttggcaggtgggtacccctgtgggcttctgatggaacagaagtaaggagagtggggagagaagccagtcttcccttccctcctgagtgagcccaccccctcctccaggttcaccgacgaggacgagcatgtgatccagcactgcttccactacaccagcaccgtgctcaccagcaccctggccttccagaaggaacagaaactcaagtgtgagtgccaggtgagtgacctgccttcagcctctctcgggcaccgactcgctcagttttcagccccgagagccattcagaagggaaatgcccatgtctttctggactggtggcagcccttccccaggtggctccataacctcataacttgaaggcttgcagttgttcaggacccgcgccactgcccgcaggcactgtatgtgatcgccctctagtgttcaatatgtgcactacagcaacacctaggcagctagagctggcgtgaaggcggctgagacactcaggagactcctcacctgcaccggggctattccctcactccttcacttagtagccaaatgatataattagacactgacagtttctggcttgtccagtgagccctagggaaggaaggagaagacccgggtgctgttggaggcagaaggttggatagggtgacccctacaccccgacccccctatgatctccatttccttcattccaggctcttctccaagtggcaaagaacctcttcacccacctgggtgagtgcactgttctctctgcctggctgtgtgtgggcatgggggctggcatttgcagaggagaggcgggaggtcttggcagcctggtctcaccctgcctggtcttctcccttccccagatgacgtctctgtcctgctccaggagatcatcacggaggccagaaacctcagcaacgcagagatgtgagtgactctacccaggggacagggcgagagaggctgtggccttcagtccccatcatctcctttcctgccccacccacttccctttctctgccttctgcgggacttcatcaccttttgagggatcctttatttcatgcctgtctccctcgctagactgtaggctccaatacagcagggacagggctggctttggatcctcagctcctatcacagtgcctggcacatagtaggtgcttccaaaaaaaaaaaaaacaaaacacttgaatggacacgtttctggagccagccagccctgagcagagtgtcttaccttggagcactcctcccaggcctcggaaatccggcctttgcctccttatgggacgtgagggcgatcagagggggttgtcaggccccagaggaccaaacccctccctccacagctgctctgtgttcctgctggatcagaatgagctggtggccaaggtgttcgacgggggcgtggtggatgatgaggtgagagggcgtggagggagtatgtggccctaggggtgtccgggagtccgccggcggcgctggggagcggcccgaggtttaacagtcccctctgtggccgggtcactaacttcttcctctcgactccatctctgctccggcagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccagggtgcgcgtggcggcccgggcggaggggcggggcctgcgccgggcggggcgggtccgagcgagcgggggtggcaacacttccccaccgcctccggcgtcccggagcataagggagtcgggttccatgcctgggacgtacgtaacctgcggaaactgcgagggcaggtcccggccggatccctccctccaaccgatccctccctccaccggtggttccttgcccctctcccttccccagaggtcatcggtgtggccgagctggtgaacaagatcaatgggccatggttcagcaagttcgacgaggacctggcgacggccttctccatctactgcggcatcagcatcgcccatgtgagggcggggttgggagtggggtgtggggtgatagggggcggggcccacgaaggaccctcggttctcctcctccgactgactctccttgtggattgatcccttggtctggcactcagagtcccgccgctggggtgcagccttcaggacacgctggccacctctgggctcagtttcccatctaaaaattgggcatacgatttcctgccctgtccactcagcctcctgggaccatgagaaactcccgttgtcaaaacctcctctcttccctggaagcagtctcaacccaagccgagtgcttttttggaagtgctgggtctcggtgtccaggcctactggcgctctggcctgggaatccagccccaaggtccctgacatgatcccctccttgcttctccttccctgccatgggccttgggctccatcactgaagcctggatcaggtgtgggggagtgcaaagggccagaccaaatgctgggagaacttgatgaggaggaaccggcgcgggggtctggatgaaagtgggggtgaggtctttactgtggactggagcttgaaggttttgactggggccagaatgggacaggaagtggggtgtctttttgaccccttcatcccagtcctgggcattgctaaattttcacagccaccttccttgagccccatctttccctctttcccctagtctctcctatacaaaaaagtgaatgaggctcagtatcgcagccacctggccaatgagatgatgatgtaccacatgaaggtgaggcttgcagagacctctggtcctcctcccagattccccggggacccagggccaggcagggcttcctgatcaatctctactgaggatgagaggataggcccagagccacagcaggcctcctgccctccttaggggcagctcccacccctgcttagagacctctcctccaagctgcttctgagctcagtcccaaggctggaagtagccagaggaaccagcccagggagtaattggttcagccaggtattccccatgttcagggaataattcccatcttgggaattactgagggctaggaagctcacccaggacccgtccccatggcttccctaggtacaatgcccatgcagccctgggcagtcttaattgctgataatctatcccattccctaccctgggtcacaaaagctggcttagttccatgtatatggtagtcgctgttcatttggacatttcctctcacctgtgtccaaaccagagaggcccagaccttgtgagttggatcaaaactgtagtaggaagagttaaggttagagagtagaaaggtctccacaaaaggaggactgctacagttactgtgtatgaaatgctgccatggtttgggggtgtcatgaaggggtgttgtcgatctttgccaaggttatgctgttacagataaagggtggtcacctgcaggaaggcgcgcggggtgggctgcagggctgtgaggggagggtggtgatttcctgcccagttacagtccacagcgtggtggcccaactgtggtacattctgggtgacggatcccccacctgccatgggaatttgagggtgaagacaccagatggggtgaaggctgtcttctaatgctctggctggtctcctctaggtctccgacgatgagtataccaaacttctccatgatgggatccagcctgtggctgccattgactccaattttgcaagtttcacctatacccctcgttccctgcccgaggatgacacgtccatggtgagttgctctcctccacttgactggccaggccgaaggtatgtagccagaggcttaagttaaatgcgcatcaagaacttcctgggaagacagagtcatcaaggaaggctgtggagggtccctcagagatggaggggcttgtagtctgccatcaggaagccatggggcctgcccaggggctagaggctggactggatgatcccaagggctgctcttggaccaaccatgcccagggcatgtgacctcagggtttgcatccctcccaaccctgtttttctaacattttgtgtgggcttggtttcaagagttcttagttcttagatctctaaaaatgcatagctccgagaacggttgcttcaactattttgtggttctctagtttagatgtaagtttctaagactccagatcttgagtgtggagcttgaagaaggacccaggcaagggccctgtcttgatactggcagcccctctgatacctccctctgccctctccaggccatcctgagcatgctgcaggacatgaatttcatcaacaactacaaaattgactgcccgaccctggcccggttcgtgcgcccacagacagccccagtcttcgcctccctctttcctctactgtcacatccattgcccccggcattctggagaggatctctctaaggatgactggggagacccagtcttatgggggtggggaggatccatgaatgagaagcaattcctagacactgaactgtcaataaaggcaagaaatgaggcaaggcaaagcctggaggcaaggccgagagtgtgtagccagaggtttaagttagatgtgcataggaacttcctgctaagacagagtcatcaaggaaggctgtggagggtccctcagggatggaggggacatgtagtttgccatcatggggccgtgatggaggaggagaggctgaggcccctcttctgccctcttccctcccccaggttctgtttgatggtgaagaagggctaccgggatcccccctaccacaactggatgcacgccttttctgtctcccacttctgctacctgctctacaagaacctggagctcaccaactacctcgagtgagtggctgcatctcccccacatctggcagccactggggtccccttccctgggacagggaagcaccccctgtgtgtcaggcactttacacgcactgcctcatgggatcttcttagccccaggggactagaggggaaggctgtgagccccatcttccaggaggggcttgctcacagccaagcagctagtgaagactgagcctgatttaaacccgggtctgctggactccaaaccagtgcttctttccaggaagggaacccaggtgttccaacctcctgtcccagtggctcctgggcatgtcatctcctgtctgtcctcttggggatttagggagggaactgtgggctgacctcttttttttctcctttctgcctctcaaccagggacatcgagatctttgccttgtttatttcctgcatgtgtcatgacctggaccacagaggcacaaacaactctttccaggtggcctcggtgagaccctgccctgctcacagtggggaccctccatggggtgtcttggagtctcatcctctcccagcctgaagatgggtgggagcgagtgagaccaggagccaggtttagacacaggaggaggttcccccagggtttgcccctggctctgagatagggaggaggggagaaaggtggaagggcaggacactgctcagcctaaagcagtggcacttggatccggatgtgaggagtgaccacagttttcctgggcttttccagaaatctgtgctggctgcgctctacagctctgagggctccgtcatggaggtatcactcttctgtcccaccccgtccttcttcccctttaaggccagtgacttgcaaagttatgacccagctcctcctattcccaaaccatgctctccagacaggctgcgagagctgcagccacacctaggacatgtctggctcattttcctggagtgggcttggaagggtgcaggtgcggatgatagcaaggatttgtgttcagcgtgtttccctttggctgcctgggaacaccccattcagccccctcctgccaaacttgggatgggctccactcccatcacttagcgtcaccttagattgtttggtttgggtctgcctacctcctcgtgcacaaggtctgagccatttctgagttccctgcacttggcacagggcttggcacagagtaggagacacatttccaaggtcaccttgcctcatgctacttcccacaacacctctccagaggctgcccctgcttgcacacccccagagacgaggttctctgtctctctcccaggaggcctggtggcagtgctggttctgccctctgcccccctgagataagctgctccttttctgagtgacagcccttcagcatccggaaatgggggccttgcccttgcctcatcactgcctctccttgtcagcaaacaaatgtgttctgcatgatttggtgtctaggactccaaaggatcatttcaaaaatgttccagctttcagggaccccagagcttaccttgttgggtccctgcatgtgacagctgaggagtctgaggctcagagtggtctagggactcaccctgggtcacacagagggttgaaacagagctcagaaagggaactggggcccctgactccccctttctgactgctctgctgacctgggggctggagctggacgaggcccctgcttcctctcttggggtcaatggtaagggagcccatctgccccagctgggcccccatcactcctctccccccagaggcaccactttgctcaggccatcgccatcctcaacacccacggctgcaacatctttgatcatttctcccggaaggtgatggggttgggggtggggtggggattgagggggagctgggagctggctggaggtgggataaggagccaaggagtggaggctcactgggatgggcaaatgggtgggggtgtccagtaggagggcatgacacccctgccctcgcctcaggactatcagcgcatgctggatctgatgcgggacatcatcttggccacagacctggcccaccatctccgcatcttcaaggacctccagaagatggctgagggtgactgctgttagccccagtccttggggctggggaggaacaaccaggggaaggatttgccaggggagcattcccagggtgcagacccatcccctgcaacatcaacccttctctggctgcacggccccccccaggcagacccagcactggccccttggctcccatcaagggtgcccaattccctggaccgctctgggttgggccctgggagccttgtcctcagaagggcaaagaggctgggccccgctccttgaccccatcctcccctcaacagtgggctacgaccgaaacaacaagcagcaccacagacttctcctctgcctcctcatgacctcctgtgacctctctgaccagaccaagggctggaagactacgagaaagatcgcggtaggtgtagtcctccctgggaaggcacaggctgcccaccctgcccagctttgggtgccccctgtgcctgaataccctctctctgctcagctcagcctggctgtgttctggggagacagaaacctagaccatctcagggtgacaaatggagactcagagaggggaacagacctagcaagtcagtggctggtggaaggtgggccccaacccagccactccctgcctcaggccatcccactgccaagctggggctggtggggacggctcctgagctgggactgaatccctgggcctcagttttctctcctgggaacgggctgtcagaggagcttgggtggatgtatcctacatagaggatgtgatgagagtgttggcctttcaggagctgatctacaaagaattcttctcccagggagacctggtatgtgtggagtgaccccaggatgtccaggatgggggagggttcctggcctgggacagggagggcttgaactagcctgaccctggtacccgatggaggaatgagagggacaggcctgacgactcgatgcctgcaggagaaggccatgggcaacaggccgatggagatgatggaccgggagaaggcctatatccctgagctgcaaatcagcttcatggagcacattgcaatgcccatctacaagtgagtgagctcatggggacaagctgcaccctgcacagagagggtaggctggagtggggacatcacaggaaacacaggtgctgagattggcctggcccagctccaactgattcatccccttgcctctgggcataactgtctcccgctgtgcccctcagtgggtccttcacttcatccttggtcctcagtggaaagagaccatcatgctttcctaggtgtcctcctctgtctcacattcttgtggaagttcttgttttttttgagatggagtctcactctgttgcccaggctggagtgcaatggcacgatcttggctcactgcaacctccccctcctgggttcaagcgattctcctgcctcagcctcccaagtagctgggattacaggcatgcaccaccacgcccagctaattttgtatttttagtagagatggggcttcaccattttggtcaggctggtcttgaactcctgacttcaggtgatccacacacctcggcatctctgagtgttgggattacaggcgtgagctaccgtacctggcccttgtggaaattctatttgttgtgtagccctagtctttcttgctgcccatggtctgatttctggcctctcaccctctgcccccatgcacccgcaggctgttgcaggacctgttccccaaagcggcagagctgtatgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttctctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctaccagtcctcccccatggggctgtttgcagactttgtgcttggggtgggtggagggggggaatagaactgggagaggcaaacgccctttggaactccatggcttccagggtcctccacccttggtgcctagccccccttctggggaagtcatagacctgttggggtactccctaggccagatcgtggaggctaaggggtgggtggcagatgagaaggcctggccatggagcagtgatgggacatgttggctggcagagattgtagaatagaggaaaaacaaaggttgaggcaagcaggcaggctgcctggaggaggtagcctggagcttgtcctagaccctcccagcgctggcctgccctggtcatgagtgcccatacggcgagggcctaggcctctgaactctgtttctagctgcagtgatgcctggctgtgtcccaggaagtcccacatcccagttactctgagtcctgccgaaggtgcacgcctgagtcagactccacaccagatccagccccgggttgtgtctgaggagttgcgtctgttcctctgcatgagagtgtttacttccgcccagtccaagatgggcagactgcaggttggggctacgcggaggctctgcctggcacagtctccagaccctgtccccgacttgcctacccccctctgagctcctctccgtgttcatctcttcctggtcagtaaaggttgatgtgttaagagggtgggcactggggtctcctttcttggtgggagcaggaaggagatggacagggccatcctgtgaccatcagccattgccagctttgcctttgggaccacagagcccatctgcttcctctgcagctccccctgccccactagcctgtctgggtttggaatctgctcctctggctgaatggtctccaggtttccagcttcccttagcgtcatggggctccaggctcctcccattcccagctcctgctgtgggctccccaagtccgtctctatcctctcacagcacaggacccaggcttggccagtgggtccccgggtgggggtgggagtggtcagtttgtggcccacggccaataagagatggctattctaatggtgcctggctgaccccagggtcactgtgggctgatgtagctgctcttctgcctgacccctgaccctgagtgtgtgtgcgtgttcctcttccacaactcttcaggcaaagagaaccttgaccctgcatctgtctgtccccagcccagccctcctttgaggctcatgctgtgacacatccctgtttttcaccaaatggagggaacaaccacagatatttccttgtgcacgcaggaccctgtgctagggctgagggctttgtctttgtcctgctctggaaagtctcacagtttgattggagagctagatctaaactcagatgcaggccatgacaacgctgtggggtgcccggccatggggctccaggcaggatcataaccctgagaacaacaatgaggtttgaaagatgagcagatgttgtttataggcaaaaggggacaggcactcctggtagaagaaactgcttttgcaaaggcctcgagaacagaagggactggcaggtggaggagccgagagatggaggaggaggcaaggccagatcctgaagggccttaaatgccaggttgtggagtttggctttattctgtgggcagtggagaaccagagaaaggttttcagtaggagagtgactcagaagtgcattttagaaagatccccctggagagcagggaagtgactgcaaggggagagggtgggcagggattattctatgggtgatgtgctgtgccctgggctgggcgaggagaggaattcaggagatgctaggttggcagaacatggtgaccagtgggtcgggggatgcagagggaggacttggaggggccctgggaggtggggtctatgccactccatgaagagctgtgggggctctgttcagcatcaccctcacccacaacaggtattgggtggagcc

SEQ ID NO: 12116 - DNA, 52824 bp, Human
caaaaagaaacatgtaagaatgctcactacggctttgctaataatagtccaaaaaataacaacccaaatgcccgccaacagtggaaaagataaattgtggtataaacatacaacagaatactattcagcaattaaaaggctacacacaacatggatgaatttcacaaaaatactgataaagtaaaaaagccagacacatactgtacatactgtattattatatttaactggaattcaagaacagagaaaactgatctatggtgatacagtcagaagagtgattatctcaatatgtaaggatgtaatactgattgggagggagcactaagtgtgctagaaatgttctatatcttgatttgggtagtggcgacaggggtgtatacctatgtgaaaattgttcccatactgtatgttacacctcattaacaaaaaaaaaacttttttaacatggaaaaaaaattcaagttcaaatgccaccttgtccattaaagttttgccagctgcaatgaaccttttcatcagggcctccttagcattctgatgtcatttctttatgccattttatcacactccatcttgaatctcagtggagtctccttatttccctaaatatatgttcatcttcctggtggcagtgaccatgtccttcaccttttacccactcagtgcctgacaaataacaggctgaaaagatatttgttgaattacatggaagaaaaaattgggtgagttcccagatgggtgaaagtggggacaggcagaggaaggaaggccaagagaaggacagaggaggtttccaaggaaaccgtggctcacactgtaattttacctacttcctgaaatcacattaaatgtcaccttgagtggcaaaaaacaaaacaccaaatcctacctaggctgaaaataaataaatatcacactccctcactcgcaagaaatccaccaaataaatgctacctaattctgggtgtttcaacagtggataggaaaaccgttcaaggagaataattcacattgccatgctgctaaaaatatcacctccttagtgtggtgcaaagagtccagactgcaagtcagccgacttagggctgaattctaactctgcccgaacttgctgtgatctgtggccaatcccttcgcctctctgggcctcaatttcctcatacgtaacaacaggggatagattagcaaagtccctttatgttttgatattctgagtatacaatccatagctctcccggtgcaaaccaggaatacagcaaaaaaccctgaaatacatgtaaaaggcgcctcagaccaacaaacaagcacgatttgaagaagtcattttgttctctttcacggtttaatcagtgtttttgtttgttgtttgcagccttaccatgatttgcagatgtctgagttccatgtaaacagaagttaactctctgcgggctgtcatcttcttttgagggtgagaagggtcttcccgttgggtttcaagtctcgggattccgaaacgaccaactcagcgggcgggtttgtgaatttgcgcacactgcgcggcacactggagtctaagttacagaggaaccgagtgcaggggatgctgggatttgtagtccccgggcctctttgtggtgcgctgggatctgtggtcccccgagtgcgccgctggaatgctgggaaatgtagtctctgtcgcgtcgcacagtgcaactcagctgccgtctcagacggctagtgtgctcagtggctggagcaggtccctaaagcctctgcagatccgaagccaaccctccgctgggacaaactctaggcaacaacaccagatgaatattgtgtcctatgggacttcccggggagggcccttcccattgacgttaacagtccccctgcgaagccgctgcgcgctcctactggctggttgagatgccaatcgccaaggctggctttccattggttccaggagggcactgcgaggctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggtgcgcgcgattcatgtcagccaaggacgagcgggccagggagatcctgaggggcttcaaactgtatccgtccgggagcggggcgaggccgggaggacttgggaggcggccgctcactgaggagactggccgggggcgggggccgcgccaggtgggccccacagaagaagggccgcgggaggggagaggaaaggaacagcgtgccgagcacccggcgggacccggcgcgagaggcgccccaaggggcgtcctgagggaggaaggggacgttgacgggagcgccggggggtggcgggtggagacgggggagcctgggggacggggctgcgagaggtgccgggcgtcggaaacgctgtcggagaagccggctgggttccgatccccggccgggacccagaggccgggatggggctgcggcccgcggagaagggctgagggggcgcggtgggctgatctcgaagcctagaagcctctttggctataagcctacccggggagcggggaacagtgacttggagcgggcgaccttgtgtgggacaaataccagtgcttttaaaactctctcaggtcccccaccgcaccgcaccgcaccccacccccgtctggtttccacaacttctcttccaaacttgtggcttcttccaggactggagtagttgggggaggtggggaaagagaagtccaagatcgacctcgtcttaacactcttggccttctcaggcattggtcactgcttccccctcagcgcctcagttttctttccagcaagatgaggaccataggcttaggtgtggggtgcctcgcgctgggactcctagccgaggtgtctttgctcgctcctgtcggtgcggttatgcctagctgtggtggagctgtccagcaatggtgtgatgtcgctggggccacggtaggatagagtggggtagagaaatcattgcctcgggcctgttgtggtgccccttttgcatcctctccgtaaggaagctttgtgttttcgtggagtgtgttagtctgtcaccatatgatgcagatgaaaaaatgcaaacttggatattcaaattttccattctcctgccaactttaatctcttcatgcatcctatctgtaatctatagtacgaacgttcttaaattgctccctcagtgaaaaggtagtcaccacttcagggctcctcccttggaggtttagtaaagcactgttttcttggtattctgttgcgttttcacaatgtccatgtcacgcttgcaaatttaattgctttgctataatcagaaaccaagttggtaatacattttagaccacagtgcaaaaaggaagttttggatgtacaagtgagatttttcgaatggaaattgatctatgctttttaaaaaaactaaaggctgtatcacctttgcatactaccatctgtgataaactttcagtactttcatgttttggtttagtagcagcctcttttatagctccatgtgcctttctgtgtttctctccataatggatcaaataggtatatagggatgactgaagtgctggaaaagctatgacatggattttatttttccctcaaataatttatactattaacatctaacaatgtaataatattgctacttaacatgctttgtagacagtaaaccggaaactggagaattgagagatttcagaagcaacgttttcatctgattggaaataccgtattgctgaaaagaagaaaggcctttttaatggcttttgaacaaagcagaaaagtttgagcttctcaccttcagtcttagctcttgaacctgttgagaaagaggataagagacaaatacggaaaagagtttcagaaagcagaatctgtgtcagcccactggaaggaaaagcgaatcaaccgattcagtgatgttagtgcatccagaaacaggcttttgggaaaagcttgacctgagctgattaaatcctgaagcacaagggaagcagccacatcaaaaagttagcatgagagcagtggcgtgctcatcctctggtagcctttactgggcatttgtggagtaagagagaaaagaaaagcaggaatgttaagatatgctactaccttcaggaaaaagtaaaattaatgttttagtaagaaactgactattgtccaccttttattgggtaaatagattttctgaactttctttcagagtatctgtttctgtaagaatagtttatcactgcaaaaagagcaccattatgttctcccaccagcagtgttgatagtactcagttttccacgttgactaggtcagtcttttttatttgccagtttggataacaaatgatacattgttttaattggtattcttctggatccctagatccatgaaaaggtaatgtagcatagtggttaagagctatactggactatgtctctatactgcctgcattggaattccagccctgcgctcctagttgtgtgtccctgagcaactgctttaacctcacctcaattttcttatctgtaagatggggaaaataatagtacctatctcatggggctgtaagagtaaatgagttgatatctaaagcatttagaaaagcacctgatccacagtgagcattatgctttagccagtgttattcttgttattattagagaagttgcacatctcttctatttggccatttctttttcttctgtaaattgtttgttaattttgtttttgcccattttactattgtttatttttcttatttgtagatgttctttacatattgtaatatcaatcctttgcctattatgtattttgcaaatattttctttcaatgtattgtctccttttttgttgaacagaatttttaaattgtcatttcaaatttattttatttcatttgtttgagacggagtcttggtctgttgcccaagttggaatgcagtggcgcaatcttggctcactgcaacctccgcctcccaggttcaagcaattctcctgcctcagcctcctgagtagctgggattacaggtgcatgccaccatgcccagctaatttttgtatttttaatagagatggggtttcaccatgttggccaagctgttctcaaacacctgacctcatgatctgcctgcctctgcctcccaaagtgctgggattacaggcatgagccaccgtgcctggcctcaaatttattaatatttgccatctggcttttgcattttgtatcttgtttaaaaagatctttcttatcccaagattaactaaatatcctatcttttcttctcttttcaatgtttagctctttaatccacctggaacgtatttacacatttggtatgtggtagacatctaagtacttctgctgtttggatagccaatagttccagtactatttactaagtagttagtccatcttttcctcactgttttgaaatgccatccttgtcatatactaaattttcataagacataggtttttttttggattatttctgtttcattgatctatttgtctcttcttgtacctatacacatttgattgaattattatagctttataatatgatttagtatagtttacaatagaatggtctgtgactaacataatatgtgtgtttaaggtccctacaaatatgtgccccttttgttcacatggaagcttgcccatatgcccatagtagatagaaacatgaggacttggctgggcatggtgactcacacctgtaatcccagcactttgggaggcctaggtgggaggattgctcaaggccaggagttcaagaccaacctggccaacatagcgagacccccaactctaaaaaaaaaaaatttaaagatactgcataaaagtgaatactgtatgcataaattaggcatggtctgagtgaattcagtagaagctttgtatttgccatcagttgtttcaaaaacaaaatcttataagattttattcttgtatcaccttcaccccatctcaccctacctctttcagagtatctgtttttgtgagaagagtttatcactacaaaaagagcaccattatgatctcctgccaacagtgttgatagtactcagttttccacgttgactaggtcaatcttttttatttttgccagtttggacaacacattgtttcgatttgtattttcctggatccctagatccatacaaggtaatatagcatagtggttaagagctatactggactgtggcgctatactacctctcaagaaatgcaaggctctcatacacattaagaaccttgcatttctttcttgtttgttaaaagcataacatttcctaattgtaaattaatgttatgaatgaaatgttacttggggaacaatatgattctcctgcaaatattttggatttgattattttaagcagctgacatagagattgatgtttgtaaatcccacgtttcccatttcgttccttcaacaaaggtctgttgggtgactattatgtatagggcactctacacttgaaggatacaaaaatgaataacttacagtcccttctttccagaagcttaaccagctttatgtctgtttagaaggaatatcttcaaaagcaatgcattttttaaaattctatttaattttcctattacaaacgccagccacctagagtgacctttgtaaatattatttaatatagccttctaatgtagctaatgtttaatgtgttttttataaaaatggaattgtaaatatcactttgtaacttactttgttcacttaataatagatttaccatgtttatgatttccaaagatagttactttcagttgctttcactgacagatttgtcacagtactcttttttttttttttttttttttgagacggagtcttgctcttgtcaccccggctggagtgcagtgatgtgatctcaactcactgcaacctctacctccggagttcaagcgattctcctgcctcagcctcccaagtagctgggattacaggcacctgccaccacgcccggctaatttttgtatttttagtagagagggggtttcgccatgttggccaggctggtctcgaactcctgacctcaggcctcccaaagtgctgggattacaggcgtgagccactgcacctagcatttgtcacagtactcttatactagctttctagtatagtctgtatctactgttttgcctatttgaatagctttttcatcaacataaaaatataactttattaaattaacaagaaactgacagacttccataagaatgaattatgcttttatgatttcattatctttaatccatctgaattttctttggtataagatacagagtagtaatgtagcttttttttaatattggcttattgtctccatttatttatttaattcatttatacgtcagatattataatatccagaatataaatggctgcctacaaatcaataggataagcatttaactcaaagtggacaaaggatatgaacaagcagttcctagaagaaaaagcagatgaccaatgaataaatgaggacatgctcaaccttgttaaaataatagactatcttccgggtgcaggggctcatgcctgtaatcccagcactttgggaggccaaggtgggtggattgcttgagcctagaagtttgagaccagcctaggcaacatggcaagaccccgcctctacaaaaaaaaaaaaaaaacacacacaaaaattagccaggtgtggtggtgcatgcttgtggtcccagctactgggaggctgaggtgaggggatcacctgagcctgggaggtggaggtcgcagtgagccaagactgtgccccactgcattccaaccagggtaacagagtgagaccctgtcaataataataataatggactatctcttcccaattaattgacacagatttaaaagattgataatatatatgtatatcctgaaagtggcactgtacgaaaataaaattaaaaattaggccaggcacagtggttcacgcctgtaatcccaacactttgggagaccaaggtgggcagatcacttgaggccaagagtttgagaccagcctgcccaacatagcaaaactccctctctattaaaaatacaaaaaattagccaaacttggtggcacacgcctgtaatcccagctgctcaagaggcagaggcaggacaattgcttgaacccaggaggcagaggttgcagtgagctgagatcacaccactgcactccagcctgggctacagagtgagactctgtctcaaaaaaaataaaaataaaaatttattaaaaaaaaaaaagatgccaggcacagtggctcatgcctgtaatgccagcactttgggaggccaaggtgggcggattacttgaggtcagggattcgaggccagcctggccaacatggtgaaaccccgtctctactaaaaatacaaaaattagctgggcatggtgtggacagctgtaatcccagctattattagggtgcctgaggcagaagaatcacttgaacctgggaggccaaggttgcaatgagccgagattgcaccactgcactccagcctgggtgacagagagagactcagtctcaaaaaaaaaaaaagataatattcagtgttcacaacattgagggaaaggggcactctcatttggtttatgtgtgtgtgtgtagtgtctgtagaaagtaattggtatctatcaaatgtttacacattactgcagtagagtatatagcacagtggttgagagtatgggctcacttccaaggtttagacttactgcctctgctattgtgactctcaacagaacactcagactctgagcctcagcatctgtatctcatattatcagagggttgttttgagaattaaatgaaactgcataaaagatgtttggttcagggcctggcatatagtaatatctgctgccattcattttattaataattactaataataatgacaggccaggtatagtggttcatgcctgtaatcccagctctttgggaggccgaggtgggtggatcacctgagtttgggcattcaagaccagcctggccaacatggtgaaatcccgtctctactaaaaatacaaaattagtcaggcgtagtggtgtgcacctgtaatcccagctactcgggaggctgaggcaggagaattgcttgaacccaggaggtggaggttgcagtgagccgagatcacgccagtgcactccagcctgggtaacagagtgagactccatctcaataataataataataataatgacaatagtgttaatatgattgtaaagctacttatttctctgagatataactaatgccttcattctagttatattttcttactgaaaaactatcgtatttccattttgcctctgaataaatgattcaataagcattgatatatacctcatgtttatcttgtctagaaaatgaatctcattctaatttatggcaggttagcaaaaagagtttgggctcagaaggtttctgaaagcatctttcacttgttttcttacatttcttctcccatagtttggtcctggaatccctgtatcttctttctcatagtaccttaatccttgactttgcttccaatcaaaaaacagttggctttacatcttctatttactcacttagaataaagaataagaatagtagacatattaagaaaagtcgactgtagaacttctcttgaaagtcagtattccctggtacagttgccttggccaaatgttaaaaatgaatttgaggtttattatttcccataatataggttttgtctgacaacccaaagtcttggaaagcaaccagacataccactcataaagcccagtttcatgtagattgtgattggtagcttgtttcctcatgcatggactcttgagagtttgtattgttatcctgaatggattaaatgaatataatgtcctattgattatcttaggattctttttttcttttctgcgacagggtctcattgtcatccaggctggtgctatcatagcttactgcagccttgacctcccaggctcagatgatcctctgcctcaccctcctgagtgcctgggtgcacaggtgtgcaccactatacccagctaattttcgtattttttctttgtagagaaacggtttcactatgttgcccaggctggtcttgaacttctgggctcaagtgatttgcccaccttggcttcccaaagtgctaggattacagacgtgagccaccacgcccggccttacttaggattcttaaacaggcattcctgcttttgttttttggaaggaatttagtgtataattagatatttatagtcttctactgactttctaagtttcttgccagggttgtgtatatggtttataatgaaacattacagtaacttctggagaaatgggacagaacacggtaaaactgtcatggagaattccagttgtatcaccactacatttgataaaggactagcaatggttctgaggcttggaagctctaggttcttactagggttgacctcagttttgcctcccaggcctcacttgtcagcattctgcatccacaaatcctcgtgttatgagaggatttgacttatagacctatccctctctattcctgagctaaagcctagcatcataggaaggaattttaaggccatcttctccagcagcctgactattctaataattgcttgaatgcgtaaaactcaaattgtcaaagttctgagagcagcattcttttttgcttttgacctgcttataattttggagctgggaagaaaagcaaatatatttcttacagtccaatatccacaaagatttcaatggattggactaaagcttactgtttatggcaaagaaggcgatggtctcaccgtaggacacatgaaagcttgtttagtctactgcaaagggaggcaggggaaagtggagctggtataaaggtgggccacttgaaacatggcatacattcaataatgggggaactgaagggagtttaacctaaagatgaaaagagttggacaagagatatgagtattctcttctaaagttaaaaaaaaaaaacaactgttctaaagaggaagaattaaatgttgctgtgtagctctcagaggaagtacaagatttgcggggtagaaattacaggtgacagagtttaggccagtttctaacaattagtagaattacctgaaaaaagacattttccagaaagtgttttaagcagcagatagatgcctgtctgtcaagagtgttgcagagggaaattttgtatgtatcaaatgtgtattacagtagatgatctacagaaatactcaaatccttttccagcactacaattctttgatttggtgacagcctttcttacttaacaagtactttttttggcaaatgtttatattgagatatgttctacacctaaaatcggcaaaaagtttttttgtgacccaattgtttcctttttgtttctgacacaactctgagacactcagtattgaagtgtttggtttagtgcattgtggatacaactgattcagagtcaaggagagcaattattgcctctgaatttagataacatttagagaatgaaacataaatagctgtaatataaattagcactgtaaatatagccacaagaagaaacagcatggtctagtaatatctcataattctatactgcttttcggtttttaaagaactttgatatattactgcattatcacaacaaccctattcattgttatcctcactttatagactaaggaattgaggatcgacgaggcagtcacttagacgaaggcagaaccttaatttaagccttgttttgtctttttaaaagtccatgttttctacagtataccatgatgcctctctggagaatttattcttttgttgttgtattattaattttgagttttaaatttttctcagcttggctgagcaaggtggctcacgcctgtaatcccagcactttgggaggcctaagtgggcagatcacttgaggtcaggagttcgagaccagcctggccaacacgccaaaccccacagaagctatttgggaggctgaggcacaagaatcgcttgaacccgggaggcagaggttgctcaaaaaaaaaaaaaaatttctcagctcactgcagccttaacctcccaggctcaagtgatcctcccacctcagcctctcagataactgggactacaggtgcacaccatcatgcttggctaatttttgtgggtttttttttttttgaaatgaagtctcactcttgtcacccaggctggagtgcaatggcgcgatctcaactcactgcaacctctgcctcccaggttcaagcaattctcctgcctcagtctcccgagcagctgggattacaggcgcctgccaccacacccagctaatttttgtatttttagtagagacagggtttcaccacgttggccagacccgtctcaaactcctgacctcaggtgatccattcacctcagcttcccaaagtgctgggattacaggtgtgagccaccatacccggccaatttttgttatttttttagagaccagattttgccatgttgcccaggctggtcttgaactcttgggctcaagtgatctgactgccttggcctccccaagtgctggaattaacagacatgagccaccatgcccagcccttgtctcagtgtttaagtcacagccagatttatttttcacttgaaaattatcctcttctaatgtggtcatatctcctatattcttttttttccctcaattcaccagatacaggggccagggtttagcccaggataatgaattttttaacaattagagttaccagaggaaaaaaagacattttccagaaaatacttaagcagcaggtggatatattcttgttttcatatttttttcatcttaagcacagtcctcttaaacattgtcctctgtagtcaagagatggctactcataggggtctgattagcaacttcagtgatgatcaaacataggaggttgttactcaagtctgataagcacaagattgtgtccatatagttttgtccaataaagtaacacaaaatttatcccacaacgaagttgttttcagatgagcaattcagataatctcgttaatagggaaaaaaaggtgaaaaagtcttggatactagcatggataaacaaacatgtcctggctttgttcagaatacacaaggctaccttgtgaccagcttatttcagtttcattttgaaaccttttccttaaatgtctatgaaaaatatcaggtgaaagtatattgtgggtagcttatagaaccaactcgagggttcctgttacagagtgttattatgcatttagagtttgtttcaaaggccccttaagtatttatggattgagataagaatctaacagactatttccttttctgtgattctctgttaaaaaatgtggtcccatctgtggtctcagctattcaggaggctgaggcaggaggatcacttgagctcaggaattcgaggctacagtgagctatgattgtgcctcttcattccagcctgggcaacagagcaagaccccatctctagaaactgtgtgtttgtgtgtgtctgtgtgcatgtgtgtgtatatgtatatctgtgtgtgtatgtgtatatatatatatacatatctctgtgtgtgtgtgagagagagagagagagagagcaaattgtaggatagtcataattatgccatgtgtggcactgctacctaggtgactactctgtgtgaaaagtatggttttcaccaggtcactgctaaagattaagaaaaagggactaaatctgagattcagcattttcatgaaataggaagtgagaaatgtaactgtaagccttaattgcttttgagccatcttctgcctaaggagcaaagacaaaggaaccagaaaagctgcgttctggtcatagtgctgccactcactggccattcattcagacatttgttaacagaatctgtacgtggcatatcatctgctaaaccaaagagaaagaaaatgataaagcaggccaggcatggtggctcacgcctgtaatcccaacattttgggaggccaaggtgggcggatcacatgaggtcaggagttcgagaccagcctgaccagtatgatgaaaccccgtcaccactaaaaataccaaaatgagccgggcgtggtagcgtgtgcctgtaatcccagctactcgggaggctgagacaggagaatcgcttaaacccaggaggcggaggttgcagtgaggtgagatcgtgccattgcactccagcctgggcaacaagagcgaaactcccgctcaaaaaaaagaaaatgataaaccagtttccatgaccaaataacttgtattatataagggagagagaaagagaccataacaatcagaatgcaatgtgttacatgccgagtagtatcaagtactgtggaaactcagagaaagggtgactcctactaggggtgttgtgggagacttcaagaattatcacttgaggtcgggcgcggtggctcacgcccgtaatcccagaactttgggaggctgaggcgggtggatcacttgaagtcaggagttggagaccagcctggcccatggtttcaacatggtgaaaccctgtctctactaaaaatacaaaaattagctgggcgtggtggtgcatgcttgtaatcccagcaactcaagaggctgaggcaggagaatcgcctgaacctgggtggaggttgcagtgagccaagatcacgccaccgcactccagcatgtacgacagagggagactccatctcaacaacaacaacaacaaaaggattatcacttgaataggatcttaaaagatgaggtgttacccagtttaatctttatgacagtagggagtaacagaggaaggaaagtgtttcaagagtgagttggagtcaggaatgaggaaggatgaggaccaaacaaattcttggaattctttgaaattttattcattaatgatatttaagaatcagctgagagtcccatgataccttataggtcattgtgatctttttaagaataatagatagtggcagatacagtggctcacacctgtaatcccaacactttgggaggctaaggtgtatggatcccttgagctcaggagtttgagaccagcctgggaacatggtgaaaccctgcctctaccaaaaatacaaaaattagccaggcatggtagtgtgtgcctgtagtcccagctactcgggaggctgaggtaggagtatcacttgagcccaggaggcagagattgcagtgagccaagattgtgccactggctactgcactccactctgggccacagagcaagaacttgtctggaaaaaaaaaaaaaaaagaatagttaaagaaacaaagtataatctttcaagattagaaaatgaatacatgaggaaataaagtcagaaataatagattactctttcaagaaatctggtggcctaagaaagcagatattaggggagcagcttgagtgggtagatagaattcattaaataatggaaatcacttatttaagctgactttgtacaagtcacttaatatctgtaaaacaaggataaagtggttgggtgcggtggctcacaccgtaatcccagcactttgggaggccaaggcgggcagatcacaaggtcaggagattgagaccatcctggctaactcggtgaaaccctgtctgtgctaaaaacacaaaaaattagccaggcgtggtggcgggcgcctgtagtcccagctactcaggaagctgaggcaagagaagggcatgaacctgggaggcagagcttgcagtgagccaagatcgcaccactgcactccagccttggcaacggagactctgtctcaaaaaaaaaaaacaaggataatgcatgctgtttgatggagatgttatgaaatttgaacgaaataatacatgccaactcaatttaaaaaccatagctcttcaaatgcactatgcttgctattacattattacaatcattatttacctttgctttaaagtaggatatcagaaaagtcagagccttagtgattgttttttactttagcttcgatacctgtgagccttttttcacatttctgggaattaattgtggctcttggagtgacaacagaagaaacccccagatgacactgaaaaaccagaatcatctttgacttagctttttttttttttttttttttttttgagacggagtctcgctctgtcacccaggctggagtgcagtggcgtgatctcagctccctgcaacctccgcctcccggattccagccatcccgagtagcctcagcctcccgagtagctgggattacaggcatgcactaccatgcccaactgatttttgtatttttagtagagacagggtttcagttggccagactggtctcaaactccccctgacctcagatgatccacccttctcagccttccaaagtactgggataataggcatgagccaccatgccccgccagctttcatttttttaagagttataatttgaaggagttgagtttcttcccaatactatagcattttttaaaaactgggtgaaattcaggaatctgaatgtagattttgacaggattcaaggcaatatccctgtgcctccaaataacctgaaagaaacagtggcccttttgggaacatgcccttgggaaaaggccttgtattatttcttcctcagtcaggaggtgctgggaagcaaataaaagtgcaaagggagcctctaagaatctctttggatatgtctcttctagcttgtttctgaccagttccaggcacataactgtacatgtcagtaggataatgggctgactagaaaaaagaaaggtttgcgttattgtttgactttgctagggagaagactgtgttatgtttcaaatactgatctttttctcattactaaattacttgcctccactgtttcccaggccagtttgaattttgattgtatactttccaagcatagtaactttgccagcacaagagtattatttcacggggatatcaccactgattacaatgctgcatattatgtttcaaggatactgaaacctgggttctcagagatccatttatattttctcatcttatcccccataaatgggaaaatcactgggaaattattgggtggagaaatgcatttaaatgaccgtgaattagaattggtccttaagaaggaactaaaggcagaatgctctgtataaccaacactaaggcagaagcataagagggctctgacataagtggtatttaagaattaatgaagaaagtgggagtaagagaaggaaatgagttcagaaaggaaacaaggaggagagagtttgagaggggagagatcataaaggcaaagtgtgaaaagatagagaacaggaagaaaaaagccacaaccaaaaactatgaaaacagagtaaagacagacagccctgtaatgaaaatgctcaggataccaccaaatagaaactccctttgtttactgctagtcattgcagctgcttccaccccaaagtaatgagaagggagaggtttttctttatgcctgtgaccttggttttgaagctttgcctcatagtgctctggtctgccatagtagacattagcatatatcattatatgcttagtcagccattttgcctgaaaaatatacttacctggaaattactcagagccacatgcccatatataatttatgagtactctgtcaagtcatgaattcaaacttaatgcagaatgggcttttaaattctaatatattgttacttgcaattcagctgactgacttaggtgttgtccttagggagagtggaggttttttggttcgttggtgggttggtttttgctttttttttctttctgagttccaggtttaagttgcccccctcccacttttttattttttattttttttgagataggatcttgctttgccacccaggctgaagtgcagtggtaagatcctggctcattgcagccttgaaatcctgggctcaagcagtcctcctgcctcagctttctgagtagctgggactataggcacgcaccactgtatggctaatttgtctttttttttttttttcccttccgtggagatggaatctcactgtgttgcccaggctggtcttggattcctgggctcaagcagtcttcctgctttggcctcccaaagtgttggtattacagacatgtgccactgcacccagcctgaattgccctttttacagtccactggaccctgaaagcatcgcttgtggttgctcagcctgaagagaattctaatgaactctccctctattgcttagtgtgattcaacacatatttgagtgtcagttacatgctgagcactgagaagagaaagataaataatatagtgtcagtagaatttgacttgcaaactaatatattcatggtactctccgataagtactgtgacacaggtataaacaagtggccaggataggaggtgatgctgtaacaaacaacactttggagaatggaatgtatggcagagactggactcagtgtcttcctccagtaagccttgatttgccatcttgacttcttcacctgaggcatatagcaatttgttacacatgctggcctcctggttgcctgttgatttcctgttctttatcaaactatcctttctgttgacagcctttcttatctcacccttctctgttgtccttttaacctattaatagctcattagaaaaaaattaatattccccataactatttacaaagcctaaactttctgtgttcctcagaaatgtgtatgaggatggaaggagtttttgttgtttttggagacagggtctcactctgttgcccaggctgtagtgcagtggtgcaatcttgccctcagcctcccaagtagctgggattaaaggcacacaccaccacatgtagctaatttgttgttgttgttgagacacagtctcactatattgcccaagctggtatcaaactcctgggttcaagtgatcctcctaccttggcctcccaaagtgctgggattacaagcttgagccactacatctggcaagattttttattgaacactcacacaagactagactaagaccttgtcaagagcaaaagtcttatcttattcttcctgtttcctagaacaatgctgcttaaactatggctggcaaaagaatcggggttttacttctaatccttcatagaccaatatttttgtaaaatacagtgagattaattattagaaaaataacataaagccaggcctggtggctcaagcttgtaatcccagcactttgggaggccagagtgggaggatcacttgagcccaggaattcaagaccggcctgagcaacatagactctgtctcaacagcaacaacaaaaattaaaaattatccaggcatggtggcacatgcctgtagtcccagctactcaggaggctgaagcaggaagatcacttgaacccaaaaatttggggttacagtgagctgtaatcataccactacaccccagcctgggcaacagagtgagaccctgtctctaaaaaaaaaaaaaagaaaaaaaaagtttttaaagaaaaatgacataaaagtttttttaaattattattgaaatcaacaaataaattattctgctgtattgttattaaaaattttaaacacatgtcacaggctggtagcaaatggattcacagaccaggaccagtctgtgggccacattctgagtggtacagctgtggaatccccaatatttgcacctgatacacagtacctcaatacatgtttgtgcagtaaatacatgaatgagacgattggaatgattatagtagtaggcaaggaaaaaaggagaatagaggctctctttggagaattggagggaaatgattaagtgagaaactcaagatgactgcaataatgctaccctccatgtaaaacaaactttttgtcatcattcactctgaatactgttcctttggctctctagcaagacagataaatactaataaatactctctctgaatttctgcaaaatatagttttgatcttgctgaatatgtagaacttgctctaaatgactgcacaaagatgtcaacctatttatttaaacttgctctcatgagcagatctatagtagctaggattgatttcaaatattaacaactgctcttagaaccagtgcatttttccatgttgcaatatggagcataccaccaaatgctttctctggctgcaattttcttttcttttcttttttttttagtagagatggggtctcactatgttgcccagtctggtcttgaactcctgggctcagctgatcctcccggcttggcctcccaaagttctgggattacaggtgtgagccactgcacctaagatctctgtctgagattttcttgtttcctctgtgtcctctcaaaagattagctgaatagggtaagaaatatttttatgaaaaactttgaaacaaacaagccttctacgtccattaagataattttgcgttgcttacagcactacaagtcttcagttcttaaaaccaaattgttaggccaggcacggtggctcacacctgtaatcccagcactttgagagggcgaggcaggaggatcacttgaggtcaggagtttgagaccagcctggccaacagggtgaaaccttgtccttactaaaaatacaaacattagctgggcatggtggtgcccacctgtaatcccagctactcgggaggctgaggcaggagaatcacttgaacccaggaggcagaggttgcagtgagctgagatcgcactactgcactccagcctggtcgacagagcaagactgtgtctaaaaaaaaaaaaaaaaaaaaaaaagcgttagtccttgaatccacttcagatttaaaaaaaaaaatagtttcattcaagggatagaaaagaggaggtctactttttaatagccacacacatagctatactcaatggagatcattattttgaaatatttaagctcacaatatttaagtgcaacttacaacagggaagttttgttatcataaatggaattttgttttcaatgtggatcagtacaaattcaataactcaatacatcatcttccttctctactaagcatatccccaagagaacattgttaggaagggcaaaagggccatttccatggtatatttgaggaagtctgcttgcctttctcaccctgtcatcagttccctcagctcttctagccctggaggaatgtcgtcacaaagatacccaggaccctgcagttccctggagcctttctgttcccaagggtatgtagtgtgaacagacctctgtctgaatgttagctctgttatttaccagctgtgagttcctgagaaagatatttgactgctgggagcaccagtattttatgtgggtatgagtattaaataagactgaaaaataaaaaagagggactgttagcacagcacgtgacatatatgttgaaagtaggtactcaaatattagctcttttaccctgactcttgtttctttgaggactacctttaaactatgaatatagctagatgccagataaggctagaaatattgttcaccttttccctggcctcatgctgtctgcagttaagttaaacaagactgttagaaagctagccctgagaaatgcaaaaatagttaagactttatctgtctgcattgataatgaaccacaggttaagaattattgattcataggccaggcctggtggctcacgcctgtaatcccagcactttgggaggccaaggcaggcggatcacgaggtcaggagattgagaccatcctggctaacatggtgaaaccccatctctactaaaaatacaaaaaaattagccgggcgtggtggcaggcaccttgtagtcccagctactcgggaggctgaggcaggagaatggcgtgaacctgggaagcggagcttgcagtgagccgagattgcgccactgcagtccaacctgggcgacagagtgagactacatctcaaaaaaaaaaaaagaattattgatttatagccattgttgggccaatacaatcaatgggatttccgtttagcctttggagattttatagaaatggtctcagaagagagaccacaaccttagtcttagactcatttctgttgtctccattctaatgtattcatggaccaagttatcaggcaacacgctagtacttgaatatggaagagatcatccactcaactggtattagatctgttacctggacattgttagggctttatcacctttatatagactgatgtggttcagtaatttctggagagcttggctgagctagaaaatagtgtcactagccttgcagcgtgtcctttttataaatctgccttttacccattaaggttatataaaacttaaaaatcaagggctccaaaagtatatgggttttgacctgtggaatacactagcagcataatctgatctggcatcttgtatcctgtagcatttggaaatgtctttctaatctcatgtgctagaggaactacttgtcttgtaccatgagtttagggatcatgagttattcatcttatatccctcagtctctccctggtacaaactgggtatgcaggatagctgggggtgtcatataaagttaaaaatcacagatgttagaatcaggcagtcaaaaaccaacttgaccacttaactggctttgtgaccttttagcaatgaaatgaagcaaaaacttaccatcctcaaacctgtacagattcctcatccatgtaagagctataataataatgcctatttcatagggttatgtggattaatttatacatgaataatatctaaattattagcatactatctagtactcagtacatcttagccatcatcattatatagtaaatagatactgaatgtgaagactgtatacatttctgccaaagtttcatatacctaagcgatgtgtaacacaaatcatgtgacaacagaattctttccatatcttggtaaagtcttccccttactttcttctattgatttaaacagaaatttacttggatgtgacccatttgataaggaccagctgataaagtataccagctgattcaaataattgctccagctaatttacatgaaggttttcctattttattgtttttagaaattattttggaggtataaaagtctggtagtgacttatgaatatctttacattaaatgtttaccttattgttctaaaaaatactaaacatttctcatttctatgggaaagccctcaggagaaaaacacttttttccctgttttgggggctatgtctctagcctgcctggaagtttagaaattcccagaaggatattgccaagaagccgcaaagggatgccatgtttgagtttcttgccattcttactgcttataaagagaagcatttgggcagtagttcactgtttgttgttagttcctaaagcactgccacgggagacttatactcctggggtctcttcatgtccccaagagggagttgatggaagatggttattaatctataccaacttcagtttattagcttttctgcttcccaaacatgtttttggcagagaaatagattccacagatccctttatagtgcttctctatccctttccagcactgtagccaagggtttattttttccataacaattttttagacatttgatctttttctctcactgcctgctcctcttctcccccatgcttgcttgccttcctttgtacacacgaataataagctccaatggctgtttttccccctgaaaaatgtgttattccaaacctttccaatctctaaaatcttatttcctagaaatacctttttcctttttttcctctttaaaattgctttatttatttattttgagacagggtctcactttgtcgcccaggctggagtgcaatggcatgaacacagctcactgcagccttgacatctgggctaaagcaatcctcccacctcggtttcccaagtagctgggactacaggcatgtgccatcacgcctggctaattttttttttttaatagagatgctgtctccctatgttacccaggctggtgtcgaactcctggcctcaagcagtcttcctgcctcagcctcccaaagtgctgggactacaagcgtgagccaccatgcctggcctagaaatgtcttttaattcccagcctcaaccctttgttcatccactgtggaccaccccttcctgtctggtggtatagagtatgggctttagtggctataatttttttcttttcactctttatgagagttttctttcctggtaccctaaagctactcaaagtatggtccctggggcagtagcattggcatcatcagggagctagttagaaatgcaaaatctcagatcccaccccaatctactgaaccagaatctgtattttaacaagatctccagatgactggtatgcatatgaaaatttaagaaatccctgttgtaaatcaccttttgctcaagggtcagggattaggagacactttgtcaagtcatggttccccaccctggcttcagtggaatgacttggggaactgtgaaaaatactgatgcctgggttccacctccagagattctaattggtctgaaaggtcaggtccaggaatcaggagttttagaagttccccaagtgattctaataggcagccaaggctgagaagcactgttgtacatgattcttataatttgccctagcttcttagaacacaaggtatatataagttgatgtggccagatgcagtggcttatgcctgtaatcccagcactttgggaggccaaggtaagggcatcactcgagcccaggagtttgagccagcctgggcaacatagtgagaccttgtctctacaaaaaaaaacaaaaaaaaaattagctgggggtgcctgtaatcctagctactcaggagtccaagccaggagaatcccttgagcccaacagtttgaagctgcagtaagccatgtgcaccactgcactatctatctacctatctgtctgtctatctaagatgccgttttagacagacagacagacaggtaggtaggtagatatataggcaaagctaatgactaaaaaaaacttttacaattacatttattggggagaagtatatgtgcatcaaaaattagaaatatatacatcaaaatattaaacccagtaatctgtgggttataagattacagttatttcttttttgtcctttgttttcttttttttttaaggggccatgctcatcttctctgtatcattccaattttagtatatgtgctgccgaagcaagcactgtcctctattttccaaactttctgtaacagccattcctttggtaaaggaaatatatgtgtaaatataatttttaataactgtgatcacattatacatgttttgtaaactgctttttaattaaaaaatactcttcctgttcacatatcaatacattatgaacattttctcattatcattaaacattattagataggcttttatattgtttaaagtgaatcctgacccaggataactgaatttttaccttaattttatttacatactgatatggggatttaagaaattgactgtttagccgagcgcagtggctcccgcctgtaaccccagtactttgggaggctgaggtgggcagatcacctgaggtcaggagactagcctggccaacatggtgaaaccctgtctctactaaaaatacaacaattagctgggcgtggtcgcacgctcctataatcccacctactggggaggctgaggcaggagaattgcttgaacctgggaggcggaggttgcagtgagccgagatcgtgccattgcactccagcctgggcaacaagagcaaaactcatctaaagaaaaaaaataaatcgtttaatacttgaaacttttagtgtttggaaattgtcctggtccacaggaggggacatgtttaaaaggagatgtctgttgggaggctgaggcaggcaagttgcttgagcccaggagttcgaaaccagcctgggcaacatggcaaaaccctgtctctactaaatatataaaaaattagccaggtgtggtggcacacacctgtagccccacatactcaggaggctgaggtgggaggatcacctgagcccaggaagttgaggctgcagtgagctgtgatcgtaccactgcactccagcctgggcaacaggagtgagaacctgtctcaaaaaaagaaaagatatctggaagcgaggttagattagcccttctctaaggcttttacaacaatagtcaattgaatactatcttttttttttttttgagcacttaaacctaacacatagagcttgacttcactttctcagaagatgcttcaccacagggaattcttaatgatgtttggattgcaacctgtggctggagttatatttctaaactttctctttgaatctttggtttagggccaggtgtggtggctcatgcctataatctcaacactttgggaggccaaggtaggtggaacacttgaggccaggagatagagatcagcctagaacaacagagagagaccctgtctctcaaaaaaaaaaaaaaaaaaagccaggtttagtagtttgcacccatagtcctagctacccaagaagctgaggtgggaagaattgctggcacccaggagttcaaggctgcagtgagcttcagttgtgccattgcactccagcctaggcgacggagtgagaccctgtctttaacaaataaataaaccattgatttggttggaattgtgcttcaggacaaccaatatctcttacagtttgagtttcctctgcattaatatgtacattatgatgtggaaagctggaaaatccttagagcaacatcttgaaaacttcaatggtatatgatggccaagctatgttgtaatcaaagtcgaatatgtcttcttgcccaaacctttgggaataaataccactccaacaacttcaacaaaagaaatggtctgcccccaaaacttctgttcttgccccagtctgcttgcattataggggaagagagtaattttgctaatggtctctttacaatgaaaagaaaagagaaatgttctgtaattagggaacttttataaagatgcacagtggattattctgcaagagaaaagctctgtcatcacatttttacctcttttaaccatttctctaccagaatctgtacataaaagtttcagaagtgcacagtttttattttcagagaaataggctttatatatataattttttttttttgagatggagttttgctcttgtcacccaggctggagtgcaatggcacgatctcagctcactgcaacctctgcctccgaagttcaagtggttctcctgcctcagcctcctaagtagctgggattacgggcatgcgccaccacacccagctaattttgtatttttagtagagacggggtttctccatgttggtcaggctggtctggaactcctgacctcagttgatccgcccgcctcagcctcccaaagtgctgggattacaggcatgagccaccgtgcccagccaactttttttttagagatcttgtgtggtaggaaaataaatattgggcatcatgcctggctaacttttgtattttcatagagacagggtttcaccatgttgaccaggctgatcttgaactcctgacctcaagtgatcccgcccacctctgcctcccaaagtgctgggattacaggctcggcgtgaatcactttcataagcaatcagcttccccagaattgggagcctatgactgaaatcagaattgtcatcggtttgagcactttggtgcttatagaagtgcttaagacttagtttttctgggtctttttacaagtaagttgttctttatttcattatgaaaaaaagcactgtaattttaaaaatttatagtagagatatctgtcatttcgggctgctgtaacaaagtgccaaagactgggtggtttatatacaacagaaacatttctcatagctctggaggttggaagtctgagatcagcgtaccagcatgttcaggttttggtgagagccttcttccaggttgcagactactgttttctcgtatccttatgtggttcaaagagaggagaaagctctctagggtcccttttgtaggtcactgatcccattcatgaagattccaccctcatggcctcatcacctcccaaagcccacctcctaataccatcacattgggggttaggatttcaatgtatgaatttggaggggacataaacatttagttcattgtaagaaataagggtaaaatttagtctttggaagagaggataagaaaggtgatagcagagcaagaagaagattatccttttatcgttgctctgtaaccttggccagggcacttaaccagtctactttattacctttctcttagtctcatcacacaatgagaaactgccattctttggaataagttttgctgcatggcattaatggcattctcatacaaaaaaaaaaaagacaaaagaaggctgggcgtggtggctcacacctgtaatgccagcactttgggaggctgaggcaggtggatcatttgaggtcaggagttcaagaccagcctggccaacattgtgaaaccctgtctctactaaaaataccaaaaaaaaaaaaaaaaaaattagccaggcatggtggtgggcgcctgtaaccccagctactcaggaggctgaggcaggataatcacttgaacttgggaggtggaggttgcagtgagctgagatcgcaccactgcactccagcctgggcaacagagggagactccgtctcaaaaaaaaaaaaaaaaagacaaaagccattttcttctcacagcaatggaagtgaagactattgagatgatttgttttagagagattctcttggggtgatatggctggctttactctgcagttggtacatggtatggtacatctggggcacttgtagccagcctctgataacaataattgctgtctttgttactcccattttcctctgtcatggttacctccacagggatcctctaagttagggagaggtttattcctccctcctttatcatctttgtctgatgtggtcctatggtcatcataacacttaattgggtccctgaaaggccactcaactcttttgatgttgctgatgtttgaagtcttatgagaagcttcagacaagagtgtgcaagctcaccagagtgcatagaggggcatatgtgcatagtatattcactgtgcctggatgagaatgggtgtaggaaggagtgtaaaacagaaagggaagccagagagatctttgagccacaatgtaaactttcaatactaagctaagaagttagcacttttctctgaacagtgaaaacctattgaaggtttttgaagaggaggtaatgatatgatccagtttgtattttaggactggcactctggtcacaatgtattagattgtaaaagccagactagaggggttttttacattttttatttgttatttaatttatttccatgcaaaagctcatctatgtgaaagctagtggctttttatatttttatcttttattatttatttatttttatttgtttgtttatttatttttatttatttattttattttttttgagacagggtcttgctctgtcgcccaggctggactgcagtggcacgatctcggctcactgcaagctccgcctcccaggttcacgccattctcccgcctcaccctccggagtagctgggactacaggcgcgtgccgccacgcccagctatgttttttgttttttgttttttggggttttttttgtattttttagtacagacggggtttcactgtgttagccaggatggtcttgatctcctgacctcgtgatccgcccacttcgacctcccaaagtgccgggattacaggcgtgagccaccgctcccggccgaaacagcatttttaacaaggtcatggaaccaccctttgagaaacaatggaccagagactggaggagaaaaatgagttgggaggctgttggaccagtaatataaaagagaaggccgggtgcggtggctcactcctgtaatcccagcactttgggaggccgaggcgggcggatcacgaggtcagaagattgagaccatcctggctaacacggtgaaaccccgtctctactaaaaatacaaaaaattagccgggcgtggtggcgggcgcctgtagtcccagctactcgagatgctgaggcaggagaacgggtgaactgggaggcgaagcttgcagtgagctgagattgcgccactgcactccagcctgggcgacagagtgagactccgtctcaaaaaaaaaaaaaaaaaaaactcaaatctctcaaatataatttctgctctgtatatatctatctaatatttaatatatatataatacaagtataaaagtagaattaggccttatctctaaaacaaaagaggatgagcaaagagatgaagattaatatatgagcagcacaaaagattgcagcaggttttccaggaattacaaggttttgagtgaataaaactcaagtcaaacattaattaatacaaataagctttcagttgtgttttcctttttgaagattttagagaaagaataagataataatatatgcttttattagagaatttgaagttgttcataaaaagtcacttccataatgtgcctccttcaatcctgaagaattatggcataataatgtcctacacttgcttatatcgtgttttataatctctaaaccatttttgtaggcatttcatataatcctggaacaactgtaaggccttcatattatctgttgtttacaaattaaatctcaggcaggttaaatgactgatctaagatcacagctgctacgtgatagaacttggactccacagcaggtgttctgctctaaaccaactgtattttcccctctctcagcttttccttctgactataaactaacataccctgtggtttctgtcttaccccataactcaaatgaattcctgagacatgtaagcatctcaaataaatatttctaagcagatttcttagtgttaaaatactttcatcttggtgataaaaatttaggtatcagagcacagtcatttgattaaaaaaagctggactgatataaatgattgaataaaacaaatggggagaagagataaatctccagtgtataattccaagtaattcatatagttatttatccctcaaggaagtagagcataattcaccaccccttaagttgtgccagatttagtaactcccttccaaaggggacagtgtagaaaggagaggaaaagagtaacttcacaatggaagaaactgacagagtaccctcaaccaggtgatgaaggttaacatcagcatcgatcggtcatgttgatagcatgtatccttgatattgatgtgataaaaatgatactatctctgtggtcttcctcccaaaaaacccataactccagtctaataataagaaaaacattaaataccagtttatggatatcctacaaaatacctgaccagttctcctcaaaactgtcaaggtcatcaaaaacaaggaaagtctgagaatctctcacatccaagaggagcaataacatcaatattggttccttagttgtgacaaatgtaagatgttaataatagagtaaactgggtgtgcaataaatgagaactctactattttgcaacttttctataaatctgaaactgttcttggctgggcatagtgctcacgcctgtaatctcagtactttgggaagccaaggtgggaggatcacttgagaccagcctggacaacatagtaaggccccatctctataaaaaatgtttttaaaaaattagccacacgaggtggtaagtgcctatagtccagctactcaggaggctgaagtgggaggatcaattgagcctggaagctcaaggctgcaatgagcagtgattgcaacactgcagtccagcctgggcaatgaagcaagaccctgtctcaaaaaaaagaaaaaaactattctaaaataaatgtttatttttaaaaaaaaaagactagaatagaataacacctgataaaacaatttatttcttggtgaattgatatgaattgaaatgttttagattttccatccctagattggtaatgaggatttgggataatatcattagaggattatctcagtatcattaagaagtgtcaacttgcatatgagctattttgaaggagatgagtgaataagttatttggttctaactagaaggaacccataaaattatgagaataatgtccatatacaaggtaaccctgaatataatgcattctgtcatctttgcagtgaaaaaatatttttaaaaagtgatgtgaggccaggcatggtggctcactcctgtaattccagcactttggaagaccaaggtgggcagatcacttgagctcaggagttcgagaccagcctggccaacacagtgaaacccagtctatactaaaaaaaaaaaaaaaaaaaaaaaaaaattagatgagcatggtggcacacacctgtaatccctgctacttgggaggctgaggcagtagaatctctcgaacccgggaggaggttgcagtgagctgagatcgcactccagcctgggcaacaaagcgagtgagtgaaacagagtgagtgagactctgtctaaaaaaaaaaaaaaaaaaaagtgatatggatgaaatagacatatattttcacatatataactaagaccataaattttatcaaataatatatgaatttaaagatattgtccccctctataccacctgtcattttaaatgaaacatattgcccaaattttttagatgcaactttgacattaataccggtacatagtaggttgtattagtttgttttaacactgctgataaagacacacctgaaacgggggaaaaaggtttaattggacttacagttccacatggctggggtgacctcacaatcatggcgggaggcgaaaggctcttacatgacagcagcaagagaaaatgaggaagaagcaaaagcagaaacccctgataatcccatcaaatctcgtgagacttatcacaagaatagcacgagaatgaccagcccccatgattcaattacctcccccctaaatccctcccacaacacttgggaattctgggagatacaattcaagttgagattttggtggggacatagccaaaccatatcattctgccctggcctctccaaatctcgtgtcctcacacttcaaaaccagtcatgcctttccaacaatcccccaaagtcttaactcatttcaacattaacccaaaactccacagtccaaagtctcatctgaggcctggcacggtagctcacgcctgtaatcccagcactttgagaggccaaggcagctggatcacctgaggtcaggagttcaagaccagcctgcccaatatggcaaaaccccatctttactaaaaaatacaaaaaactagtcgggcatggtggcaagtgcctgtaatctcagctacttgagaggctgaggcagaagaatcacttgaacccgggaggcagagattgcagtgagctgagatcacaccactgcactccagcctgaacagagtgagactccatctcaaaaaaaataaaacagagtgagactccatctcaaaaaaaaaaaaaaaaaagtctcatctgagactttgccttgccttggcaagtcccatccgcctatgagcctgtaaaatcaaaagcaaactagttatttcctagatacggtgggggtacacgtattgagtaaatacagccattccaaatgggagaaattggccaaaacaaaggggttacagggcccatgcaagtccaaaatccagcggagcagtcaaattttaaggctccaaaatgagctcctttgactccaggtctcacaaacaggtcacggtgatgcaagaggcgggttctcatggtcttgggcagctccgcctctgtggctttgcagggtacagcctccctcctgcctgctttcaccagctggcgttaagtgtctgcggcttttccaggtgcacggtgcaagttggtggatctaccattctagggtctggaggagagtggacctcttctcgcagctccactaggcagtgccccagtagggactctgtgtgggggctccaaccccacatttcccttacttactgccctagctgaggcgctttatgagggccctgcctctgtagcaaacttttgtctgggcatccaggcatttccatacatctaaactccaggcggaggttcccaaacctcaattcttgacttctgtgcacccgcatgctcaacaccacatggaagctgctaaggcttgggtcctccaccctctgaagccacagcccgagctgtacattggccccttttagccacggctggagcagctgggacatggcaccaagtggctgcacacagcatggggaacctgggcccagcccgtgaaaccactttttcctcctgggcctctgggtccttgatgggaggggctgcagggaagttctctgatgtggccttgtgacacattctccatggtcttggggattaacattaggctccttgctacttatgcaaatttctgcagctggcttgaatttctccccagaaaattggtttttcttttctatcacataggctgcaaattttccaaacttttatgctctgctttccttataaaactgaatgcctttaacagcacccaagttatctcttaaatgctttgctgcttggaaatttcttccaccagataccctaaatctctctcaagttcaaagttccagaaaactctagggcacgggcaaaatgccaccagtatctttgctaaaacataacaagagtcacctttgctccagtgccgaacaagttcctcatctccatctgaattttattgtccatattgctatcagcattttgggcaaagccattcaacaagtctctaggaagttccaaactttcccacattttcctgtcttcttctgagcccttcaaactgttccaacctctgcctgttacccagtttcaaagttgcttccacattttcaggtatcttttcagcaacgcccccaatctactggtaccaatttactgtattagtttgttttcatgctgctaataaagacatacccgaaactgggaacaacaaaaaaaaagctttaattggacttacagttccacatggttggagaggcctcagaatcatggcgggaggtgaaagcctcttcttacatggcggcggcaagagaaaatgaggaagaagcaatagtgcattcagaacccattgtggactcagtgttcccaagaacctctcaagggaggtgccactgacaccaggacctgaggctgtgaagaataaggttaagagtactcaggctgcttggtgcaggtgagaagaggtattagtgtattggagaaagagttaagaggcttttgtgcctagggcatagtgattgaggggccttgtagaccatggaaagaactcgatttttttaagtgcagaggaaagccagggattgacatctaacttacagttttaaaagaccctttccttctatgaagagaatggagaaggaggcaagaatagaagcggggaaaaccagtcagaatgctagatgggagacaataaagaattaattgtcattgataataataatagctaacacatggcttactaatgccaaggactgttgtagcacattttatgaaccagctcatttaaatgtgctcttcagttagcacactctttcattctttaaagtatcataggtcgggtgtggtggctcacgcctgtaatcccagcactctgggaggacgaggcaggcggatcacctgaggtcaggagttcaagaccagcctggccaacatggtgaaaccccgtctctactaaaaatacaaaaattagccaggtgtggtggcgcatgcctgtaatcccagctactcaggaggctaagacaggagaatcgcttgaacccgggaggcggaggttgcagtgagccgagatcgcaccactgcactccagcctgggcaacaaagagcgaaactccatctcaaaagaaaaaaagtatcatcgtttggatgataaattacacgaaactatgaaccagccaattaacattttcagaggagcttaacacttggaatacttagtcttcctcctgttctcatcaatttcaaactgtcttgtgaaactcactaacccagacagctatacagtattaaagtaggaagaaaactgtatgggatctatctccaaattttcggagactcttcctttttgttgccttctgtcctggctctgtctcttggttctgagttgtatgtgggcctttctgtgttttttctcagtctttttttccccttcactccgtccctgtgtctctcctgtgtgtgtcccccgtgtttcttttctctttctgctttttgtcttccccattccttctcactctctgttctcttaccctgatttctctttcttcctccttcaactggccggtgaggtacgggcatgtagtgtggatctgtttattatataaaaaatgatgttgactatttccatttaaaacgaatcaagtctctcagaaccagtgtactcattccaaaatactcatagatgattgttacaaactactttaacaggagtgtccaatcttttggcttccctgggccacattggaagaagaattatcttggagcacatgtaaaatacaccaacgggccaggcactgtggctcatgcctgtaatcccagcactttgggagaccgaggcaggtggattgcttgaggtcaggggtttgagaccagcctgggcaacatagtgaaaccccgtctgtactaaaaatacaaaaaattagccggacatgggggcgggcacatgtaatcccagctactcaggatgctgaggcaggagaatcacttgaacctgggacgtggaggttgcagtgagccgagattgcaccactgcactccagcctggacaacagattgggactccgtctcaaaaataaaataaagtaaaataaaaattaaaaaataaaatacactgacgatagctgatgaactaaaaaataaataaaaaagttttaagaaagtttacaaatttgtgttgggccacatgcagcccagaggccatgggttggacaagcttggttcaaatcattttattatcctgttttctactttcacatctctcaaggaaatttacctagtaccccgttcatctaactgatctcttctgatccccaatccttcccttcccattctaccacccacctccttcactgccttctatacctcaagtctgcccccagctccagcaccagactgcacctaaatcacaccaggtcacaactattctgtaagacacaagaggatttgcgtaacctgtgttgagccaagtgtcacccattcttccataatatttatggaatatttacttccttttttacctttcctaacgcttaatactttgcaaactattggttttgttctgaagcttacttttaagatattcttattttacatacgaaagtgcttccttatgtttgcctggttccaaattagagggtaccagagcccgatctcctctaagcaggaggcttcccataggaaaggaatgttcctttgtgctcatccttcgtataaatcaccagggagcttttaaatgaacaaagacctggctgacccagagggtagaacttataaatagtactccagcccctcctttaaagcctgtccacctaatcctcctctcaagattggaagtgacttgacctttgagtcttaaaactcaggctctttttctctaaaaaatctggttagcagtaagctgttaaaacaaatatgtttttagccagatgatgaccaatcatcaaagcttgtctttcatttctagcatttttagccaaatgtttcctcggttttttttttgtgtttttgtttttgttttggctcctcagaagtcaacttgaagtttcctcttttgaggaccagcttttctcattgttattattttaagacatctaccttaataacttttatttctccttactaatagactattatggatttccattttataaagatgttcccaaattgctgcatttctaccatgaactaagggcttccttttcacccctaaaattacagaacttagaggggccttcaatggcctcaatcccaacgtcgttggatggagctctctttgtatttctctaatgctgtattgaggataaaatcttacaaaacttgttaaggattaaaatgtgcaaggattataaaatgatgcacatgatatagatactggtagataattttccagattagggcacatgcaggaataactatgtatattgaactggctaaacatataaatatattttatagaatatatttttatgtgattcccaaaaagataagcaattagggccgggcacggtggctcaacgcctgtaatcccagcattttgggaggccgaggcaggcagatcacctcaggttgggagttcgagaccagcctgaccaacatggagaaaccccatcgctactaaaaatacaaaattagccgggcatggtggcgcatgcctgtaatcccaaatactcaggaggctgaggcaggagaatcacttgaacccgggaggcggaggttgtggtgagccgagatcgtgccattcactccagtcggggcaacaagagcgaaactctgtctccaaaaaaaaaaaaaaaagaaaagcaattaagtccttaacctggttatttacagagaaaagacattcatgttgtggaaatcaaccatgtatttttagctacttctctcccttgaaataaggggagcttaaatttactattcactaaatgccagatagaagactaatttaaaacatctttcttttttatcatttaatacatagattgaagagtaagtcctggccccaggctttgcttttctgacctctgccagtcacagtagtgctttttctggaagttcagtctgctccaactgcagctttgtgcagggaccctccgggacttttctagttttgctagaatgcctcatctgcctgtgagcctggaactgtagaagtcattttagttttgtttagtcttattgtttaatttaagaaagtctgatgtccatgttgccgtagtgggtacataggacactatcggctgtgaaagaatgaaaagcttgttcagagaaggtcgaatgaggactatgtcttcagaaaaccttgggcttagctgcctgggacagtttagatctgagctcagaggggattgatagagcagtagtatctgttgttttccttctgccgttgggaagctttctcttaacatatagagaccctgggatgtgtgagcatatttatagtaattataattgtgagacatgacctaaggaagtatgtgaacttgcttttgaatttagttgtttaaaaaaaaaaagtggagtttgaaaatatgaaccagaggaaggcagatcacacgggtggagaggaacggcactgtctggagatgtattgagcatagaaggagagtttgttaggaattgcacaccctgaggggagaatgacacagccaatgtgatctgaaagcgacagtacattcatgcagggatgcccacaagcaggttgagtgcacagaaagatagactcctcatcacattgcaggcactctgctgaataaccctttgttatattttgagacttttctttttttttttttttttttttgagacggaatcttgctctgtcgccaggctggagtgcagtacatgatcttggctcactgctcactgcaacctccgcctcctctgttcaagcgattctcctgcctcagcctcctgattagctgggactacaggcgcacaccaccacgcccagctaattcttgtatttttagtagaaacggggtttcaccatgttggccaagatggtcttgatctcttgacctcgtgatccgcccgcctcggcctccaaaagtgctgcaattacaggcgtgagccacgacgcccagccgagacttttctcgtatagcagcaaaacctagacagaatctctccagagggtaaaatatagtgttattacacacatgatgattccagtcagctgtgttgtttagggttcttcactgcaagctattcaaacaatgggaaagggtatctgaggcttttggagctgcctggaagttgaaggacagggtctgtagcaaagaccacacagtaggaaagggcaggttggcatgcccctgctgcccccaccctgaagaacttccaactccctcgaaagtcctgtagcttcaggaccccagaactgggtagcacgtgtccaaggctaggccttcttgtgctcacccctgattatgccagggctgggagaaaaggatctggcctttctagctgctgtagtgcaaagcagtcactgccttccacaaggtagagactctcttctttgggaagagagtctgatcacaagatagcaaaaaaagaaaaccaaaaaaaagacacatgtaaactatatctatattatacatatatttatctgcagctcagtctcttcgcaaatattaacgatcttttgcagacagcctctgtgcttgcataatgttaattttcttttcctttaatggtttgtcaattgttttttaaaacaaaacaaaaaaaaccttagcactctcttcttaaagttagtctttatttttattaagttgtatgtgttcatcatttaaagaatcatagtcagccgggcaaggtggctcacacctgtaatcgcagcactttgggaggccaaggcaagcggatcacctgaggtcgggagtttgagaccagcctgaacaacatggagaaaccccatctccagttaaaaatacaaaaattagccgggcatggtggtgcatgcctgtaatcccagctactcaggaggctgaggcaggagaattgcttgaacccaggaggtggagattgcagtgagccaagatcatgccattgcactccagcctgggcaacaagagcgaaaccatctcaaaaaaaaaacaaaaaacacagtctatctagtttctaatgaagagcaccactccctgtccccctattttctactccccagagaaaactattttcaatcctttttagcttatttatttggtattcatcttggtatttctaaaaagcaaaatgtggctatgtcgtaatgtttccattttagcattatttatccactttccactacggaaaatgacagttttgttgtttctcaacatttcgtgcctgactatccagatatacatactcttgttcccccatcctcccaggtaaattatattgggtgttagcatgtgctttcattgttatgaccatatcagcactacttgcaatgaagccatgagttatactatgactacttttttcttccagtactacctttaatttttcttgatgtcagtacttggatttttgtcatttgcttagattttctgtgcttctcatgaatttgaccccaaaatctccctctaattgtataaatctcctttccatataaacacactaggtattctatgaattttatctttttaaaagaaaatctcttcctgagctttgtgacctgctctagcctggaccctggactagtcactctccagacctgttaaagagctattgtcttgggatcttccttcactgtcactcaggggactcccttcagctgtttcttgcttgctatatcccatgtcatcccctttcttggttttctctgtcattttgatgaagccatattttccttagtttcttaagaaagcaaatattttttagtttgtttcaggaattgtttccctgaaaattttaaaggccctgctaagttgtctcctaccctccagggttccttttgaatttgatttattctgattttttttcctattctgatttgaccctttgtataatgacttgtttaacctctggaagcttttcgcttttctttatctttgatattctgtaaatgcactaatgatgtgacttgggcatttgctacaccctttttttttttttttttttttttttgagacagggtttcgctcttgttgaggctggagtgcaatggcgcaatctcccgggttcaagtgattctcctgcctcagcctcctgagtagctgggattacaggcaggcaccaccacgtctggctaattttgtgttttcggtagagatggggtttctccatgttggtcaggctggtctcgaactcccgacttcaggtgatccgcccgcctcagcctcccaaagtgctgggattacaggtgagccatcgctcctggcctagacactttccatctacgaaattttcttgaattaatttattgatgccatcctcccctctgttctctctgttctacctttctagaacttctattagttagacactagaactcttggactattcttggactataagtttttgtgcctttactctcctttttttttttttttttttttttgagacagggtctccctctgtcgcccaggctggagtgcagtcgcatgatctcggctcactgcagcattgattttgtggactcaggcaatcctctcacctcagcctccagagtagctgggaccacaggcatgcaccaccatgacttgttaattttgtatttttgtagagatggggtttcaccatgtttcccaggctaatctcaaactcctgagctcaaggaatccacccacctcagcctcccaaagtgctggaattacaggtgtgagccaccacactcagcctgctctcctgttttctatccttgcctttttcgttctgaaagctttcttcaattttgtctttgtgttgagttgtttggttctgctatcaaaatatatgtgtttctagagttcttttttgttctctgaatattcttttttaaattggtattattgactcatttaatgtatgaaacaatacagaaactagaaaatataaatacttatgttagaaggcattttctgacagagaacatcagttaaccagcttcataagttgtaacctcaaaccagagaaattcacctaaaatatacagaattttattatattaatttttagtgtctgtaaaggttatgtcttatctctcttttttaatgctcctttttaaaacttatgtctttatctgtaagcctctttattcttctaagttacttttttcttttagtttgttttggtctgtctttcataataaatgctttcttaaatttctgttgatacttggctatcttctcatatttaaaaacagggcactcagaggctgaggcagacagatcacttgaggtcaggagttcgagaccagcctggccaacatggtgaaaccccatctctattaaaaatacaaaaataagctgggcttggtgacgtgctcctataattccagctactcaggaggctgaggcacaagaattgcttgaaccaaggagatgaaggttgtagtgagccgagattgtgccactgcattccagcctgtgtgacagagtgagactctgtttcaaaaaaaaaaaacagagggggccactacaaagcaatttgagagttctgtgcttgtgggtgaagtttatggactgtggcattcactatagagtgatcttcatgagttgtttccttggggtacatctgatatttgtttctttaggtattttatcttggttggtcagatcctgttggtaaattttaaattttgcactattcgttttctgtccctttcttgcagtctctaggtgtgtgcagtcttaggattctcatagataaaagtaacttctctaggtttctgcttcttcctttagatgtctttttgactctcctcacattcttatgtgcttccatggcaatgagcagtttgacaaactttttaaaaagtaaacaagagttggtgggagtaaacatgagacacctagaatacaaagtgggagtcactttcagtgccttatttttccttagtcatatttgatcagaaattggatgaaccttcgggatgctgagacagggaagatactctggcaaggaacagaagacctgtctgtccctggtgtggagcatgaaggtactttccaaccctttatctacacagggctgtgaccaatgccagactagcacctgagcataagagagctaagttaacacatacctaataggcgggtgagcccctgaagacacagcatgttaatccatgtgttgttgacagtttcagttactttcttttttttttttttttttttttttgagacacagtcttgctctatcacccaggctggatggaatgcagtggtgtgatcttggctcactgcaacctctgcttcccaggttccagcgattttcatgcctcagcctcccgagtagctgggactacaggcgtgcgccaccacatctggctaatttttgtattttgagtagagatggggtttcaccatgttggccatcctggtctcgaactccggacatcaagtgatctgcccgcctcagcctcccaaagtgctgggattacaggtgtgagccaccacgcccagccagttactttcttaacagttctttctctcacttcccaaaacccattttgtgctgatattttaccattagaacatacccaaagatagaaactaagatctcaactttttctccaaaagaaaatttgcatttttatctccctgaagtaaagaagaaggaaggggttaaaatcaccagaacagagtagagagaaggtacccatgcagcccccttcctgatgagagtagttagatgaggcccttagatgcacaaaacctggtgttccttgaagatctaatatctttcagatacgggtgaccaattagagacctctgctttcagccacacaaagtgtaatgcacttaccaaggcattatccaaaatgtaagaaagtgttctctaaatcagctgtaagaaagtgttctctaaatcagctgtaagaagctcccagaaatttgaagcatcatagtcctgtggttttcatttagaaaggcttcaacatttgtttttctcttaccagcccgtgttcccaagaaaatcctcaagtgcaaggcagtgtctcgagaacttaatttttcttcgacagaacaaatggaaaaattccgcctggaacaaaaagtttacttcaaagggcaatgcctagaaggtattctgctgcctacatgcctgaaatcagggcttagggcgaccaggacaaaaggcaacaatacccagtgaactaaagcagtgctttgataacattccttttacaactcagtttgtggtaggattcctacactctgcaagactgtgaatccccagtgaaacaaaccaaaacaaagctagccactacaaggggctttgaggtctctgacactgggagcgtggatggtggtgcctggtttaggcactgacgttgtattgtgatatgatcatggaggaagctgctatgagcagggcctagtacagtgctctacatacagtatcatacagatttgactggcaaggccactctgcattgaattctcaccatgcagtgtaaagggcacataagccccttcaagctaattccaagtgaatttaactatgtatctatatatagttcacatctagcctacctctaagaaaatgctgcttatattgtgtcctgctcgctggtcctagtcctttagacctcaaagcatgagaagcaagcctttggtgtggttcagaggacaacctgagcaggcttccctgtcttttttacgcccctggtctgagaggttgctgatagcttcctttggtggttctcagggtaggaagaggctcactctagagagggagacaaagagcccttaaactttatactggggcacctgctcaccccggcttttccttcttccttcagaatggttcttcgagtttggctttgtgatccctaactccacaaatacctggcagtccttgatagaggcagcacccgagtcccagatgatgccagcaagcgtcttaacgtgagtgagcaggtctcaggaaattatgaagtgtgtctagaaacaggcattccaggcaggtgggactcctggtgccattcagtgggcagagagctcggttgagaaatagagtaaaagagtatccaagggtatctaggtttccaggttcctgacctttttcatatgaaaaagacagtatgatagagtagaaagaataaaaaactaaaaataaaaataaaactttagattaaaccagatttaaattcctgattcaccctgactacctgtgtcatcttgggcactaatatactttatctctctgagccttagtctttcatctctaaacacagaaattaattctgtcttacagaggtgtaatgaagataaaatgtgatgacatggaaggagactggcatttaatatatataccgaatctatgttaatttgctcccattcctgactaccgtacttccggtatctctgtattttgtttagatcacctttaacagaatctggcaaagtcctattaataattctgttttcgaggatactacttggttacagttttttggagaatggcttaccatattaatagctttggttcctgttccaagaacaatttgtttgtgctttttccaaaaacactgtcaataacttcctacctcccattgtctgtgggaaagatgttagtctctcaaatgttatagtaatagtaccttctaaagagttagctgggcgtaatggcacacacctgtaatcccagctactcaagaagctgagataggagaattgcttgaacccaggaggtggaggttacaatgagccaagatcatgtcactgcattccagcctgggtagcagaccaagactctatttcaaaaaaaaaagagttagtcccacagataattgtgtaatattggatcatctctttcaacagttcctttatgaaagccatattgaatttgttaaaaattgaggttattgactttaaggttttttgtttttgttttgggttttgtttattttatttttttaaaaaacagggtcttgccatgttgcccaggctggactccaactcctgggctcaagtgatcttcctagctcagcctcctaagtaggtgagactacaggcatgtgccaccatgcctgtctctactttttaagtttttttttttttttttgagacagagtctcgccctgtcacccaggctggagtgcagtggcgtgatctcagctcactgccagctccgcctcccaggttcaagcaactctcctgtctcagcctcccaagtagctgggattacaggcatacaccaccacaccggttaattttttttttgtatttttagtagagacagggtttcaccatattggtcaagctggtctcgaactcctaacctcgggtgatccacccgcctcaacctcccaaagtgctgggattacaggcatgagccaccgtgcccagcccctttttaaagtttttaatagtttttttaacagccaggtgtggtgacactttcctataatcctagctacttgggaagctgaggcgggaggattgcttgagtccaagagtttgagactagcttgggcaacatagattttgtaagaggctgggcgcagtggctcacacctgtaatcccagcactttgggaagccaagtcgggtggatcacgaggtcaggaaatcgagaccatcttggctaacacagtgaaaccccatctctactaaaaatacaaaaaatcagctgggcatggcggcacacgcttgtagtcccagctactcgggaggctgaggcaggagatcacttgaatctgggtgccggaggttgcagtgagccgagatcacgcctctgcactccaccctgggtgacagggcgagactccacctcaaaaaaaaaaaaaaaaattgtaatagaattttttaaagttttaatagttttaaaagtagattttttttttttttttgatatggagtctcgctctgttgcccaggctggagtgcagtggcaagatctcggctcactgcaagctccacctcccaggttcccatctttctcctgcctcagccttccgagtagctgggactacaggcacccgccaccacgcccagctaattttttgtatttttagtagagacggggtttcaccatgttagccaggatggtctcgatctcctgacctcgtgatccgcccgcctcggcctcccaaagtgctgggattacagacgtgagccaccggtgcctggcctaaaagtagattttttaattacagtagtagctatttttatatcttatcagccagtcagattctgagtaccttatttacctgttttttggggtttttttttttgtttttttttttgagacggagtctcgctctgtcgcccaggctggagtgcagtagcatgatcccagctcactgcaacctccgcctcccaggttcacgccattctcctgcctcagcctcctgagtagctgagactacaggcacccgccaccacgcccggctatttttttttttttatatttttagtacagacggggtttcaccatgttagccaggatggtctcgatctcctgacctcatgatctgcccgcctcagcctcccaaagtgctgggattacaggcatgagccaccatgcccggcctatttacctgttttataattaattaccagcagaaatgtatctgctggttattaattaccctgggaaagtacagagtagtttaggaaagcaggggttttttttttttagattttattaaacttcatttgacttcttcttcacgaggcgtgattttttgttgctgtttttttttgagacggtctcgctctgtctcaaacctatcataagatgaaaatatcataagtcaaaaatgcatttaatatccccataaatccactataaagttgaaagatcataagttgattcattataagtagggaaccaactatacttaactttttattttttatttttttttattttttttgagacagagtctcgctctgtcgcggaggctggagtgcagtggcgtgatctcggctcactgcaagctccgcctcccgggttcccaccattctcctgcctcagcctcccgagtagctgggactataggcgcccgccaccacgcctggctaatttttttgtatttttagtagagacagggtttcaccctgtttagccaggatggtctcaatctcctgaccttgtgatccgcccacctcggactcccaaagtgctgggattacaggcatgagccaccgtgcccggctacttaactttttagaacccccaaaaacagttgccctaaactcagctcaagtgtgatttggtaaggccatggtctctcccattttacaaatgggagcaccgagatacccaccaagaaaaatgaaattcttccctcacacctcacaatacaggtgcatcatttagtgttctgtagttgtaagtcatagaaacaggctctggctaatacaagagctgaaagactaagggggagagctgggcggcttggaagatgcagatgggcaggaatccctggatggcttcctcaaggagaagctacaggaaggatcttgctcaagagaaagagtctgattggcctaagttacatcctctgttcacccttttgccaggtgagtgaggggccactcacttggcacatggactggaggaagggtggttcccaaatgaagagcaaggtgctgttacccaaaggcaggaaaatagatgtgggccaggccaaagcccacctttcgactattgtgagtactgtagggaaggatactgcccctgaggtctgcaggcttctatatgtaagccagccagaggtgtccatgaatgcagtatcagaaagtcagtcggatctataagcaccctgtgtgcagagcactctactaagggctttagagtgtaccaaggagtggagacatgctctcacttctgatttgtgagcttgacagggatgaatgtaaccacataagttaaatgtcatgttagacttgtagccccatatagacaaggattttaatgtccccaagctaagactctgggtgggtgcatgtccattggcccaggaatccagatggaaaccactttgtggaaatgaaatcttgtgcctaacatgctcactctcttttgccctctgtttctcttcttacttacagtgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtctttagcatggcactgcttttatctctcctttttctggaaagtgaacctggctgcataatggaaagaaaccaaatataagatcacaactgtatttcactccaggaatggaactgatagatcttgttccctagtgccacagttactgctttccaaaattgtgcaacatacttgaaccaaacccatgaccttaacatttgtcttttagacacaatctttaatggttcttttccacaacatacatgcaccctttgtttgtttattattgttaattttttctatttgtttacagtattcatttgttcaagaagtttcaagaaagggcaattctaagttagtagagtagggactctcatattcctaaatgagactagaagctacaaaatgaaaagatctgcatgaacctaactggagaatgatgggaaggcgtctgggctgggaggaggctgggaggcctttaagactgtcgtcattggaagccagcgtgggagagaagggattacaactggcagtgctttcaggtccgacataagagagaacaccaaaaagtgttcttacctctgagctactagtagccttcagtgtctttttttgttgttttgttttgagacagagtctcactcttgttgcccaggttggagtccaatggcgggatctcagctcactgcaacctctgcctcctgggttcaagcaattatcctgcctcagcctcccgagtagcccgtcaccacacctggctaatttttttgtaattttagtagagacagagtttcaccatgttggccaggctggtctcgaactcctgacctcaggtgatccgcctggctcggcctcccaaagtgctgggattacaggcatgagccaccgctcccagcatgccttcactgtcttttataaaataccaacaattacatgttttcaagttaccaaagcagtaaggtctgaggccagaggacagaacacatcaaaggtatggctctctttggtgtagctcttgctctcagattcctcttttccttttctctctattacctgagtctgtttgcatctgcgggtggggaggagaaaccgtatatttttagtgtactaccatctttcaatgatgattcaattcctcatattagatctgttgtcttcaaaagctgttttttattaattttatttatttatttatttatttagagacagaatcttgctctgtcacccaggctggagtgcagtggcatgatctcggctcactgcaacctccacctcctgggttcaagcaattctcctgtctcagcctcccaagtagctgggattacaggcacacaccaccacgccggttaattttttttttttttgtatttttagcagagacagggtttcaccatattggtcaggctggtctcaaactcctgacctcaggtgatccacccccctcggccccccaaagtgctgggattacaggcatgagccaccatgcccggcccaaaagctattttttaaataccaaagtttggatggaaaaacaagttggggtaaccccagcaatttaggagaccaaggcggaaggatcgcttgagcctgggggttcgagacgagcctgggcaacaatggtaaaacccagtctctacaaatgataatacataaattatccaggcatggaggtgtgtgcctgtagtcctgactactcgggaggatgaggcaggaggattgcttgagcccaggaggcagaggttgcagtgggttgagatcgtgccactgcactctggcgtgggtgacaaagcaagaccctgtctcaaaaaaaaaaaagaaagaaagaaaagaaacgaaaagaaaagaaaagaaaaaacacagccgggcatggtggcgggcgcctgtagtcccatctactcaggaggctgaggcggaggttgcagtgagccaagatcatgccactgcactccagcctgggcaacagagcgagactccgccttggaaaaaaaaaaagaaagaaaaaaacaaggtgaaaatgaattgct

SEQ ID NO: 12117 - DNA, 10320 bp, Human
  misc_feature (1)...(10320): n = A,T,C or G
tgagccaccatgcccgtccaggttttatttttaatttttcaaaattttcatatttcttcaggatatagggtctctctgtgtcccccaggctggagtggtttgaccatggctcactgcagcctcgagctcctaggctcaagggatcctcctgcctcagcctcccaagtagctgggtctatagaagtgagccactgtggccaggccaccggtggctcacacctgtaatcccagcacttcgggaggccaaagtgggcagatcacgaggtcaggagattgagaccatcctggctaacatggtgaaaccctgtctctactaaaaatattaaaaattagctgggcgtggtggtgggagcctgtaatcccagctactcaggaggccgaggcaggagaatcacttgaactcaggaggcagaggttgcagtgagccgagatcaggccactgcactccagcctgggcaacagagcgagactcagtctcaaaaatgaaataataaaataagaagtgagccactgcacctagctaattttttctattttttgtagagatggggggtctcactatgttgtccaggctggtcttgaactcctggcctcaagtgatcctcctgcctcagcctcccaaagcgctgtttgagagccactgctcccggccgagttatgggtttttatttatttatttatttatttgaaacagaatctcgctctgtcgcccaggctctagtgcggtggcgtgatctcggctcactgcaagctccgcctcccgggttcacgccattctcctgcctcagcctcccaagtagctgggattacaggtacatgccaccacgcccggctaatttttttgtatttttagtagagtcggggtttcaccatgttagcaaggatggtctcgatctcctgaccttgtgatccacctgcctcagcctcccaaagtgctgggattacaggcatgagccaccacaccaggcctgagttatgggtttttaaaggtgcagaggcagaggtcacaggcaagtcataaatcagtacatggaggttgtacactggttttgccataaatagcaaggagatcttgaagccagggaccacgggtcataggtggattcaaaggttttctgatttggtgcagaagcgaatctttgtctaaaactttgggatccgcaggaaagaatgttagctctgggttgtgggcatggcctcctccaggcccctcaggaagaaatttaggtaagagaagggtggtcagaggccagtcctcagctcccgctcatgtgaggtctgtgtgccagcacgcccctttggtgggagtccctgtttctggaaaacaactgaggagcacctgctaagatggcatggtttgcttctgtggagactctcgggactctggcttccatctgttgttctaagctcctgtgaccttcttgtgaccttcctgtggatcggctgctcatttccttctctgggctggctgggggcctggcttgcccttgaaggaactcaacattgtccttgcttctgtgcttgggaagacccacaggcccctaagggcggggggggtccttgtttggtttcaggagcagcaggtgcaaaggccctggggtgggaggggtgagatgtgaggccacagcagcgggtgagggccaggctgcagagggttttggggaccatgaaggtgggcccttcagagatcaggcagggtcaggaaaggcagtagggaggcccaagacagcagacactgtggttgcttccatctggaagatgggcagctgcaggagcctggctgttcagggtcacacttctctccctgtcccggccccatctgctgggtgtccttccttggagcccttgacagcacctgagcccctcctctccatcccctgaaccttggtggttgtgccccccctcggggcccaacaatctcattagggtggcactgagacgcctaatcagctcatgaagcagcgagataaaggccggggctggcaccctgcggagggaggcccagcactcacagcacagccccctgagacccgccctgcacttggtgagtagtggccaaccccgctgtctttcctggcagccacttcccccagtgagtcagtgggggtctgctcatcacccaaggggcagagggagctgacaggcttttaccaccgtggctgaggtctgggtctgcagatgcctacccgccaccctgttattcagaggggactcccagccaacctcctcctctgctcccccatggtaaccagtgcttccaccatccccaggccagtgatggtctgggaacctcaggccacgtgggctcagctgacctgagtggacgccagtcacaggctgggtcgggccagggcagcgcaggcagcggtttccacatggatggcatctgatggttggagctccatcagggcccagagctgcccaggacagcccatgtcccagggctggagaagcagctggacggggcctgtgctatctaggatatgaggattgggtgccatgggatctgagcagctgggaccaccgggctcctgagtgctggttttgcacaggctggtgctggtcccagtcccggggacagaggctgaaccttagtgagggaaggtgccatggcagggtccaccccaatcccaggtgcccagcaccccttgcagagcccgcgtccccgaaatgggccacctgcccttgctttctgatcactctcacgcctgaagctcggcaaacagctggtagtagcccagggctggagtcaggaatcccagccaaaaagaccaggggcaggaaaggggaccccaagaggtggtccctggggcatccagtgcgggcaagcagcccctcctgtctgtgtcatgtgcctccttccagaactttccggcagcatgtgcagctgacagcagctcgatgggagattaggaattcccctctgctgttaataggcttaggggaagctgaactgcccttggcccaggtcactggggcttagggcatctggggagaggctgtagggagaggaggaggagaggccaccctgtgcagcagtgcagggacactgatctcgtccagagcggccgaggcccttcagccacgccacgccacgccaggcgggtgaccctgctccccgagctgactccagacacagagagggcctggtgattcccccagcagggggaacacatgcccggcaccctccgtccccaagccccagcttgtccctctatgaagtggggttggggaacgcagggcttcacagctcagcaccaagtctctgagacaggcccctttcccaggggcgccgtgcctggggaccctgccccccattttgtgggtcattctccatcagcactgcggggtgcccgtcatggtgctgaggggctcagggatgcctccgtgagtgggtgaagggaactgacagcaccccaactgcaaagcacagacaagaggcagaaagcaataaacccatcaataagaatcagaggggttggccgggcgcagtggctcacgcctgtaatcccagcactttgggaggccaaggtgggtggatcacgaggtcaggagatcgagaccatcctggctaacatggtgaaactccatctctactaaaaaatacaaaaaaaaaaataaattagccgggcgtggtgtcgggcgcctgtagtcccagctactggggaggctgaggcaggagaatgacgtgaacccaggaggtggagcttgcagtgagctgagatcgtgccactgcactctagcctgggcaacagagcgagactccgtctaaaaaaaaaaaaaggtgagattccagccacagctctggaataggatcctagggggctactttggcaggtattaaaacttttttaggccgggcgcggtggctcacgcctgtaatccctgcactttgggaggccgaggcgggtggatcacaaggtcaggagtttgagaccagcctgaccaagatggtgaaaccccatctgtactaaaaacacaaagaaaaattagctgggtgtggtggcgcatgcctgtaatctgagctactccggaggctgaggcaggagaattacttgaacccgggaggcagaagttgcagtgagccaagatctcgccactgcactccaacctgggtgacagagcaagactctgtctcaaaaaaaaaaaaaaaaaagaatcagagggcaacagcccgggagacgcccaccagcctggaatcagggctaactcgacgcgtgatgagaagcggcaaatcagaacctaaggacacagtggctgcagggcgggggttcaggggagacctccctgagcgggaacttgagatggaggcagcccactaaccatcaggaagggcagctcagaggcaggctcctctgctgggcctggcaggcccattcccagcaggagccacagaggactttcatcagagtagcagctgggccgggtgcggtggctcacgcctgtaataccagcactttgggaggctgaggcgggtggatcatgaggtcaggagttcgagacaacctcgtcaacatggtgaaaccccgtctctactaaaaatgcaaaaatgcaaagattagccgggcatggtggcagacgccggtaatcccagctgctggggaggctgaggcaggagaatcacttgaacccgggaggcggaggttgcagtgagccgagatagtgccactgcactccagcccaggcaacaagagcaaaactctgtctcaaaaacaaaacaaaacaaaaaaaaacccagagtagcagttaaatgccgacgggagtcacgcttccctggggtggggaacgcaggggaaggggcaggaagttgtcagtggtcacccacagggaggtggtgaggactccaggctcaggacctgccacaggttgggaggctaggtttgctgtggattgtgggccggggcgagggaggccaggacaggggggagtccggagctgtgtgtggccagcgttgcaggggggcatccactaggcaaggggaatgggagcgtgcgggtggacccaagcaaagctggcaggctggttaccccagggcggattgcaggggctgctgtctggatgacgctggagctggcggggctgggtctcagcccctccaccggtgggttgagacccccacaagggttggaagcaggagggctgactgggacccgggcctggtctgcccccagaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtaagcagagctgggggatggggcctctgaaagggaggaggcggtcctgaggctgcacaggaaggggagggcggggcagagcctggggccacttcactgggtgagtggtcccagcctcacagctggggaaggtagggcggtgcctgagggcctgagcagggatggaggagggggaaggggaattgggggctcctgtcacccgctccagatgctactgccaaccatgcttgaaaatacagccactgccggccaggcgcggtggctcagcgctttgggaggctgaggtgggcagatcacctgaggtcgcgcccggcctaaaaaaaagttttaatacctgccaaagtagccccctaggatcgcgagtttgagaccagcctgacaaacatggagaaacctgtctctactaaaaatacaaatttagccaggcgtggtggtgcacgcctgtaatcccagctactcaggaggctgaggcaggagaatcgcttgaatccaggaggcagaggttgtggtgagctgagatcgcgccattgcactccaggctgggcaacaagaagaacaaaactccgtctcaaaaaaacaaaacggccgggggcggtggctcatgcctgtaatcccagcactttgggaggccgaggcgggcggatcacgaggtcaggagatcgagaccattctggctaagaaggtgaaaccctgtctctactaaaaaatacaaaaaattagccgggcgtggtggcgggcgcctgtagtcccagctactcgggaggctgaggcaggagaatggcgtgaacccgggaggcagagcttgcggtgagccgagatcacgccactgcactccagcctgggcgacagagtgagactccgtctcaaataaataaaaaaaatacaaccactgccacccagggacagccatggcacaatgcaccgaggagtgtccactcacacatgcgcacacacgggcatctcactcccatcagtgcaccgaggagtgtccactcactcgtgtgcgcacacaggcaccgcgctcccatcaacgcaccgaggagtgtccactcacacgtgtgcgcacacacgggcatgacactcttatgcacaaacacgctcacacctccacatatgcacgtgaggcacactcacagacaagccaccttcacaaatctacactcagaccatgcaccaaccacgcacccccccgtactcccccagggcacgcacctgcccagcatcctgggacttgcacctccttttctaggcctcagccccatgatgctctgggcagcagactcaccctgggtctgtgagggaagcctcctcagatgcgccaagccctgggaggttggggaggaggcgggtctctgcccactgggctcccagccaaacacctcatctcctaggaaggctagagatgacctcgggcctcaggctgactgagccaggactgggcccggccatgtccctgagtgctctgtccttgcaggtttggggacgacatccctggaatggaaggcctgggaacaggtatgacggctgccagtaccaacccgaggtctgcccaggtccccccaggcacacccagcacgcccggggcccattgcagcccacctcggcccccacctcccctgcttttcacttagggacccccagcctgtccatcacttcttcccccaacactgagctccagatccactggatctagagggtggggctgtccccatttgggacacttgcaccaggtgaggggaggggtttgggaaagaacagaacccctcgctgcctcctccccttcagcaagccccaccctcctctggttccctcccctggacctgctgcacccaccctccttcccccacagccagtgtgtccccagaggagggccccactccagcgtccgcacgtccccgctcagcacactgtagggctacacctgggctgtgggaaacagggccacaggggatgggggggtccctaggccgtgggatcctctctgatccgtggcccgtttctcccacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcctgcccttgcagtccctatttcaaaataaaattagtgtgtccttgcctgtctgtggcatatttgtgcatgggacagggcctgtggtggggtcacttgagttgagccggagcacatgggggaaggggtgggcagtggggcaggaggggctggcctgcttgagtgggaagacagcccttgggctcacactctcactgagccttgctggtggccccaagacacgcaatgtcaggccatggctgggtcaaggcagaaggctttggtgcacacccaggggccatagtcaacgaagcnnnnnnnnnnnnnnnnnnnngctgggtgcggtggctcacgcctataatcccagcactttgggaggctgaggcaggcagatcacgaggtcaggagatcgagaccatcctggataacgcggtgaaaccccgtctctactaaaaatccaaaaaaaaaaaaaaaaaaaaaatagccaggcgtggcggcaggcgcctgtagtcccagctacttgggaagctgaggcaggagaatggcgtgaacccaggagacggagtttgcagtgagccgagatcgtgcccctgcactccagcctgggtgacagagcgagactccgtctcaaaaaataaaacaaacaaacaaacaaaaaaaaagaaaataacaataatgaggctgggcaccgtggctcacacctgtaatcccagcactttgggaggccaaagtggacagatcatttgagctcaggagttcgagaccagcctgaccaacatggagaaactctgtctctactaaaaatacaaattagccaggcatggtggcccatgcctgtaatcccagctacttgggacgctaaggcaggacaatcacttgaacctgggaggcagaggttgtggtgagccaagatcgtgccattgccctccagcctgggcaacaagagcgaaactccatctcaaaaaataaaaataaaaaaaatacaaaaaattgtctgggcgtggtggcgggcccctgtagttccagctactcaggaggctaaggtgggagattgcttgagctagggaggcggaggctgcagtgagctgagaccctgccactgcacttcagcctgggtgacagagcgagaccctgtctcaaaacaaaacaacaaaaacaaacatgcccatttgtaaccaagatcccactcctgacaccacatccaggggaagcaagagctctgcaagctggcccagcagcaggggccctcacagtagccccctgttcacatggaccagtccattcgcagcaagggccagatctgactccccacagaccctctgggattccgcttatgtgaaagcccgaaacaggccccgctggccctggcaatgtagtcagtgcagggctgacttggggttgagcgcgccgccaggggctggaactccccgatcggacctgcggtggttcacggtcttcgatgggtaagaattccctacgctgcctctgaagattggtgtctttactgtatgaatgatacaccccgaataaaacatttactatctccccaaaaatgcactcgggagggagaggcctggaccttatctccaccatcacgagcccagaaggggtggcggccccaggggagggaggtgccaggaggtgggaactgtgcggctggggtgggagtgggggctcggaggtgagggtcagctccaggatttcctccggccccgcgtgctcctcccgccagtcccgtggcttcgccgggcgccctgcgttgggggctggcatgggggacgcggagcgagcgaagtgagcgagctgggtaggtcctgcggcgaagtcacccgaagcccgagcgaaatcaggcggcggcggcggcgcaggcagcgctttttagccgggcggaggcgccccctgtatccctgtgcgtggcggtctcggacctcggggcgtgcgctcagccccgggcgggcttggcagcgggcggggcgccggggctggggctctgggggccagcgcggtcctccccgcgcgctccggggccgtacgccgccccactgcgggcagcgagggccccgagtagccgggcggccagcaggagctccgcgccctgcagcagcaccaccgcgattgcgtagccgcccgaggcagccaggttcgcgcgcagccaccgccggagcggcgggccgcagccctccaggtacaccactctctgagctgcgtccgcatccaggcgcaggaccccgaagccgcactggtcgttgacagaggctccatcttcgcgggggtcgatgcagcaggaggcgggaaggctgcaggcctgcacccc

SEQ ID NO: 12118 - DNA, 24040 bp, Human
  misc_feature (1)...(24040): n = A,T,C or G
cccttccgtccccaccccctacccggcggcccaggaggctccccgcgctgcgggcgcgcactccctgtttctcctcctcctggctggcgctgcctgcctctccgcactcactgctcgcgccgggcgcgctccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgatgaggaccttggcttgcctgctgctcctcggctgcggatacctcgcccatgttctggccgaggttggtgccgcccccgcgccccgtccctgcgccggctcctccggcgcacaccccccgccggctggggcgccacgggctctgcagagagcgttttggttcctgccagggtggtcgatgtttagattttcccaactgggttctattttctgccatgcctaagtgtgtgtggggagtttccagcgtgttgcgtcggtcgctctgcctcggggggaccggggagcagcgaggtggacgagtggggagaaacttcggggggcgcagtgtcctctccggggaaggggagctggggccaggcgggcgctgcagcagcggggtgcgggagcggggaagggggtgtgtgtgagccggcggagcctggggaggagagaagggcggcggataaataggtaggggcggctgctgcggaacgccctggccgggcagggtgggcagcgcaagctgcagccctcggttcccagtccccaagcccggcggggctcagggccggcgcagtcccgcccgcccgggcctgcttacaggtggctgagcgaggcgagctggggctgggccaggcgtccgcaccctcccaccgcggcgtccccgcccccccatccccatccccatccccatccccgggagctttgctgtgatgaatgactttccacagcccccgtcgtgggaacttagtgcttcaggctccccagcgacccccgactctccttaaaaatcggggaggggagtgggggaggccagaggtgagggtggtctccgcagggcacggagagctgcgcgaggtggaagtttaaccctcgctttccctggaggcttcttctcccggccgccggctggatttgggcgtcttagtcggcgctagggccgcggctgggccggagcccggggtggggcgagtgtgtgagtgagatgtgtgtgcgcgtgtgtgtgtctgcgcgcgcgtgcgtgtgtttgtgagacggagagacctctccacgggttcggcccgggattccggggcgtgaaatttaagccctgcctggattaaagtgttagggctgccgtgactctcgccgacccgtgacgcattttaacttgatctttctagatgttgatctcactattaaatcagaaactttcggccccctcgctgccccctagaccttctgtaactgacaccccgggtggaggggccggagtgcgggggcttttgtctgaaaatataaaggggggggggctttgattttgcaaagggcggaacatggatgcgggtggagaatttggggtctcttccagccccacccccggacttctggttccagggccggggcgagggctccgcgggggctggggcggggactcggccggcgctcgcggggtctcctcgggcccggggcggcggcgctcctggcggccgggggcgcgtgccggcggggtcgggccgcgggcgctgaccgtgtggcctctgcttgcaggaagccgagatcccccgcgaggtgatcgagaggctggcccgcagtcagatccacagcatccgggacctccagcgactcctggagatagactccgtaggtaaatcgcgccccttccctccgcgcgcggggagggcgcgggcgggcggcctgtgcgccccgagctggggccgggcggggcgccgcgcaggagcgcaccgaaaggtcagaatccaatccccagccataagcgcccgggcggatgagtcaggagtttctcttccagtctcccacctttctctcccagcggcggccgagggctgctcgctcgccccgggattgttttcgcctttaaggaaaacgccgcgtgtgtcacacaaagttcagccgcggcctccgccaggtgtgcgggccccgcgcctgccctcgggccgggggagcggcaggatccggcccagaccctgggcgcagagccctggcccgtgcgccgggcgggcagcccgcggagcgaggccccaagggcaggcgcggctcccggtccgacgggcgggcgggcggaggcggcccccgggtcagggcccggccccctctgtaatccctgcgagctggtgccgcgttcttgccgcagggctgggcctctgtggctgcagaagccggtgtctttctgttttcacgacccaatgaaaagccttggacgcatctgctgcctgggggctatttttgcggctcaccctcgggccctggggccgggccactagagaacacagcttgtttgcaagcacagagttttgctgcgggttggcaagggttaaaggggcctctcaccccgggggaccccggtggaccacgggtgggtgggaggggcgagggtgtagggtggccgcccgcccgctcagggctagagagccccttcctagaaggcgaggtctctcttccaggcgtgcgtggcgctcttttcaaaatgagcactcggcctgggaactccagtcggagccttaacctggtttaaaaaggggctctgcgatgaacttgttaaaaagagtaactaaaggcagcagaattggaagaagttacgtgacatgaagattcttctctccctgcaaaggactctgaaaaagggggggcatgcggggattaagtgaaatcacatggtctagtcatttggaaatttgtacctaattatggtggtggagaggcctgaactattttcgtttcatgccaaaaccattttctaacaaggccgatggtttctgtagtttcttgacccaggaaatccctgggctgatccttatcgggggcggagggtggggggtgcggtagagtttcactcccacagcacagctgggcggggggattttgaccggatccctcagtggataactctagggaaaaggatctggctctggtttgtgggggggaatcccttgcctgaatctcgctggtcctggatgggtttggaaaagtggggggggggggctgcttcctggagaaggtttcagggctttttctgggggggggtgctagcagaaggggaggcttgtggagagctgggcctcctcgtgggactggctttggaagctgcagggaaatgggccattcactttctgctgggactattcttattctggtcttggcgccccgcctcctccacccccacccattatcgcctttagcattgcagcttcgtggggtatgctgatggcattcctcacccgggggcttctaggtcgtagggtccgaacagaaaaaaacaaggatgcccctaagctagtcctggccggtttcaaattccctctgcagtcatgtcccaggagctctctcctcctgccccagggaatgcagagtggatctcagccctcctgtgtccgtgagaggttttggggtctgaataggattctcctagtgtctgggaggctttgtgtgtgagaatatgggggtggcatctacctcctctcttgcccctggtgggggaccttttgtaacataggggggcctccttggtcctgtccagtcccctccccaggtgtggctgaaaacagaaccagagaaacccacagtctctcgcctgaggacaggagaggcaccggctgctcctccagcttgtagggggtgtcttttcttcaactcccgttctctgtcgtagggagggttgtaaactggttgaggtcagttctcattgggtaagcatccctccgggtcctggactcccttttcaatccagaggtgcttctggtctgttaggggcaggggacagtgcaggggctcatgaggaaggggctgggtgctgggagaaacccaacgcaacgaactttccctcggagtccctttataacccttccaggctgatgttcttggcattaggtgcctctaaggcccacgctgtaggaagcagaaaagaggctttgaggaatcccaggggtgcgccccagctatgctgactcctcctccaggtgggtggggctttgtgactggcatttggctcctcccagcatgcaggctgcgtcccactgtacagttggggagactgagccaggcaccgtctggggtcttggccgctccttgactgtggctggaggagcacgggtagtgggattcctcaccatcctcccggagcccaagcgtttcattcggagggtgtgctggagtgaagagtgaaggcttttcacctgtggcttttagatccagaggccagcatgtggtcttttaatgaccggcagcccgcgtttagggcctgtttgtcctgtgtgcagtggcagctggggagctttgttccccaaagtggtctggcctggcgcccgtggttcattgagcggctgataacataaatagccccatctcgggccagtaatgccagaccaggactgatggttgggagattctccctgtcctggagttgtccttgggacatctgtgcctaaaagacaaaagggaaagcctcctggttaactgtcctgggagcagttttaggggtgattcttgccggccaggccacctgggcctgggctgctcagagctgtgtttggtgagctgtgggcggctttggtgagcgtggtccactctcggcatcttgagctgggagcaaagggtgggcttggtagactgggagctattccccctctgtcccttgtctcaagaaatttgccagctcaggctttctgggggtcaatgagctagcacggctgccgtcttctctgtttattaagccagggctagagggtggcggggcacggggactgtgctctgtggacgcagaccacatgagtctcctgcgagccacttctggtcctgttatatttctctgggcctcagtttcctcggatgtgaagaagtgatagcacccaccgcacactcagaagctaagtcattggtaaagcagctaatgcaaacgtggctatcacaaggcatcggaaaatgggagctggtgttattgaattttctcctacgagtggagaacggacccgttactctttggtttggccatggcaagatggccaccaccaggatgtgattcataagtgtcactttttcatgaaaagaaatgctgcttgtaacagttggttgatgggaaattcttactgcatgagtagttctgttctgatcttattttgggtctcaaaaaaaattagtgtcattggaacattgagtcattttcggtaaaaagttgggctccgggcgagcttcgtctttgcctgacaccttctgtgaggtttgcgggcttcattttaaatccgcaggctcctcgggggtgcggaggaagctgaggtttctccggttggtttgtggatagtcacggatgcctcgatgggctggggagagacactttgggctgctagtcctgaacccaggaggtgcagagcccattagccgtctgggctggtgaccgggacttcccaagcttcccaggagggggcagggagatctctgtgcctctggagcatcctggctgtgaggctcactgtctccgcgcctgttcacccttggttatatggtggggggggggcaggatggagggagatgggaagagaccccccagctgggaccagggggccaaggcaaggaggcccagagccacccgcggtgcccaggtgcgggcagtgtccatgggcaggactgtgggtcctctccctactgcgggatttggagagacctgagactcccccagcctgtctgctgtagccgtcagcgcctgtgaaggggtggtgtgtgcagctgggtggggtggcggggataggttctcagttctgctccccggtcagtgctggtcttggctctgggccactgccccacctgcacctggccgcctggctgtaaacacggctcgcagatgccagcttctctcaacccctctccgcaggccgcctccctctgtcaggctgcgggaactcctccgtgtagcctccacgagaggccacgtgccctcctgcctctcctcatggccgctggccctagagtagactcatttcaggaatgagtggggtctggcccgcagcccagtctggcggcttccagtgcccctcagaggttaggccacttcttccaggagtgctttagtgagggggagggagggagacgtacaggcacctgcagaaatctcagcggcctctgcttctccctcgctccagcccccagacagaggtggggcctggcttagccctgtgcccctcggggaggtgcacggagctgggcggctcaggcccctcctgccccggggcagccctcacctgggctaccttggaggaggcaccgtaggggagaccacctgcaacctcttccccgaagggccctgcgcttcgtcacgggcccctgaatgtggggacctctgtgctaacggggcgttttctgcggtttccagtgtttcatgccctgcatctctggaaagccctggtgggaatcgaggttctcctggagggcccctaatggcgggagctgtgaggggctgtgccgccaggtgcctgttccccagtggctcccaaagctggtctgtgggaagtgcggctggacaggcccagggcacagcgcacgggcctggggcattcacggtgttctccttccgcctgcagggagtgaggattctttggacaccagcctgagagctcacggggtccatgccactaagcatgtgcccgagaagcggcccctgcccattcggaggaagagaagcatcggtgagtccaggaggccgcgatgggcagggcagggccgggtcggggtgagtccaggaggccgcgatgggcagggcagggccgggtggggaggagctgcccgctctcccagcgcagtggcctcaggcaagccacccgttccctcctccctaaaataggcctggccctggtgcctctggctctggcctctcccgaggcctccctccttcgagggtgtctcctgcgccagcccgcctgctcctcctggagtcctggtctgggccaagagagcttccaggagagaagagccatcataaattccttaagcgccctgtcttgtcggggcctgtccccaggagccttgccggaaacgtggtcgcgcctaatttccaattcgcagtgtgggcatcgtgctcctgcgccggctgctgaactggtggggacgcgcgtgctgtgtccggcggctgccccccggcaccctcaccacacccgtgtgccccgccccactcacacctggctccagggctccacccccgcgtccatttgggggatattttgtcccttcttacaggacagccccatggccctccagccccctgaggaggaactagcaggtttggggagttcaggggccagtccctgctttctacccaagtcccgcgtcctcgggggtcccacctgatgggtttgagccctggtgctgctcatggctctggggccctgagcaggtggacccccctctctgagctgtggtttcctccatgaagatggattttgtatcttccaccttaaagtgtcatgtgtggctggctagtcccagctgatgcaagcaggccctccccaggtgacatttgctgtggggtctgcattttgcacccttcagaccacttttgaaggctagagcatgcagcaagtgctgtaggattcactgttaaggccccctcctcccccagccactggccccacctggactaggttcccctctgcccctccagccactggccgcacctggactaagttcccctctgcccctgccacccccagtctctggccccacctggactaagttcccctctccccacccccagccactggccccacctggactaagttcccctcccctccgaccactggccccacctgtccaggtccctccagcctgcaggcaccgggctgggctcctctggatgtgtggtgctcctgcccacccagcccctgagcctctgctcccagctcagcctctgctgcctgggaggaatcctggcctgtggcttaccctggttgccccccaggcccagctggagccgcctcagccctggggtggggccgtggtcgcagaggccggtccccgctcactgtgcccccgccgttgcagaggaagctgtccccgctgtctgcaagaccaggacggtcatttacgagattcctcggagtcaggtcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccacccgagcccaagggccgcccctacctagcagccagggtccctcccgcgtccaccaccgcagcgtcaaggtgagccctgcccctcccctcccctccccacccgagcccggggccgcccctaccaagcagccagggtccctcacgcatccaacactgcagcatccaggtgagccctgccccacgcaggcctgagggtcgcccctactgggttgccagggtccctcctgggaggccacaaggtgcccctggtgtggctggtgggggtgcacggctgcgctcccatctccctggcaggtacactgaggcccagggaggagaaggagcacctgggggtgcgggaaaggcagggccggccggggcttctgctctgctgctctggcgacgagcctggcctcctttccacgccctagaccacagtgcgggggccgttttgggccttgcgaggtgtcgagctgcttagccggaagctgtctggcgtccccgggccctggagggtcctgtgcgggctcttcagtgggggccgaggtgcatggcaggaggagtagggggtggatattcagagcctgcattgccttttgaagtgcctgacctttggagggcccccccggcttcccccctaaagcagcccaggagaaggagaaggagtgcttggggtgggctcgaggccagacagcagacttccttccgtagaatcccagggtgagcccctctttctttaagttgggggtggtgcctgccttcttcaggctgctttagcagaattccatccactaggagctgattagcaacaaatgtatttctcaaagttctggaggctggaagtccaagatcagggcgccggcagactgtgtctccgctggagccgtgttttctgggttcatagatgacaccttctcgctctgccatcagtgtgaggggcgggggatgaacatgctccctaggctgctttcgaagggcactaattccattcatgaagcctctaccctagaaactaatcgggccaggcgaggtggctcacacctgcagtcccagccaccgtggaaggctgaggctggaggatcgctgagcctaggagttcaagaccagcctgggtaacatggcaggaccccatctctacaagaaatacaaaaattagccaggcgtggtggcaagtgcctgtcgtcccagctactctggaggctgaggtgggaggatcccttgagtcgggaggttgaggctgcagtgagctgtgatggcatcactgcattccagcctggacagtagagcaagactccgtctctaagaaaaaaaagagaaaaaaggacttaatggctaccttaagacaccccacctcctaacgccgtccccttcatctgggatttcagcgtaagaatcctgggggtgctggcgttcctgccacagcagggccttcctccctggggttgcgctgggggaggaacagcacccgggtgaacttgctgaaggtcttcttgcgttgctgaggccctggggctcatggctgggccccttctccctgctttcagggaagtgtgcccagagacctgcaggatgcagcgccctgggtgggctggctttggcctgtgtttgcgcctctctggcctcattttcctcacctgtgcaatgggtctgaggcagggcctggcccttctgggagagccgaggctgctgccatcttgtttgcaagggaggtttcctgcctgttggggcatcagtctcccgttttcgggatggggttgcagggtgagtgtctaaggtatcttctagcttctgtgaggcctggctggggctggcacctccctggggctcccatctgggagggatgggctctcttagggctcttctccctggaaactggcttcagttgggttaaagtgctgttgatgctcccacctgacctgcaggacccatgagtttgagcagtgggcacaggcgggtgcggcccctagtccaggaggctgttgctttgactcagagcctcctggcttggcctcagctgaggatttttttttttttttttttttttttttttgggacagcttcttgctctgttgcccaggctggagtgtggtggtgcgatcatggtttgctgcagcctcggactcccaggctgaagctatcctcccacctaagcctcctgaatgctacaggtgcatgccaccatgcctggctaatttttaaattctttgcagagtcggggatctcgctgtgttgcccagcctgctctggaccccctgggctcaagtcagctgaggatttggtgacagctgagcctgcttttcctggaatatggggtcactgaaatgatgtttgaggatttaagttttggggctacattagtaaccattctttaactttagaaaagaattatttcacacccccgccccccactgttgtgactcataggccccggagggagatggggcgggggggagaaggttctccgggaaggactttgcagccagccgggtcgtttcctcgtcacacgaccgggcactttagacccataactgggacttatcttggcctctggggacttggtcctctgaggtgctgggtattgagtaagcagattccacatcttactacccgggatctccaaggccactcactccccttttgaagccccaagatttttccagggccctgggagtgcttgtctgcggcactcttctgtcctcaggatatttaccgccggggggtcagggaaggaggggaggggagggcctaactcaggcctccaggtccaggtgtggctgggtccccctggcatgagcccccctggcatgagcccagcaccatcccctctgtcctgtgtgcctccctggggcgcagtttctgcctttcggtgggccttggcatcctccctggttatattttggaggcccttgtgagctctgagtccgggatgcctgtggtcttgttctcattagagattctcatgtcagttctgggtgctgggggaggcttggaggtacggggagaggctctcagcccatggctcagccttgtgcagcccctgcccttcccaccctggcctgtcatggggtgaggataggagggcttggccctacagggcagtgttctctccctcccccggccccctgaggaggctgggtggggtctagaggcttccagcaccctctggccagtgcagtgttgggggtgagggccagttccccgctgggagtggcccctgctttgctctgtgcagtggtagagccaggaccagggctctccctctgggtctcatctgccgggacagggtgtcctaaggcctcagggctgtgtcctgcagcagagcctggcggcccagttcccacctcctcagacccaggcccccttcatgttcccgcttctgggaggcgtcttctccctgcccacccatccgagggttggaggaaaacatccggctttggacccagggggctttggctgaggggacaaaggtcagagggaacaggaggcccattttggaggctcagccaagagaccggtcctgccgctgcggatggaggcggctgtcaacctggcgaggagatgggccccagagcctcagactctgtgcctgtgagtgggcatggatggggtcagctgaggtcaaaggggttggggctggccgggaggggcccccaaagtctgtccacccaggatgggcatggcatcccccatttccagtttttatgcctttccggtcaacattcagaggtctcttgttagaagatggatggtagtgaagctgggagtgtcactgcctggcacagaccctgctgggatcaccaggatgtgactgaccggcagccctgggggagtgactggccggggtccctagctgggtgggtgtttccttgcactctgcctggcacagttagctcttggtgcctggacgcccgactctcccccagacccaagcctcgggggtaggacaggagtgtgggcctgaacgtggaccatggggatgagatgccagcccgaggactgcaggggtctagcctggacggagctggctctgagcccaccttgctgtgctggaggcttccagaaggtgtgtgctcacctggtgcttgggatgggcctctgctccctggaacagagtggctggggtgttacgggtgagaagctcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaagctccatgcaggcattcatggccgggctctgttctctctggcaggtggccaaggtggaatacgtcaggaagaagccaaaattaaaagaagtccaggtgaggttagaggagcatttggagtgcgcctgcgcgaccacaagcctgaatccggattatcgggaagaggacacgggtgagtggctgccttcgtcggcatcggtgttggagaacaggtcttcagagccttgcttttggggtgttaggtggcccccttgagcgcaacgcttactgctgtgagcatctgggctgctgttgaaggattcgttgccctgctcccgggccagatgcctgcgggggagacggatcccacacctgcaggtgtccggtggggagggtggcccaagctgcggcactggcaggagaggaggttcaggtctcactgagaggggctgggagtgcataagacacccaattcattagtgggctgcggggctgagctgagaagaatctgcagaagggcctcctgccagggtgggcgggaggagcaggttcgaggactgcagttgccctggctggctggggtctctccttcaccccgccacgcggactccacccaggagcagaatggcttctgtgccctgctatggctgggccctgggagcatgaggggactcagaagtttctcggtgccagggtgctggccttctcttctggaaagataaacaaatgccgtaggtatttgttgcttcagttcttcaccccgacggccgtccctcggcccactcaccgccctgcccttttgttaacaggaaggcctagggagtcaggtaaaaaacggaaaagaaaaaggttaaaacccacctaaagcagccaaccaggtaggactgtctgccggacacactgagtcctgcagggcggggaggtgcaactgactgatcacaccagcaaatcacgcttcctgtctcgccgggtgcggcggggatgtggccctgattggccttgatggtgtctgctgggcttgggtctccttgctccccgtccgctcctgcctcgcagaacgccctggcccgtggctcactcccgcttgggagcctgcctccagctttgtccttctctttgtcgttgattggggatgcaggagcattgcacatgaatggaacaggttgggcgacctgagcagcggtggggcagctctgagcgcctggccactctgggatcacccaccccatttgacagatgaaaaaactgaggcttaactgagattacagataaggactgttggaggctgaatatatctggaaatcctttataaacgtgcagggctgttggctactgtgttggaaattgcatttggctgctagtaacaccagacagcacagggattgagataagatcgagcttcatgactttcatctaagggtgggattgcagagcagggagggtagtcttgaggtatcatcagtgtccgccttctgtctggctagtggcatccatctgcagttgcctcatggcccagggtggctgctaaagctccagaaaccacatctgtgctccaggctggaagaaggagtgagcgggggggggggggggggggggaagggcaaaataacacccttagagagctatcctggaaatcccacccagtgacttttgtgtttttctcagctgccatccctccactgcaagggagcttgggaaatgtctcctagcaagacatgtcgcttcccagatggaggtgggacctgggcagccgccatcatcacggaggaggcagtttcaagccttcctggtccttggcattggcccgtctggcttgggaaagttggagccctgtctggcctggttccccctcctggcacgtgggactccatggtggccaaaacaaatagtttctttagaagagaggaggatctcagagatagggtgtctgagaaccctggctcctgtttgcaatgtgggacttgggcctgcgggtgaggtccattcatgaggagcctcttgggaggaaattgtccacttgggcgggtctttgaagcagtccaggactgttggtcagccttggctttgtttgctgaaagtgtggcctggtgggtggttttgtgcctgcctgtgggtcccatttctacagagcgttaggctctggcctccatgggcctgctggtgacagaccccatggtgagaggctggcactcctgttgtcccatgcctggctggtactcatgttcagcctataggcagcccacgtgttggagtgtgcgatggagaggccacatgggatgtggaagaattgttcttaagcgatcagcataggtctgcctgggtgcagactcttctgtctggctggtggcctccatcctcagggttgtctcatggcccaaggtggctgccagagctccagaaatcacatctaagccctaggctggaagaaaggaaggcagagagaagggcaaatgagccattcttggcctcagtttcccccatctgtacaatgggagaatggggcttggtctctagacatgttctgtgagatgctgtgagcctaatcccaattcctgtcagggtactgcaacatggccaatgtggcaaatgtgattctggaaatttcatgaaaacttgaaatccctgtgtgcccctgattgggttaaatgttttcaccctgttttcctcctatgcagccatgtgtgtgctgggtggttcacttggtcggtggtctcagtgtctgtctttcccttctccctgcagatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagagagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcaggggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgttttttttttttttttttttacaccataaagtgattattaagctttcctttttactctttggctagctttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacttaatattacctgttttgtatacctgagagcctgctatgttctttttttgttgatccaaaattaaaaaaaaaaataccaccaacaaaacccgtggacgtgagaagcgttttgtggtacgtttttctagcactgagtctagaccctggttgccaggtcatgcggtgctgtgttgggtggaaacggaggtcagagctttctgggtggggtccctggacctgcctccatggtggcacccgtgggatgcctgcctacctcggacttcagcacctatgggggttaggccgaggacatcctcctgcaggctccactccctggagcggatgaggagtgtcagagtagccagaagaccatgaagagtttcatccaagaagggagcccacctgacttggtgtgtccatgtgcagcactcaccataccctgcccgggctggcccctccaccacctccaggcccacgagacaaaccatcgaggttgctttcaatcttgaccccgcgttcttcgaggaccatctgtggactggcggccggctggcgtctgttgtccatgtgctgctggaatgttcttatgaaggattatcttcaacagctcatcttcatggtgctgttttcagcctcgtcagggcagcctggaggctggaggggaagtgcagggccaggtggttgcaagctggttcctgttccttggacacctgctggggccctgcctgggcctgtgggctgctgtccagatctgcaccggttacagcgccttgcccaggaatgtgcattggatgtgacgtgtggcaatgtaacatgtatttgtttccatgagatgctggcgacaatgctccatttttcttttttgtataaagtcgtctggtgtaataccgtgtccattaaagtgatggggcagaaaagccaggtggggaagagagaattccataagaattccataggtctggagcccaggggtggctgaggtagcagtagaggtgggaactcaggcctgctttctctccctacttactccttccctccctcactccctccttttctccctcattggttcatccatgcaggcgagggccctagtgccagcccctcctgtcccgacatggggagagccctggggaggggcaggcagagtggaggccactccagccaggaagggctgcagtgtggcgggggctgtggtctgaggctggatcctttccgagcctctccacccacgtgggcctgcagcctttgtcgcggctctgccctgcgttcccgggatttctgctcctgcctgggccccctcccggcccctagccctgggctgcacctggatctgggctcaggaaggtgactttctgcccagggtcagctcttcatgtcttgtgagccctgtgaccttgaccgaggggcctccatctgcatgtcggcgtgcacatctgtgaaacggagctgcagctcaggcagggtaaggacgtctcgccattgactcacctggtgcaggtcttgtctgctgcctcctcctgctgggacttcactccagcctctagtgtttctaggccccagcatggcagaggacagagcccttgggctcagggattgctgagcggcgatggtgccgcctgttaaaacgaggttcctgcacctgcctggacacctgaacgcacctgctcacaccgtgcccttgccaggggtcatgagagctggggcccagcctttgctgggcttctcctttagcttgggggtgtttccttttcttcacccaggcctctgtgtcctggctgtggagggggttggaactggctgggagagtcagtgacggcaggtggtctccagccgtgggtccctacagctgtcttgggattcccagcggtaggtgaagccgaggcctgggtctttgcctgggtccagtgcgcagagcagttgctgggctgggccaggctcggggatcccgttctgcagagaagcccttctggtttgtgccctcttgtcaagcacaagaagccacggccctcctgggacctccttggtttttttgggcttttcatacttagccatgggttcctccaagaattctaggggtgggaacttgagggcttggctcccatttt

SEQ ID NO: 12119 - DNA, 18864 bp, Human
agatctaaggagcccttgaagggagcctataacccagcttggcaggatcaaggaaggcttccaggaggaagggatgactaagcagctgagacctgaagaatgggcaggtgaaggtgggaagaaagaatgatccagacagaagagatgcatttgcagtggcttagagattagaggctggttcaaggcagcagacaggtatggctgggagctgcatgggggaatgtagagagaggagtctggagaattaagcaaaagtcaatcgacttgtgacaactggaaaggctccagtaagaagaagagagccattgatggcctagcacagtgcctcatacctgtaatccctgcactttgggaggttgaggcgggcagatcacttgaggtcaggaattcaagaccagcctggccaacatggtgaaaccctgtctctactaaaattacaaaaattagccaggcatggtagtacatgcctgttatcccagctacttggaaagctgagacaggagaatcgcttgaacctgggaggagaagtttgcagtgagccaaggttgtgccactgcactccagcttggacgacagagggagactcaatctcaaaaaaaaaaaaaaaaaaaaaaaatagcccattgaaaggctgtgagcaaggaagtaataaggtcagatttgcagttgagaatgatccctgagtctcggttttcttatctatgaaatgaggctaagaataataaaatagagaattaaatgagataatgcctgtaaacagtgcctggcatatagcttattattcatccagctaagaggcccttccatatgtgaagctttgctctgtgaggtctgtattacaatcacattcagttatagctaattatttacttatgtagctatctctgaaacttagaaatgaaatcatcgaggaaaaaggccatttcttgatcctgtctgtgttccctgttcccagcataaagcctaacacgtattaggctaatgtcaccgagcaaagaaagcatcaaagtggcgggtcgggccctaaacccacgatgggagataccacattcggccacaagagggcgcgtcacattttctccaagagaagctgggccgctgatgaaggacgggctccgggcctcccagagacacttcacctcctgggatcttgctctaaggaagcccggtgcgaaggaggtggctttctcaggtggtcgcgctagatgtccaaggctttatgttcggtcagatgagctgtataataaaatgaaagtgttaactggcatggacgatagctgctgcctccaccgccactagtagtgatggtttttactctggatgtttttcagttggaaaagcaaactccgccttttcctgagccgcttggatctttgtggaagcgggtgggctgcatatatacaggacggattcgtataggcttgcaccctggttccgaattttgcaaatattcgcagtctgggtcactgtcatccggactgggaatccccaagacccgttaagggaggataggtaacgatcatgacaggtgaaacaggtacctttgagttggagaaaagggattggttgaaagctacctagacaactctggaaaggaagggttaaaaggagcctgcaggtgaaggagatgcgagggggtagcaagggaaaggcaggcgtggaagaggaagcgaaagggctggcggggctctgggaaggaaggggttaacccgggcttcgccccgcggaggaaagggaggagtgaacacaggggaggtgggaactcggcgcggcctccccaaaacaacaggccgccccggcaaagcgtgggttaagggggcgggcccgggggaagccacgtgccggggcggaaggctattggttcgcccggagttgtttgtgagtggccattggcgacgtcgaggcgccatgacgagccgattggctgggcgttggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggtacggagtgggcgggaggcggctggcagcggaggccggcggggcgctgggaggggcagccgggggctagggggacggaggagaagaaaggccccgagtgacagagaagggttgtttggaaaggtacaggcaggaaagagttaatggggaagcaggaaccggccggggcctctcgacggggctgctgatgggaatggggggcatttacaaggacggtcccgaggtttcttcgtgggcctcatgaagggtcttgaagagtaaggggcagtgaagctgtgatgttactgcaggaagggagtagggtggtatccagacgcgaaagggttaatgggagttgtcctcatgactggaggagtaggggcccctcctcccaccagaggaaaccgggggtctgctggtgggagtgaggaggcagggtttagaggtgcagccatctgtagagagacctggactgggcatgaagggtcagacacccctgggcagagggtgagattaagccaggggcagttggggaagggggctctttcagaagatgccattgggagacagtgccctgactggtagacatccacccacagaaggagctggaccctagctgccccagtgggcaaggacacttgaagatcaaatctgttccggcctggcagcctctccccagctgggcaggggccccaggcaccgtgatgtggagtcaagccgcctatacctcccttggctgccccagggctgctaggtcaggatcgcccactaccagcaacctgggggtggccctggggcaggagggaggctgtgccaacgtggcagctgaaatgggcattgtgtgggccctgtctgtctatgtggtatttccatggtgccagctggggactgggggtggggggcagtctctcaagagttgagttgatagtgcctagcttgggttgcagctgcgtcaatgatgggacgggaacagagaggtggcagccgagacataaggcacctgttcctcaggacttgtctgcctgcacccctgccctgcctgagtcttgagcctcccccatgtaggaaagcctcctgggcccacccctagcccccagcagctgtccccacaaactgcaccctaattacagaaacatcacagctgtgaggggctcacagtagagtttggtcaacttgtagtactatgggggaaactgagaccttcaaaaggatgatggcatggcctgggtgacagagttggaagcagagcctgatggactggaacccagggcccctgaccctgggccaaggccatattcggtcccccaccctttccatcttgacaccagacaaggaccgaggcatttggactcctgttctcaggcccgtttgccccatggatgggcattaagacacagcagccccacatgggcattcaggccaggctgggtgaggtgggctggccagagacaacactgggagcctgcagtggtggtctagccatagcccccctcagccagagcccagtcctaggtagggatgggtttcccaggctcctttgccccctggaatcagcccctcaaagtgagtgtgctgggagggaaggaaagagaagtgaggtgactgaggccagaggcagctccaaatgggcccaggagtggccctgtccactgtggttaaaggcaagcagggttcagctggggatgaggagaggatgacacctcctgaagtgttaggcatggggtgtaggtgtttgagccctgcaggggatggggagccttgctgtgtgccccgggcaggtcacttgctctctgagccccctgttaatgaagggtttagctgacctggccgagacatcctttggctttcatagtctgtggctctgtggctcacccctctttctcctgccaggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtgagacccctggctcagtccctgcacctcccactccatcgccagtgtccctgggctcagggatggcatctccaagcttttagcagctttgagggtggggtggggacagacaggagacaccaaagccccaagcgcttggagttgcctagggtcacgtgggaatctgaggccagagcaggactgaggtcaagctcctagtctctgtgtctagccctcttcttaccacccacctttctctggaaacacaggatccacctaggaaagcatggttttcacagccaaaaccccaattcaggctgatgtcagcattagccagcagcccagacctggaactccagtaactgttaggcagtatttatttgggggtaactttttgggaagcagaaacaagaagtaagttttcaaatacattatataacccaagctgcaagacagactgttttggatgttggaaaatactcagatacacacaaggatggcacagtaccttcccgaagagctttggaggggcaaagaccaaacgtttattgcgcactgcagcaggaacagagggaaaggctcagcagagttcactcaagaactcaagttaagtaactggatgaaattagccaaaggccagtcacgtgaagaataaacaagggtgtcccttgtcactgggcatgtaaatagctaatcctcattgactttggtggcacccttgcagaaatcttgggctggttcttttggacttgcagtatgatatagttgtgatttccctgtagactgaggagcacgtgcccacatgtattctgagctcaaagccatgcgaagtcacagcagctgccctcagaggcctgtgatcttgagggaaaaataatattcacccaggcagggtgaactgagtccagcatagtgctaggagcagggagctgccaaagagttcgttttatttaaattaggaatccaaacattattttaaaagaacactgatatttttccctcattgtggaagtgtaacaggttcacttgacacttgcaaaatgcacaatagtagatagaagaaaatgccaaccactcccctccaccccctaaccgaacacagttcagtttcgtcagatgtagtggtgcctttccagcgctgttttctatgcatggacctgtggatatggggcttattctaattaaatgagatatggtgaggggcagtgttgtacacacaaggctaggggtgtagtgggtgcaccatgaatgtttgttgaatgacacgttgtggggcagttgctatggacatgcagaggaggtgacttgtcactggaccttacagggtacctaggcaagctgagagctaaaaggaagggaagggcattccaggctaaaggaatagcctgggcaaaggtgtggagacaggaaggggcctggctaagggagctgagaactgactttctggagattgtgctgttagtgtgggctgtgaggaaggggtggaggcatgaggcacagagcctgatcttcatggagcccaaccaggtcaccccttgctgtgccttgcctctcggaggtccaggacctctgagccaaccaacacttcccatcgtgggtggtgtggagtggtgggaaggagacagaaggtaccatctgttctccctggccctcctccggctctatccggctgcctgacctggctgcctctccacctggtccctgactccagggcaggacttctcaggcccctccctggacaccgtgttcctgggagagctgagggatgcaggaggagggcaggggcctgctgagcttcccatgactcccccaggggcccctgcagagtcccttcctgaaactcagtgacacagataagaggttggcctgacttattcttccgcaaagcttgcaagtaatgtcaagtaacagcaggagggaatgaagttagacaagagagaacacttcctcaatgaaggattcagcttaggccgggcgcggtggctcacgcctgtaatcccagcactttgggaggccgaggcgggcggatcacaaggtcaggagatcgagaccatcctggctaacacggtgaaactccatctctactaaaaatataaaaaattagccgggcgcggtggcgggcacctgtagtcccagctactcgggaggctgaggcaggagaatggcgtgaacccgggaggcggagcttgcagtgagctgagattgtgccactgcactccagcctgggcgacagagcgagactccgtctcaaaaatgaaagaaagaaagattcagcttagaggagagcaggccgagggattgctaaagcatcccaacgcgctgaagagacagcctgccaagaatgtttccagagagaatgagcattggctacagcaagagagactgaggtgtgaagacaagaaggacttcccgacagggttgaggtggctgcctgtaagagagtggagacctctttctccaggagcaacagcctgccagctggaatgatggagatgggcaggttctaggtgcctgagaggaggggggagactttaccagggagcttggcaagagggcctctagcctgagtttgatgagtaagaagcaaaccctcctttctggaaaacacaagagccctcggcagatgcagttattagtggtcatggttcatctgtggtcatagaaatggagtttctactcagctggggagaggttctaggcagagtcactgggcaaggtgagaattcctggttctaaataaacctgatacatttcaactggacagacttgtgatagtgggccctgttttggtggagactggacggggagggaaagtcccaggtttggcctcagcatgtgtgactttgaagcttcatcctgggcaagccacatggcatctctgagcctcagcttcctcatgtgtaaaagggggacccattgtgtttgtaagggccaaaggccagtgctagatgtgaaaagtgtgcagaactctaccaatacaaggcatatccccaggctgccgggcagcaacacctccagcccacagaggatgtaattgtggtgtggcttcttgggcaaggtagtaataaatcatgataataacaaaagcaaacacctccaaaggctggctgtgtcccaggagctgtcctaagtgtctacgcgtattaactcatttcatcttcgcaaccttatgaggtagtctttgctatcatcccattttctagatgagaaactgaggttcagagaggtgaagaaccttatctgagatcacccagggactaggtggtggaattgggattcgaacccagctgttggatttggagactggattcttgaagggaaaggagggagcctgcactctgggcagtgatgtggagtcagagatttccaagttcatggtgcaagtctgtgggagagcagaactcactttacaaaattgttgacagccggtgttgttagagacggaaagggacaaccccggctcctctccaggcgtggagtctgtggggatgtgcttccagaaaatgcagggttaagcaggagctgcagagtagaatcaaatgacaatgactcactgctgtcactaacaggctctttgtgggggctgtaggtgggaggcgatatggccggcaccttcgcacaaacctcccttgcccgtcagcaaggtgtgtggaccccatacagggggtgtggcttgggtgcccaggacctgctaaagccacacgagctctccaaacccgtcagccgctccttgcatgaccgagcaggaccgaccacttactgcgcatgtactcgaggcatcatcttttctgtacacccaggcccatgaggtgcttactcccatgaaccccattttgcaaatggggacccgagggactcggtggcctctttagggcacaatcagcagcggaacccaaacctgcctggctcagaggctccggaggcgggacaccgccacctctcccccaagtgcagcgagcaccctcctccccagcctttgccttgtttacaccctgctccccagcagctgtggatacgagtgcacagggcacaccctcgcacacacccacaggcatgcacatgccacatgcacacaattacacacactcccccgctggctcagcaccccctctgctcccacacagggctgcagggccctcctcccactcactcaccctctcctcccgcccccaccgcccattatcagccccacactctcagcaagcctcctggcttctgcctgcatccacccctcctccttctcattcctggggctctggactggctctggagccctggaaagcagggtttgggtggatctccacattaccttgggctgggcttgggagctccggatctcaccaagggactcctgggggccttgattactgcagaggtcagcaggcccagagaccccagcctccctgcaggtcctggggaggggtgggggcaatgcctctcccgcctgttggtgcctgtctgtcactgcaccactgcttcaggcctcccttatataagcccagttctctctctggcctgcaaggggtgggcagcccagaggccagcgccactcgtccccaatctcccttcttaggatcaagaaccggcccaaggttgacatttggtgcaccaggcccctgaggggcttcagggcaaggccagggacctcggggaaaatcctcatcctctcccctccattccaagagtagcctgggccccttgccctggaggagccctggccctgtgagggaggctggcaggcgctgcccgctgtcactccatgccggtgccctttgctccacttcagtggccacgtgaccaggccccattcctgccctctagggttgttgagcagccacaaaaggggtggtgccagcagctggggcactctccctaagtgagactgggactttgaccatgcccacccccacccactgcccagcacagtcaggaagtggcttagcctcccagctcccacccgcttcatccccacctgcctcctgggaaggggcctcaggccccactctgcagtgggtctcctccccctcctctccccacctgcccctagcactgcctgtgtgcgggccctctctcccctaagaatcatatgagcatgaaggtctattttgggtgcgtttagggagcaagggattcggagccacataggcctggatgagagaatctcagctctgtgtgttaacttcctcatctgtaaaatgggtccagcagtagcgcccacctctggggttcttgtggaggtgaaagtggggcaggagggaagcacagggtggacctggctattggtacccagtaaatgccaccatcaccatcagcagcggcatcaccgtcagggcccgtgttggccgttggccacgtggtgtagacttggagtctgcaagagctaggtttgaatcccaacctgctgcttactatgtggcctggggcatatcactaacctctcagtgctggtctcgttgtctgcaaaaacagggaaataccttgtgctcatcaaggctgttggcagatgagagaccctgtgtgggactcggcacaagtgggtgttagtggtcgctatgttcttctccagggagacaggtgaggtcttaggagtgccagcctgattgtctgctggggtggcagggatggtgatgggggctgagagaaaggctgatcttttctgctgttggggcccccagccccatcagcagccacagctcctcctatcgggctctgtgcagagctctgggtagggaggggtgggcggtgagctctgggcctgagacagcccccttcgtgtggcagtggggcaggtctccagggcacaggggctccaacatgctgtgattcagagcctacaagcagtgggagagtatcagatgctgcctgggggctcagaggatgcatgcagctgttgacagtgtttgagccaccagccataataagagcaagcattagagagtgctcactatgtgctaggcactgtgctaatcatcacatggaattctcaccacaaagcagtcataaatagatataacaatccccattttcctaatgagcaaactcaggcccagagaggttccatgacttacccagagccacacagctccaagtgcttaaagagccaggtctgggtccagagctggttctttcactctcttctctgtcaggcaagagcgagaagagcagcaatactaggtttaaggggaagggcattcctagcagagggcactgtgtgaacagaagcgtggaggtgagagtcgagcagaatcagcactctggagtggcaagagcgctggagactcgggggcttcatcatcccacttactagctatggggctgcttacgcctccctgggggaggctgtgcgtggggctgattcctgcctgtctgcctgttacaggttacagtgaaggccagagcactgtggacatgggaatgagtcctcgtgtggaggggccttttctagaaatactgttgggcccctggggcccttggcactgcagggctctaggtagcgcccccccttcctcctggttataagtgtttctgccagagagaggctcttcctgccttccccaaaggaacaagccacagactggacatgttagcagggaaacaggtcatggctccccagggcacggggcacagtggctccagcttggtaccatctgccaccacaggtggacctgactcccttgcagaaggaggcctgctgctgtccctgagttcagggcttattttttggggggacagagtcttgctctgtcacccaggctggagtgcaatagagcgatctcggctcactgcaaccattgcctcccaggttcaagcgattctcctacctcagcctcccgagtagctgggattacaggcatgcaccaccatgcccagctaatttttgcatgtttagtagagacaggtttttgccatgttggccaggctggtcttgaactcctgacctcaggtgattcgcccacctcagcctcccagagtgctgggattacaggtgtgagccaccacacctggctaagttcagggattcttgatgctccttttagagcatcaagctcttctcttagcccagggaaaactggcctccccatcaggcctgtagatgggaggaggtggcagggcatcacccactgctacctggccttttgcagtagagtgagcttctctggactctccatgggccccagccccacctggggacagagccaggcacgcccaccccacctttgggtccttcccacctgccattttagaatccacttgccgaggcaggtgcctggcccagatcaccccagctcaggggtcactctgggaggccccgtgctgtctcctctgccgggggtcactccaggaggccctgtgctggcccttctgccattgtgcccactggatgcaacaacaccccggcggggagaaacattaggagctgtttccacactggggctcagagaagttgatgcacctccctgccttcccccactgcaggcgctaggtccagtctccctgccccatctcagcctcagtctcctgatctgtgagtcctcttagatgggatcatctccaagccccttctgagaggactattctaggattccaaagcaaaggtgctaaacgggggaccagcaaatttgaagttttcttgcataactgactgggttgtcagggagactcacatacaaatgaaatggatggagaaaaatagtgaggcggcttgtcggcagctctgtgtggggcccgcgtaggagcaggacaagagcaaggcccagttgaatgaagtgggtgaggaggggctagccacctgaagctgaggctgtgtcccctcccgcccccacacaggtatgtccagagcctcctggacatcatggagttcctggacaaggatcccgaggaccatcgcaccctgagccagtgagtgggggccctgggtggggcaggaaggcaggtgttggccaggggcatctggggttgcagcccctggggcagaagtacagcaggatggaagaaaagacccctgccttcagaaacatccagtctgagtggggagacagactctgcttcagggagccccaagtttgatgggagagacatggactccattctcactgttccctgagcccggtgggcaagacccaggccctgccatggggaggatgagaactctgggctttcgagtgggaagcctgccggcaggcagctaaaagatcagagtgggctttgggaggagcagggagggcactgggagtccatcggattgggaagggtagagcgggtgaagacaccgtggagaggggagtcagaagcggagaagagtctgggggtgtcccatgtgaacatctgccctgccccacaggttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacagtgggtgccggccacagcggcggggagcgggcggtggggggggcggtgctggggcccagggccgggctgctgaggggacctagaccactcttcagaaccccacaaagggagtctttgaatagttactccagtaactatggagttaatggctccaacatggaaaaataaaatttttctttctcattgattttccatttcaaaacgttttgttttcagtgtttgcaaaatgtaaaattatgtcacatctttaaaagaatgtttaatttagtatttataaaaactctcattatgttcaaaaacaacttgttgtttagagtttcttattccaggaggattcactatgattttttgagaagttgtagccagtcataaattaaacaagttcctcatgctcaaataatttccaaagcaaggtggtaagagttctcttagaatgttatagtcaaagaaaagaataaatgcaatgtggagatgtgatgtggggagagacctctgaaaagacgtctgtttcaggtttgcaaaggtttaaaaacggcctaagccagggctggaggggtcaggggtcagggaagggaggacagaagcgggggagtggggcagctttaggactggagcctacagaggcattggaggtgaaagtagaaagaggaggaaagcccgggggaagagggagcgctgggacagactgcagcccagccaacagcatcctcccttcctgcctgcagccctcatctttgatggcagcaccaacccagcccatcccaaacacatcggcagcatcgaccccaactgcaacgtctctgaggtggtcaaaggtgagccattcccacggtgcctggcccgcagagaagccccagggacccctccaagcttacctggccagagggtgactcgttcctcagtaaggggtgccatggatttaatgctggtggtccccagtatcagtgtcaggaggactgcctgctgggtgggccacccatgccctgaatgaccccatcttctctcagatgcctacgacatggctaagctcctgtgtgacaagtattacatggcctcacctgacctggagatccaggagatcaatggtgagtgagcggggctgtgtatgtgtctgtcttggggctggggacgtggcagggcaaggtgagacggggagtcaggagatggactgttttctagacaggggagaagcagagttattatattattaattcatttgataaatatttgggctgggcacagtggctcacacctgtaatctcagcactttgggaagctaaggcaggccaatcacttgaggtcaggagtttgagaccggcctgggcaacatggtgaaaccctgtctctactaaaaatacaaaaattagccgggcatgatggcacatgcttataatcccagctacttggaaggctgagacaggagaatcacttgaacccgggaggctgagactgccgtgagctgagatgctaccactgcactccagcctgggtgacagagcgagacttcatctcaaacaaataagaaattgagtgaatgaatgaatgaaagagtaagcaagacagaaatggtccccattctcgtggaccttacatttttggtgctagggagattgcggaatggagccttcagccaattaacaagtaaataaacaagaccatctcagatcatgacaagtgatgggaaggaaataaaatggggtaactcaacaggggtagggaggaggggcatgttagatggtgtatcagcttggctgctttcctagaaccccaataccagtggcttacttaagagggaggtttccctctcgccagccccttgctggacaggtcagggctggctccccacccctgattcagttctagcctggaggaagggaacaagggtgtggaaagcagggcccaagaattgaatgcatcacttccatgagtcaccagctaccccagctcaagggaggctggggatttagtctctcgctgggcagccatgtactcagaactttgtgggagggggtgcctcctttgggtaaggtggttgagcagtgacctcctgacggtttcctgacccttggtcttgacttgccctgtagcagccaactccaaacagccgattcacatggtctacgtcccctcccacctctaccacatgctctttgagctcttcaaggtgaggaggctgggagccggtgctttgcggggagcgtgagtagggctggcttctcccatgcatctcttacctctgcccctccgcagaatgccatgagggcgactgtggaaagccatgagtccagcctcattctcccacccatcaaggtcatggtggccttgggtgaggaagatctgtccatcaaggtatgtgaccctttgaccttggggaccagggagcagtagtgggggcttccctcctgccaggagacgggctttccttttctcctacatggtgggcagatcctgggggtggggaagaccatgagaaggtcaggggtattgggcggggtggggaaaatgagctgtaaagaatccctgacacatcccatctctcccagatgagtgaccgaggtgggggtgttcccttgaggaagattgagcgactcttcagctacatgtactccacagcacccaccccccagcctggcaccgggggaacgccgctggtgagatggcttcaccccagcccctcccacctcctgagggaggcttctctcctcctcactcacttccttatctccctgctcactcagcttctgtgtggccgtctgtgacagtcacctgtcttgaatctgggcccccgcacctcccacatctccccagtctgcacagatctcacctgtcggatgtctctctgtcacctttcctccatcttccctctcttctgtagctcccaaacccccaatttctacctttctcctggtgttgtccaacttgtcagcacctccctgttagaaaacttgagactcaaaggagccgtggggcctgctctgacttcctggcccctgagcggaactcctctctctgcccaagcctccctcccgcattcatgattgccccattcaccccacacacacttcttacctcagtgtcccctcccacatgtcccctcccagctctgggacccctgccatgtgaccccagctccacacccttccctccctgcatcagtccctgcagctccaggaggcccctgccagcctcctcatcctcactgccttcctgccccgctgcaggctggctttggttatgggctccccatttcccgcctctacgccaagtacttccagggagacctgcagctcttctccatggaaggctttgggaccgatgctgtcatctatctcaaggtgagggcccttcccgcagagcccagctggagaagagctttgctgataggacctgggcagccttggccagctgcgagctttcctttccatccccccagtccttccctggccccagactctgagaatccaagcaaagctacagttcctcaacctgaagaaccctcaacccccagacacgcactgcttgtcagggaatttaggggagtctgtggtctatgattaagacccctgtgctgggaacccttgacttgttagacccagaaggaaggggacaccctaggtcttgccattcagttcagaggagaagactgaggcccggagtccgtgacttgctcagggtcacacagcccagcctcctccccctccctctccctcccttagagggagctgcttgcttgaatgggcaggagcgggacacaggagggaccacccttttgtggtctttccaggcccccgtgtctggcagctgggctgccgctgagctggggtggggtggtctgctgaggagtggacaaggcacagggaggtgggaggggctgaccctgacactccccaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggcctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgagactggcctggctgcatccctgggggaggggacccacacgtgcgcacgtacacacgcacactgcggtgccctgtgaccaccacatgacgcaccggggacgtccggcccagctcaggactgtgagtaaaacactgggcaaagccatctgttcagaacgccggatggcccagcacctggtgacagacctgttgtcccaccatactcagggcccagcagagtccggccaacccaacaactggagcagacagaaattctggtcactggcacatcataaggatttattgaaataaattgagaactgcctccccttcacatgcaggtgggcacccactatagctactgatggctttaaggatgtgggtgccttccaacctcccatggccctgccaccaggcccagatggtgccagtgtcctcatatctgtttccctccgaagcccctctcccagcacagatagcagaggggggataagggctgagtcccaggtacagggtgctggccgtaagccacagcccctgggcaggaatgagggagccagcatgcattggtgccatctgtcgctctgtctgggcagatgggaggagctggaggggtttccaagcgggagcccccaggcctcatcggtaactctgaccagtgtcctggaagcgggactagctgctgaccagcgccacacatgaacacttcctccaaggacatttcctaaaaaggacacatgctgtccccaggctgctggtaaactccacccccatccagggagctggccccagccctcagtgtggcccagggaagcagagcttgcaccgcctgccagttctgagcccactgattccctgacaatgcctggggcagatgggggagggctgatgaacctttccaatctcgtagctgccggggacccccaggttttgcctctctgcctggctggggtgagggctgaccaggtcagcagctcctaggccttggctggtggaagtggtgtcctctgtccctatcagttcctgtttgctcagctcccaaagaggacttaggtgccctctgaggaagcagcaggaagtgaagggagtcctggcttggagaatgggtcaaagaccaggtcttgaatgggccctgagaggcagacctgtgtggtgtcatctcgccccctgggacccacaggacagaggaggggagagggagaaggggatgt

SEQ ID NO: 12120 - DNA, 11024 bp, Human
attcaagtcgccctcaggaaggaccctcggggcaccagaggccttcgaagccccaatgagtgaggcaactgagggtcgcgggtgccattacaaggcccagccaaggcctagagccaaggcttgaaccgtgggggacccccaagccccacctgcccaggaacagcagacactgggacactttgtttcaggtcctgcccaggcccctcccactgtgaggctgggatttgtcgcccagggtgcagatgagaagagtggggaaagcagtcctgagccaggacagcggtgggggatgcctcctagagcaggccctcccgtcaggggcccatcatagaacccagtgtgaatccaaaggagccgaagcctcctcctcagaatcagacgtggagccatgaacccaggggccagagcggcatctcaaactgttatctaagcattgaccagaacacatgatcacctcagcggctccacgtgggcgatgccgggttgcctggtccacggatgaggggttcagcccaaggtgctcaacccaatcagagggcagcctctgtgtccaggagacacgggtgcacccgcggggtcagaactccaaaggggcgcgggggcgctgggaggtttggtagccagagggcctgcggggcggggccacccaggccatgccccttccctgtaagaggggccattcctgcagtgtggggctctggctttgtgactgggctgtgccagtctggggatgatcccacagctgagctcctgtagatggaaccagaggtgaggcaaggaactggaggccctccccactgaggtcagcggggcgcagacgcccccttgtcgtgccctgccttcctcctgcaatcctgcaggactctccagggccaagtgctgcccttggggccaaaaaacagggccttctccttcacctgccctgcagccattcaggtatgtaccaggcatctcctgccctccctggccaggcggccccagaggcacaggccgcagacaccgcaggcgacctgcgtgggcctccagttcccgccccagcccttcccacccccagctcagggcaggtccagctgtggccagcggctggggaaggttctgtcccctccaggtgtgcggccttggcaagtgcttcaggcctccctccgctcgtcccctgggagcagagggatcggagcgcctgcgatgtggttccccagagcacctgcggggctcaggccaggcagggtggagggtggagggtggaaggccaccttccggcccgtcctggaaccacgcggcggctttcccggctgccccccacccgccaggccctgcctcccgtgggcaccaggggggcgtccacaccaagccggccgtgtgcttttcgcgcaggattactggggaaggcggctgctcggggcctggaaggtcccgggtctcgcctcgtgcccctctggcccccaaaccgaccggctccccggaactggccaacccgcgctgagagcccgcgcagctcaaagggcgcgagggcgggaccgccgcggccggcgctgggagctcggcttcccgaagacccaagcgaaagcctccgtctccccagccgtaaatgggcctgcagcgtctccactccgcagcgctgtccccagtgggagggcggcccgtggacgtgcagggagcagagcaggggcccctggcagcgtaggaccccgaggtcgcagcaaccacgcggccgcgagcccatcccgctgcctcgccagcgcccctcgcgcgtgccccgcccccacctcggctcgcgggccccgccccgctccgctccgccctgcgcctccgactaccttcccgctgccccgccccgcgctgcgctggttcggactccagccccgcttccgcccgggccctggccccgcctccagccccagtccggccccgccccagcaccttgacgcagaggtctgcgccgcacgcagagccacgtcgtgccgtcatcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgagggccgggcgcggccggacgtcctcgcgagcggcccagggggtgttgcccctcatggaggcggggtgtctgccgtgtgtggtcacggtcgcctgggcccgtcccacaacctgggacccggcagtctccttcgcctgccctgcggccattcagggatgtgcggggcacctcctgccctccctggccaggtggccccagaggcacaggccgcagacaccgcgggggacctgcgtgggcctccagttcccgcccaagcccttcccgtccccagctcagggcaggtccagctgacgccagcggctggggaagactctgtcccctccaggtgtgaggccttggcaagtgcttcaagcctccctccgatcctcccctgtgagcagaggggtcagagcgcccgcggcgcgaacgcctcatacctcggtccggttcacactgaccccggcctttcctaggcctgagcagcagcccaggcccctcgccctgctgaccccagtgtaggctcagccaggccctgcctgcctcaccaggccgggagctgagtacagaagccagtgtactcaatgaagcagcacctgtcatcccagcagtttgggaggcagaggcgggaggatcgcttgagcccaggagtttgagaccagcctgggcaacatggcaagaccccgtctctacaaaaaatctgaaaattagccggacgtggtggcggcgtctgtaatcccagctcttcaggaggctgaggcaagagaatcgcctgagcccgagggatgaggctgcagtgagccatgattgtgccgctgcactccagcctgggcgacggggccagaccccatcaccgattaaaaaacgaaaaaaaaaagatgccgggtgtggtggctcacgcctgtaatcccagcactttgggaggccgaggcgggtggatcacttgaggtcaggagttcgagaccagtctacacaacatggtgaaaccccgtctctactaaaaatacaaaaatcagcagggcgtggtggcgcgtgcgtgtaatcccagctacttgggaggctgagacagaatcacttgaacccgggaggcggaggttgcagtaagccaagatcgtgccactgcactccagtctgggcaacagagtgagactccatctcaaaaaaaaaaaaaaaaaaaaaaaggcaaagccatcaagtctttggggggtggggcaggcagtcgttaaaggcatgaactcccagcagaacgtttcagggagcagtggcactagagcccagtggtgggggtgtcgtggccaaaggaacagtgccatgggacaggaagagcatgggtaaatatcagaggacagccaggctccgtgccgggaggcccatgggtgtcaggtgggcagccattggtggattctgaacaggagagtgacatgatgagaattttttgtgtgtgtacttacttgttttacagtacacttggcacttacccctgtgccagacactgttcccagtgttttacaaatattgaatcttcaaacatccctccaagtaggacttattactcttctgatagatgagcaaattgagattccagaaagacctcacagccagcaagttggagagctgctttttgatgctagacagttggcctctggcctgtaatcttaataccccagaccatctttccatgtggccctcataggccctagaacagttgctcaggggaatcccggagcaagagatgagcacaggtgggagattcttcgcagactgtctgcagctcacgctaaggcaagtcaaggtggtgcctccggagacagaagcagagagggaggccagggagtgagtgttggcttcatggaaggggtgggactggatctgggcctagacaactgggggaggactgtggtccctcatcctcagaggatgcccaccagctcccccggactaatactgtttctcctctcaggtgcgaggaagtggctggagtggaggaaggaggttgagctgctctcagatgtggcctactttggcctcaccacacttgcaggtagaagctcccacgggacctcaggactgagggcagccacacacaccaagtctggggacggtggccagggggctgccaggcagtgtgagaagctcctggagctggcccgggtgaggttgcttcagggaagtgcaggaggtactgctccgagggaggcgaggcatctgctcccagcagggagccgacttttccagcctttgtgtgtccctggggttctttgtttaagactttaccccgggtgccactgagacccatttctcagtggccagccctggtggcaccagtgagtcacagtgctgagccatgtcatagggtgcagtgcccgtgtgacagtgccctggtggagcagtggtgggtctgtggcccaggctggtcaccaccctttagagggagttgttgacagaagctctcaggctcccaaccccagctcagcatgtagcaaggaccaccgagtgccagcctggttccctacgaggggctcgccccgggcatcctgccgccatggagagtgtgctcggtgggcgggagacagatgtggctgcgtcacagagcatcttgggaagtgaggggctctcagagataaagaccacgtcttagggaagagcattttccagaccggcagagcaagcagccgggaaaggccctgagaagaacacgtccttggcggtttgggagaatgaccccggggggctcgtgagttttgtaagcccatagctttccctgtgcgaggcttggggcattccagggacgtgggcaggggagaggccgaccactagctaagaccagacctcaggggacaaagttgggctcagggagactacagaggctgtgacagtcccccacaggatggtggtggtacagagcaggggcggcagcgagggggtggaacacacagggaaggtgcatgcagggtgccccttgggcttgacctcaggaaccggaggcctggcgttgccatccacagagatggaaacggggagcaggcttttctgggtgggggcgctgaaagctgtctcggcaggggtggaattggggtgctcatctgagcatacatggcgatgtcaggtaggtggcggacctgcatggctggcactcacaagtaaggtccaggctgggcataaatcgggtggtgccagctgtgtggttggtggagagccatgggactggatccgagtgcttgggctgggggaggtggcggggacagctagggagaaaggggaaagagcagagactcttggggagaagccaagagagggagggacactggccagccaaggccctgggagccaagggcagccattggccgggcctgtcatgtgctgcctgagctcacagtgggcttagcgacagaaggtcatgttggcctcagccagcacggggtgacagtgggctcaagggcgacaagatggggctgttgacaggagccagcagagggtcggctggcaggggcgccgggagcctgtccccgcggcagcagtctcagggtccacatacccatcctcttcctcgcaggctaccagaccctgggggaggagtacgtcagcatcatccaggtggacccatcgcggatacatgtgccctcctcgctgcgccgtggcgtgctggtgacgctgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacgtaagtagcaggcgctgagggcacagctgcttaggccgtccttgtcacccccactggacttgggtgccatgcacagagctggccctccaggcctctcagccaacagggttctacatccagcatctgtgtcaaggcaggaacccaaatcctctgcttggaaaaaaagcagattttgtttaattacacttggctgaaagatccaaggaagtccagaccctaagtgtagaatgaactcctgctgcagcccctcatggacaccgggccctgcgcttagctctttactgaccggggggccccgggtcacgcctcaccacagatccctgaacctgggcccgtgactgcctatgtcactgctgtggggaacaaacagcttctcccagacagtgtgggagcatggactgcagccccggccccagcccctcacccctcgcccctgcctggcccagcagtctgccccatcagacggccgttcccaccttctcccctccacagccgtcggcacctctgcctatcctgacccccagctgatgcccctgcttccagattcagcaacgaagcctcccccgtggtcccaccaccatgtccacctgccacagcgttagtccctggcccaccagagccactactgcatgagctccttccagaacagccctctgaggaacccccttccttttgtccctagagctgcactggtcccctcagcccctacttgccaggcaaccccgcctccacacacaccctaaacaggaggccaccgtgacctcgtcgcagagccagtggtcaggtcttcgtcctcagcgtacccagcctcacttgcatatttgatgtggtttcttgccccgtccatgttggtgagggatttgatgagctgctgtgacaggggcatggaagtggggctcaaaccagatgggaggctccctctctcctaggacagccaggaagtggctggacacccagggcccatgctggcggtgtgacctgccacctctgtatgtggttcccggccctgggctgaggctgtctggctgtctccatttcccagccagtggaaagtgacacgggaagccgagggcagccagctgtccttcagtggcacggtcagaagctacctgtgtcaccagcaggagggtggcagcagtgtccctggggccacgtgccttgttacactggggcttcggtccctgtagcagggtagctggtgggcagcgtctgcagccccacatttccgctccccgcctccttttctgagaggtggtccctggacatccccacatcctcacctgctctgccagcctcatagctaagactctttctgcactggtgatgccaaggctggtctggagctcaggcctctccgtcatgctaggctacgaagcaggcacctcagactccctgaacctgccccctggcttgatcgtttctgccgggcactccccatgccagtgagaggcctggttctaacgtgctctgtgccaactgaacgtgtgaccctcccagcaggcgctgaggccagatcccctcagggtcctgatgagtgtggcgccatctgccttacagctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcaggtgcgtgcgggggccacacatgggggctgggggtgtcctgggcacttcacaaggacctgtaaggtgcacccaccttgacgctctgccccaccttccccagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggtgaggtgggagcctgctgccgtcctggggtggtcagcggctgtgccggcaagatgcacctggctgcagcagaagtggggagtctggctctgagcaccctccagttttgagggtacagaggtgggcatctttttaaaggctcccaggtaggtcagatgtgggttcgttgagggggttaaagttccaaattcacgtgtattgaggctttgccgaatgcaggttggggtagtggccagccctgaaaggccccacgcttgcaccacgcatcccagcacacccttcctcccggggtcctcaccacacttgaaaaccctagcacactgactcacacccaccgaagatgccggcagggtgagagcgcacgctttcccaggagctgggcttcctgggctgtgtcagctgcgggagcaggagggaacctcccggccgagccccacaccctgagccctacgcccccagccccgccccagcccccactgggactcggccttctgaaaaaaggctggctttcttggtcattagttgaaggaaatacaacatttatgttgtgtgtcatgtgcagagaatgtggacaggaaaagaaatgccgatggggatgggcatggcccagtggccccagctgctgtgaccccctttctcctctccgcaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcacagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctccggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaacgttgagagtatttcttttctcgaatcaaaaacgctgacatgcaagtgggttccgcctctcccgcagtggggggccgagtgctgaacctacaaagccagtctgctccctgccagcttcgctgcccctcatggagggttgcatgaggacagatttaaattaaaaacaaaacactctacgtatcaaagaaatgtgtcaaaataatctcaaacaattaaaatataatatatatttataattccgggccctcaaaagcaatcatggtagttaagaaccaagttttgagtcattaggatagaggccaactttaaacatctccagtgagatggaattaggaaactggcattagaaccccacacagttacttgacaatcacctttaaaacgttaagttctttcggacacgcaggaatcaggctagatcatccctcgggctctgtggagtggctggcacc

SEQ ID NO: 12121 - DNA, 15853 bp, Human
ccactttcgtctcctctccccatgctgaggcctcccattttctcttagcttagaggccagctccagagctggcccccacccctcccctctgtgctctgcctcagcacctcatttatctccttcatgcacttggtaccatttgtgacaattttgccctttatttctgtctccctctccaccatttgtttcttgcagtgcttttacattgagctctggaataaacagatatcactgatggagcatctcctatgtgccagacccggtgctaagatttaaccctggaaaaacatctttattcaacaaatacttttttgagcacatatgagctacacactggaaagtcccaatactaagggcctggagagcccagaataggcaggagaacaggcgatgcccgtggcgggctaggtggttcggtggggagggcacagggtgctataaggtctcattcccctcatttaaccaaagaggaaattgggactttgagaaaggaggaggcttgtcaggggcagttctcaagctgtggcccatgaacctcgggggtccctgagaccttttcagggatccatgagggcctccctttcccaactacatgatttgtatgaggctggggtttttcatacctacaactaggcaactaaacagtgtatttggagagactgaatgcagaagtagacatgagaatgtaaccttccattaagcctgatattaaagagatcagtgaaaatgtaaaatgatgacaatcttctcaatttatttttgtcttagaaaatatagttatttttaaagtgtgatttttattaccatggaatggagttttatattattttaaatgaattaataaatacattttaaaaattctgctttaatttctaatacagcaaatatcgataaataacccacataaacaaaagttctttggagtcctcagtaatttccaggagtataaagaggtcctaaggcaaaaaaaaaaaaaaaaattactaattgggagacacaagtgtcagaatatacagtaattgttcagtaatattgctgtaaattaattaataggattgcctagtcacaacagcaaaggcatggaatcaacccagatgcccatcagtggtggataggataaagaaaatgtggtccatatacaccatggaatactatgcagccataaaaaagaacaaaatcatgtcctttgcagcaacatggatgcagctggacatcattatcctaagtgaattaacacagaaacagaaaaccaaccactcatgttcccacttatgagtgacagctaaacactgggtactcgtggacataaaggtgggaacaataaatgctacggattccaaaaacggggaaggaggcaggggaaaggggttgaaaaattacctgtggggtactatgttcactacttgggcaacgggatcattagaaacccaaaccttagcaccatgcagtatatccatgtaataaaccggcacacataccccccgaatctaaattaaaaaaaaattacattaaaagataggagtacctcctttacaccacctgaattatcatggcacataaatctcacaccctatttgccaaggccattcgttcctagctgttttacaggtaggttagctttctcaatgcaagtctgtgggacggatggagaaaaattccccgagccctttgatcctgccccagctgggccccgccgcgctgagccttgggcgcgccccctgctgcccgcggccggagccgttcgccacacccccgtgtttatgtcggtccacgggggttgcctgtccctttaattggcatgtaccaagtccttccaggtcacatttcctccctacgtcccagccgtttggactcactggccaaaagtccaagaggacggaatgtggagacagtgttgtatttttgcggggagttctaggccgaccgggagcgagagaacgctcgggggcgaagcgcgccattgcggccctccccgccgcctgcggtagtccagtcccaagatggcggccaccatgaagaaggcggtgagtggggagctcggggctctggatgctcgggcggcgccggatctcggccgctggggcccgggcgcgggatgctgggggtgcgcagctccgaagcccggcgtgggacccgaggccgaggccgaggccctgagagcggtcccgcggcaaggcctgctcgcgcctggcgccctgagcgttttcctaggcacctggccagccgaggcggggcgccggggctggggccgggagcctcgaaggacgcaggtccgcctcccgcgatgccgagggtgcccccggggagtctgaggaacctgcagccccggcctcgcccctgaggtgtgggaagccgaaggtcccgttgagtgtggttggccttgactcgggcgttgcaccggcatgatcgcattagcctcactggttatgggtagctgctgctgggagcgtggttacgggtgaggaaactgaggcccagagatggggagtcacctgcccgaggttacgcagctcataacggggacagcaggttcctgcatccccagattagcaggccccagagaccctgtgtccaacctggagctgcccatttccacgcttgatgcccctgagtccttcaggctaaaaccagtatttattgagaatggaagatgtgccgggcccagcagccggccgtttatctgttatcctccccgcaactcagcaagtgcaatgggttcctctccactttgcaggtagagaaacttagacacagagcagttagaggccctaaagtgactcagctagtaagaagcagagctggagttcaaactcaggtttgtttttgtttttctcaaagcacgcctgtgtaaccactaagccggctaaacttccatgtggggtttttaatcccgtgagccttcccagatgtgtaaagatagtcagatagaagaaaaagaaaattggagagggggaaggagataacggctgataatttggggagctttacagtgtgctaggtacagctgtaagttgttttgcgtgtattgtttattttatgttctttgagggagatactgtttttatccttatttaacaatgagaaaacaggcgcggaggcaaagctagcatttaaacacaggcattctgactccggagtctgtgttttaaactgctatagggggtctttgatgagaatctcttggctggagggatttgcgttcattccacttttaagaccacattagaacttctttgctttgcccctatccagtaccacatagtctatgccatctgtgcctggtgtagggtgacccattgcccccttttatatgaaattgagggactgccaaaaatgggaaagccccagccaactcaggatgtgttgctcaccctactattctgccatccaaaaattcttactgtgtcccagagtagggtctagggccatggtgattcaaaaaagtatgaaactttgtgagattcacttcacctctagtttgttaaattgggccctctggtgttaggtatggcctttaattccttggaagatactagttgtggttcactccgttttataggtatggaaactgaagtgcagagaggtgaagtaaatggtagaagaggaaatggcagaagaatgatttgaaccttggattttgattgcaaaatttctaattaccaactttttttttcctttcattgattcagtaaattttcgggggcacgtaatatggcgtagtctcagttttaagtggagacaactgtggtgaccagtgagaaagctcttctccccttaatctcatagccccaaagaacgtatgttccagggcagagcaggcattactcagatagtcagacagaaaactagtttctctgatgagaactgtgaaggaaaagtgcttatgaaatgagggccaaaatgaggtctgttttgagatcagagaagactttcctgggaaagtgccatttaagttgagatctgtgagattatgtaaggaaaggaagggagagttggatagggagcgaagcattctagagaggagtatctgcagagactctgagtgcatttaatacaaggaaggcccgatggcagataatcaggggaagagagtttgagccatgatgggaaaagaacttacagaggggtaggtggtggccaaaatataaaggagcttctttaactttggaggctttaagagtcacatgatagatgcagtgtcctcctgtagatgtttccagtgttaggaacaattcccgatagattagcttgcatgtacacttttcccctttgccctcactaggagaaaacatatgtgtatgccagtgagtgagagtgaaacagagagagatagccctttgagtttaattaaaagcaaatcgtacaatctggagtactttacgtttgtaacacatcgtatctctcaactggtcatgactttgctggggagagtgtttagatgagatgattcagtcctctcctctctagagttctgccttctaagatccagttcttgaccataaggagatctgcactttgatttctgttcattatcctatatacaaatgtcctttcctcagagaggctacctttgacctttatctaaagaagcctccttcactccccaggcccccaaaactttctactccgaagctgttttattttcatcatcacgtttgtcaccattgaacattatcttgttcatcttgttttttgctctcttcctccaccaggatgtatgcttgccatttgtattcatgaaagtgggatagtggctctcttgtcacagtgcatggcgtataggaaacagtaattgttaaataaactactgcatggatgaaagttgaatacaaaaattaactgggcatgatggcgtttgcctataatcccagctactcgggaggctgaggcacgagaatcgcttgaacctgggaggcagaggtcgcagtgagccaagatcacaccactgcactccagcctggcgatagagcaagactcgtctcaaaaacaaaaaaacaaacaaagaaggttgaatacaaatacaaagcaaaagtttacatcatacagacttggtagatatgtttttaaaagtaaaaataaaagactgaaattggccagaatttatttctagggacccagctgtcagtgcagactccgtgtaatacctagacttggtgtgaggcatgactgagtatggttcagtttcctcctctaatcccgtaagatattagttctcaagaaaagagcccagggaattttaatttttactttggatcccgagcaggcatatttctctttggcctagcagaatttctttctagatctggatctgttctttgtaatgatttttgataaacaatattcaggatgtaaaatgcttagctatcatttgactgactccatcatcaggctttctcctacatgttcattttatcaaccctataaggtaggaactagcttctccattttacagatgagaaacctgaggtggttccaaagaattgggtaatttgcccaaggttcctgtttgcttggattggattgcagcctgactcttcccaccactctgtgtgctgcctcagatactataggatatgagttcttcctagagttcttctgactttgagagtagctacagctggtttccctgaaggcaggagttcctaaccttttggggttgtggatccctttgagaatctggtgaaagctatgaagaccttccagaaggatgcacatactatacatgccattttgcatacagtctccgggtatatcgacctgtcaatgtccattgaccacccccaccccccagttaagaattacccacttctggctgggcgtggtggctcaagcctgtaatcccagcactttgggaggccgaggctggtggatcacctgaggttaggagttcaagaccagcctggccaacatggtgaaaccccttctctactaaaaatacgaaaattagccggacatggtggcatgtgcatgtaatctcagctacttgggaggctgaggcaggagaatggcttgaacccgggaagtggaggttgcagtgagccaagatcatgctactgcacttcagcctgggcgacagagtgagactctgtctcaccaaaaaaaaaaaaaaattacccacttcttgccaaaatgcagcttcaagaaatgtaggaatgttctaggacagtgagactaaaacagaagcctctgttagccatcaaaggcactgacatcttactgtctgctgtaaatggcactccactgggcggcatgcagtatatttgactcacacatcaactttagcccttaaccccagtgggaaaaccactgtaaagatctggataccaggggccacatgtgtgctgatgcctgtggtttggtggggctacaacaggaaattcctgctttggaaagacagaaagcagatagccaaattctctctaccacattttggaaactatgtgtttgagtctgatcaagcatgatttagattcaaattcagaaaccatgtattagccttagttatgtgccaggcagtcctgcactggatccgttcatgtgaatggctctgttgagccctcaccaagacaaatacatctataaatgcctgttgggggttcaatatttaaacaaaatggcatatactcttcaggcaaacaggaactcttcagaattctctgctgtctatttgcgtagggaattgacagttctcacttaggcaaaatgacttgtgtgccaagatatagactttggtttcttgagcgtagctcagtgttccccaacttccatattcatcaaaattatgcatacggttgaacactcaaagctagacatagtgtgatgtaaaggattttttcaggctatcttctgggttgttgaggtggggcataatgcatgtgaaattgtttcttggaatgagagcctaacaaaggggaggactgtgttatattccgaccactgagctctgtattgcttgacactgcctttcaacctctgagaaataaaagttcacataccttaagtcgatggtcatgagagaccaggtcagggatggagtgtgaatgttgtgagctcattactgttactgcaaaagagccaaaagtagtgtttcagtatgaactatttttatacacacacaaatatcttttcttctttaaactagaatcaggtgctctggttttcattttataaatggaagggaaaccctaaggagagtctggttttatgttttagctttattttttaaaaatatatggtacctccttgagaatctgatgaaagcagacatcctgctgcctcttccagatgtgcctaagcctgtgtacacactcacacacacacgtgcacactcacagagacgcacgttcacattcagttaccgagaactcatggacctgtctgacctctgaagccagtctgcctgggttgaaatcaagttccaccacctactggctctgtggctttggccatattatataaagtgtacctcagtttctcaatctgtaaaatagtgctggtgatcctccctaataagatggattgcaggattagcagagataataaagtacttaggaagttttggcacatagtaaattcaatcagtgttagctatttttttattatttcattggtactttatgttatccaagtactctttatttgcaaatttgtaaatttaatcacattaaatattaatttttaaatactaaacattcaattttcatcattttttagtaaagtagaccttattaagacatttaaacaggtcctacattataaacataatttttgctgtgaatggaatagagccactgaaatgtacagtgaccctttagccagtaagctcatgcaagttttagctctaagaaaaaaaaaacactactctgagacatttaccaatatatttgaccatgtaactttttgtttcctgggtcatcttaatgaaagaatgctccaacttgagaaattctgctctgtgccaaaagttggctttttttctttccttttaaaaggacttattaattgttctttatgtttgcaatatgtttatagcttaggaattattttatggagtatcagaaaaggttatagatttacaaacaaaccttaagcttgtggagcaaaaaataaggcatttgttatgttctgtacttcttgtgattcttgactatatgagtgcaaatggcttattgagttattgttgagaaatataaaaagctaactgataacttctccgttaaaattttacaaaaacttaaacacttctttcaggctgcagaagatgtcaatgttactttcgaagatcaacaaaagataaacaaatttgcacggaatacaagtagaatcacagagctgaaggaagaaatagaagtaaaaaaggtattgaaaataattattagaagaataaaatttttttatactatagctactaaaactgaactcagttaacaagtgaatatatatttctctgggctgtttgttgcagatgaatgacgcgatccactctagttaagcagaaagtcattttttttttaagggatatgcgataacttacagagttgttgaggagcttgagtctagaccgaggttccaggaacaagtctcggagaacttggctggcggtggaacagctgttgcctccactgatcccagagtcagctgtcttcccaatgaggaagccacccttgcagacttaggaacaccaagctgctgctgccagtgccacctaccccagtaaatctggggcctgtgtccagccgtcccccttgagttgaaatccagctcaaatgcatttgattggtggaattgaagttattatcacttatgcatgctggcagaactttcattacccgcatgatttacttacaccctatcagcaagcaaggctgagaaatgtaggctggtttttttggttttgtttttgtaggaaggcagaattcacaaagtcaaaaattgttaaaatagaagaaattttgagtgaccatgtgcctgctgtccaccacagggcgcttattgtccagaggacaaagctttaggtagctctaagtgcttgcttgtgaaatgtcttctaaaaagttacaaattaaggtcttattctaatgtggtaataatacctttgtgagagggtccctcagagagttgctgtccccaaattacaattggcctttagcttctatcagagaactttgagtacattttctttgccattttgcatttatagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaaggtatgttaaaggttaattctgaaattagaatttatatcactataaagaacatgtaattatagatgtagggaaatagtagatgctagctatagctaatatttactgccttgttatgtcccaggcatgctccgaatgctttgccagcaggattttgttgaatcataacgatgacctgttatcccaatttagggacaaagaatagaggcttagagaggttatgggatttattcaaagtgacacatagacagtggtcttctgactccagaaccttgctcaaaactaaaagtatttagaaggtatagcatatattgaagcagaaaagaaaaatcccctgtaattctgctatgcagaggtaaccattcatagtgaacattttcctgtatttcttttatgttctctctgcctctctccgtgtagtttgcttcccagttgggacaattaatgttccaggaggagcatttttgctggtttcattgaatgtttgtttgtccagcagatactcattggaagcctgctctgagcctggcacacaggcctttaaaaacatcgtttttgaagactgtttaatatcatgttgatggttatcaattggggtcacgggtcttattgttagcattaatttgtttccaatattttgctgtactaatgttactgtgagcattcttctacataaatctttgttcacatttagaaaattgttttgaggaaataattagagaaatataattactgggtcagtcagcatatgagttctctgataatatctgagacatttgatacatggtatgaaattttcagttcacatgccttcttactatttgggagggacagccacgttgtttgtctatgagaagcagatggcaattaaacctttcctaatgcttttgctaattaacctgattgcttaaaatgatagtctctcttcaaatgtcataaaaagcaaaacttcgtatgaatgaaacccacatttagtaagtcttcagaagaactatcactcctgggtctttccatgcataaatcttatatgtctcccttatgtttaaatcttttcttcttggtcaaattttgtgatttttgttctttttatttgtttaaccatttaaaaaacatttttattggaagtattcccagatagcttatggtttttgtggctattgtgaatcccctgccccatacacagatagctactgaacttttattttattttatttatttatttatttatttattttttgagatggagtcttgccctgtcgcccaggctggagtgcaatggcgcaatctcggctcactgcaacgtctgcctcctgggttcaaacaattctcctgcctcagcctcccgagtagctgggattacaggcgcccaccaccacgcccagctaatttttgtacttttggtagagacagggtttcaccatgttgggcagactggtctcgaactcctgacctcgtgctcgtgatccacccgcctcagcctcccaaagtgctgggattacaggcgtgagccaccacacccggctgaacctttctttttttactcattctagaattctagaatgaatggagtgcttactctgtatcaggttctgccatgtactagggataattggggacaacaaaacctgcctggcccctgcctgcatggagcatatagtctagatggaaagaaaaaaaagtaaacaaaactgataatgagtagaaagtgatatgaggatagaggtggctttaagaacacaggaagaggaatctacactagtctggacatcaagggtcagggaagggctcccagggaaagtgatgggataacagctgaggaataagtggctattagccagaaaggggcggcggggggcggggggttctagtcgtgagaagcaacatgtgtgaacggccataggatgacggtggtgcaaacatagacctgcaagaagatgtatttgctggagattgggagcacctgaaattgtggccacatcttggagaactccagtcagttgagttgaagaaattgtactttgtcttagcaggggtcagcaaactttctgtgaagggccagaagtaaatacgttaggttttgtgggctgcacagcctctgccataattactatgaaagcaagatgagtgaatctgcgtggctgtcttccaataaaacttgacaaaaacaagcttcaggctagattgggcctgtgggctatagtttgcccactcccgtcccagagcaaagaggagccttcagagatttttggaaaagagagagatgattggacttgcgatattaaaatgactttctagtgtcttattttacttattaaccaggttttctcggtatagaaatttagaatttatccctttctagtagccatatgtcttatttttgtttcttgttttgtaacagtgattctcaaacttagcatgcgtgagaatcacagtcaccacagggcttgttaaaaatccaggttgctgggcccgacccaaagacgatctttcaggtgggctgaggtagggccccagaatgtgtatttctaacaagttcccaggtgattttgtccctgacactggtctcggggccaccgtttgagaaccattggctagatttctaaaacggcaacactgtcagtattagatattctttggtttctaatgttagtgggtatttggtttgtgtgatttcatatttttttgtcatgtttaggaaaaaaaattgttttgatcctagccaggaaggaacttaatggcttttttttttttttttaaaacaaagagtatatgttaaaatttatttaatctattaatgagggaagcattaacattacaaaactggttttagaattgaagaggctaagtatctatagataggtaggtagaaagaattgtcctttggaattgtattttcttttttttaattataaattgacaatttataattgtataaatttatggtgtaaaacgggatgttataatttattaatacaatatggaataattaaatcaagatagttaacatgtctatcacctcaaatacttagaaaatatctgagttttcactgggcaaagctgctctttcttacaaatgaggcactttttaccactcttttccaaagtttagctccagaggcctcaaagttagtgaaaatttctgccagatttggatcataagttgttcttcttaattattggtggttggtggtgtgagtttctatcatttcctgtagtctcatagttatttttgttgttggaaaaagctgggttagaagccagcaggcccaggataaactatttatagaagtctttgtatttggttctttgttaggaaataatttagacagtaattttttactattttttagatcagcagaaactgagaaaacaaacttgatttattctgtgataagcagatatggaccatgaattaaaaatgcccacattcagacatttagatctaattatcagtgttacttagctgcctgtccaagtttagaaggttcttgacctaaaattcttcccaaatattatttcagacacagatgctcagaaatcatcctattgaatagaattaatttaaaatattttttttccagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgacgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttcccactcccccacaaaagacaaacattttgggatttgggagacctaaatgtattaactttccagcagatggcactgatgtgccaaatgtgaatggaaggatcctaacacaacaatgagattgttaggattaaatatacataattttagaggaaatatttttaatttttaaggctaaactgcatatgtattttttggttcagtgtttataaacatgaattcaggcttaaagatagatgattatataatttctaaaattcttaatactataaaggcagttttttctttttttttttttttttgagatggcatctcactctgttgtctaggctggagtgcagtggtgcgatctcggctcaccgcaacctccacttcctgggttcaagcgattctgccaccttagcttccagagtagctgggattacagggacttgtcaccactcccaaataattgtatttttagtagagacatggtttcaccatgttggccaggatggtctccatctcttgatcttgtgatctgcccgcctcggcttcccaaagtgctgggattacaggcgagccattgtgcccggccaaaggcaaatttttaaattgctgcaaaaatcttcccaaatagtgatattccagttctggaaaatgactcttaccaaaaaaatgcaaggatatttttttcttgcatccatttggttaatgttcagttagaggattgaggctggggaggtagtcaatcaagttgcagcaggaaataagatcagaataatttgaggaaactctcaccaaagttaacaatggtgccgggtgaccactagggtccttttggaccctcaaaggccaggggagagagcaactgcccacttcactccctgaccagggaaagttgcttttcatctggggaggaacacagccagcctgtgtcatacctgcagtggtagagccaggggactagacatcctgacctcattctccctccaaaatccacctgtgtcccaccattggccaaacccaaccagaatccggaggtggtccatagaagtcagtcgcctgcagggcctgggaggggtggggaatggataggtctggggatcccccagtggaagatctagcataggagggcgactaaagtttagccctttagaaatgttaacaacgaacactcgcctgacatgggccaagagactgaactatgtaattcactgggacttcaaattttgtcctgcatattatcaagaaaacctaatacaaaaacccaaatatctaacatcagtgggatggaagcgtgtgatgttgctaacttcattttcttaacttacctgtgacattttagaacattacaaatatttgattcccattttaagttcatttctaaagcctttgcttatttttgtgaatagtaacttccctgggctagctgaagactggggaacagcacgcggtgcatctgaagggaaaggaagaaatgtcagcttcagccagtagttgcgacagagggaagttttgatctggatttgtcactaacttcttttttttttttaagcaggaatcttgatttgcatgtgcaatcactctttttagactgggccactatttgttttttaaagcagtgcaggctacacaacagataattgcacaacagatctggccctgagactgccaggttgcaaagtcaggtgcataatatgatacgtcatgtgcaggcttttcacaggaagtggtagtagaagtcttctgagcagctatgctttgctgctgactgtaatgtttcattatctctcacatccattcatttctttccatctccacaactactgtgatccttgtccaagccttgtgagctctagtcaaaagcatggctaagtaagggagcaaggggatggaaaagccatttgaggtagggtttcgacagggggtctctaaagggttttgaatagaaaggagcagtactttttaataatttggcagttgttaggtgggctttactgtagaaagatggaggtagaaatact

SEQ ID NO: 12122 - DNA, 70828 bp, Human
  misc_feature (1)...(70828): n = A,T,C or G
gttggcccatccacccgcatctcagcagcaggaaccggatgaggaaccgttctgtcctgggtggatcttgctttccccgtctttcttgttcagacttgtgaagattaattggcttaaaactggtatttgctttatttaaaaaatattgccttcaaaactgatttatgtgggaaaaaaaaagcctgatttatatggttctgtcaaatatatatatatatacatacacaccttgtacagtatttaccttttgatgtagaatgatcttttttctaatgtaatttacctggagatccccctgcagcatggcagtgtgtccaccacatccgtgaacttacccagaatctcgtgaccggaagctgcggagctggggttcgagccccacgggttctcctcctgcagtcctgccgtcctcgcagtggcatcctctttctgcgattaccttagtttgcttagtaatctgttttccttttttctccctagtttgtaagaaaagaaattttcccttaatcttttaccaacttagaaaccatcatgttacttttcttttagttgccggtggcgggatacggtgagctgatgtatctcacacgtggctcaggatgagacacagaggccccgacaggcagggagaacgcagcccctctgctgctcttcatgagttgttaaccttggacttctgcttctcaccttgattcatccgggcatcgtgataaatgctgtctcatacgcctctcaaatctttaccggaatgcagcttgttgaaaagtacagaaagctatttttagcactttgcaacttgcctttcattgttcactttagctgtttcgttctgtgtttgcacattagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtgcaggcagttaccggtcctccctccagtggaactgcccgtgttccagggagctggggatgtgtcccagggcgtaagagagaagaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatccctggggacaatgggatttcctaatgtagatgaagcctgagtaattctcacctttgatcatgtcagaggtgcgaatattaatctctgtcatcactacacattacaatttcacatggaaggaaggtagtttttggcaaatataataaatgatggattccatgtaattccggcttattgttccaagggagttagctgcaccctttgctttgctttacagccaggaccctggtactcccagccactggtgggatggtgggagcctcggagctgggttagctctacagctgcctcccggctgttctcatgagctctgtgtgtgggtgccctggacggtaaagctctaggtagaggcagatgcatccctcggtgtgcgttctggggctgaggactggctgctgacaccccgggcacaggtgcttgatagggccagggcgttgctctcgaacgtagagaggactcgctggctgttgtgggctcgtcctgaagaggcttaagaaacctcaccttaggggccagcacaggtttgcacttagctgcattcacttgtctgctctgattgcctggcctgaacgtttttgccctacggtgtcttataaatctaccaagagtacaagtacttcacttcttccaatcaacatgaaacctttggatgggcttgggatgggatccagggaggggcacagtctggtgttgcacttgttagccctgtcatgtgacattggtgagagcatgggggagggagagcaggtatgagcagatgggattttaaatgagatcaatagtggataatgcatatgtaagttatttggaaactggaaatttccatttaaacaattattgggcacggcggctcacacctgtaaccccagcactctgggaggctgaggcaggtggatcaggaggtcaagagatggagaccatcctggccaacatggtgaaaccctgtctctactaaaaatgcaaaaaattagccgggcgtggtggcgggcgcctgtagtcccagctactcgggaggctgaggcacgagaatcacttgaacccgggaggcggagcttgcagtgagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcaaacgtttaccgctccttaattaaaaccacagactggggaaggcggccgggtggggaccggcgtggcgtcccgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagttacttgttggctactggccacgatccgagatgataggttcccagacccagcggccactggagaattgtagaacagcaggatagcaggtggtaagacgtggcctacgagtggcccagttccagtaaagcaacttaaccgagaagcaaaagcttgactccttaaccgggcctcatctattcagtgagctcttaatgtatttcaggcctgtggaagtaattctatctcttgagtccagagtccagtggctacttagagactaaggtagttatacctagaattttgtttaaaatcacatattggactgtagaccctaatattttttctattcatgaagattagtcccatggtaacctttccatttacttttagaaaaagtaaaaactggccgggcgcggtggctcacgcctgtaatcccagcactttgggaggccgaggcgggcagatcacctgaggtcaggagttcaagaccagcctgaccaacatggtgaaaccccgtctctactaaaaatacaaaaattagccgggtgtggtggcgggtgcctgtagtcccagctacccgggaggctgaggcaggagaatcgcttgaacccgggaggcagaggttgcagtgagccgagattgcaccacctcactccagcctgggccacaaagcgagactccgtctcaaaaaacaaaaacaaagtaagaacctcagaaatgagactcttacccatgagaggtttagtcatctaaccgatcatgtctgtcctgcgccctttgtgcttacaacctgccgatccttgtctgtggtcttaaggcaactgtgtgttgatctcggagtgttttcgtgatgccccagtgtgctccctgcgtgctgtggtggaggtggcgctcccagcctctcccagcgagaccccctcctccccagcttccctctcgccccacaactcccacgcttgtctgacaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacgtaagtccgtgtgcgccctgccaggcgggcgccggctgacgctaaccccggggccccggccctttttatctaccagtgcgctagaaatagccttttacaaataccctgaatgagagcttctcgttctttttttcccccagaaaagtatgttttaagactctgaaaatttttgaactcactcccagaaagttttaccacctcttcttctgtgtggccaccagggggacgtagtgtggccgagactccaggagtgcccgtgagcacccgaggcgctgaggagggctgggtcgcagtctcctgtgattgtaccagcattaaaaatcactttgtgtgtgtgtgtgtgtgtgtgtgtctgagcctaaattttctttgagcctccaatacccattatgatgaacccctgccttgatgctgagggtagaaattgaattgaatattttataattttattcattgccctgaatgcaccattgcatttgttatctctctggtcttggctgttgacctcattttcccctttgtaaactggggatgttaaattacctctaaggcaataattggtgctactttagtttttttgccaagagacaataataaaacatagaaatatattcttctttttttctttgtgggacggggtcttactctgtcacccaggcttgagtgcggtggtgtgatctcagctcactgcagcctcgacctcccgggctcaggtgatcctctcacctcagcctcccgagtacctgggaccacaggcatgtgccaccattcccggctaaaagaaatatacacctattcccatgtttgtgtgtcacgcttggtaattgatgtgggagtttgaagatccgtacctaacacagaaagcatttcatttttttaaaatttgatgtctaaaagtttgtagtaattctcaagttttaatttttcttgtgagacttggttctcatgaatatttttcaaagatattttttcttgtaaaaccttggcatgaaacttatttctagcactggtaaataaaaaaacaagcttttaacatacagctcatatggtaagtaatgcttagcactcgtttcttgcttttctgagcgttttaaactttcttcactttctttgcgaaggaaacctgcccaggttttcctgtgttcactggctttgggggcaactttcaccttatttttggcagttgctaatctctgacctagacgttgcttctgttctcctggtggtgggtgtcacggctttgctgctgcggggctggcccggctctggaccgaccttcgcactgtgaatgtgaagatgagcctctttcacagactggattccgtcattgctttcactgctctttcgcctgctttagctagatttttgggtctgtgaaagttgggtgtgcaatgggagggactgaagcttcttttttccctaattgttacctaattggaactcgcccagagggaacgggtggagaatttgagagcggtcgctgcagttagctgagtttctttttaattccagggtcctctgctataaataactgttttttttttttttcagattgtaaatatgtaacaaatgcatagggtcaaatttatgaaaaccaaaatacgtggggcaaaaacaccccacaaatgatcatttccacctgcttttacttcccttggagggattgtgtgatttattatgcgattgttttaaatgcagtttttcattcattcgagtttctcgaagctaggttaaacaatttctttttttttctttttttcttttttttttttttttttttttggagacagggcctcactctgtttcccaggctggaatgcagtgctgcaatcgctattcactgcagcctcgacctcccaggcttaggtgatcctcccacctcagcctcctgagtagctgggactacaggtgggtgccaccgtgcccagctaattttttgtatttctatagagacggggtctccctgtgttgcccaggctggtttcaaaacgtctgggctcaagcaatccccctgtcttgggctctcaaagcacaggggttacagggatgagccaccgcgccgggcctgaagttaactgattacaatgtctgagaaagaactggagcgtgtagttagttgagcctcccgttggccaggcacagccaccttggtaagtgcatgtgtgtgtccttgttgcccttctgatcctgagctccaaggaacaaggctgtcttgggagtgcggtggttctagtctcgtgatgggtgagtggcgccgtctgaccgaggtcaccctggcgaatgctgtggctgctcgggagctggggcagagaagagaaagccgctgagggtccctctgtggaccctgaagggagagggaccgatatgtgaacatggcagctgttttctccagagccctgtttactgacggccgaacagtgtgaatcctgagacggtttggatttgggtctgaactgggctcgtctggccacagaagaacatgagctggtggcatcctcaggaaatcagggtgtgaggcaactggacgtggatggctccgggtccccccggccactgtcctgaagccgccagaggctgaggacgcatgggagtgagcgtctcttccctgtccggccacaccctctgtgactggtgactcatggcgtggccctgggcagcatttaggtttgaggtctgtagatggctccagtatactggcttctcttgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctccgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcgtgactgattcacagcctggctgcgcttggtcttgagaattttatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaaggtgccaagacccccacctgccctcctgtgtgcctcaggcccctcctggtcccaggtcacccacaccgtctggcttccagcgagcgcttctcggagaaacagccagctccccacagccagtcttggtcagtcctgagctcgggtactccaaagtgaagtgagcgacatcacctgtctgaaaagcataaggagactcccacgtggcggtgctgaggggccacatcctgggcaccaggccagccagtgccccgacatgagtgttgctggccgggaagcagctggcatttggattgaagtcctgcaaaaactgccatggccagagcctgccaggcagagcctgcacagagcggcccaagagctgggcacgtgctgggcctgggtggatgtggaggctgtgccatggggcgcgggggaccctgctcacagctcaccttgtggtcacccagcactgaccctgctcacagctcgccttgtggtcacccagcactgacccacccgccccaccctcctatccaccgtgctgtgaactcacctgccacgggtctacacccactgtccgaagccctcggcccacacgggctccaggccttgggatgctttgcgttgcaccagggctgcagagtccagatcgctcactgtccgactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcaggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacacccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctcccgttgcttttccgtcatttattttagcaacttgtttcttctgtgctaaggatgagccggatttattcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacaccctcctgggcaggcggtttcaccaacatgtgccttgggaggggtggattctgccagtcgtgggtgtggtgctgacacccgcatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagccctgctggagactccttagttcagcttagcacagaacctcggaagacagcagttctattccgggtacttccttcagagctgagttacagtgcagggaagggagcagaggagccatgaggtcggctgcagcttcctgtgcgtccgagcctcagcctcccactcgagctgaggggcgtgtcctggccatctctctcctgggcttctccctgtgttccccagtgctgtggtggtcttgcagaggctggccctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccttgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacagctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacaccccacttcatgctcttactcttggctgagtcccatggaggcccgttagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactcactctcccacagctctggagcgcaggagccatgggctgaggccagaatgtttgctccaggagcgtccctcgtggtccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttagggcccacctgggtactcctaggattcacctttatcaccgcatgagggagcattcccaggttctagggattagggataggactgggattcctttggggactgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggacccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcccggctgctgcacacccttcacctctgcgggatgctgggaccgcatgtttgggcgcggtgggggggccttgctgcactcactcttgggggagctctgggatggtgggcgcgccccgggcctgggctggagtgactgatctcttctctgtgaccagacctgcgaccgcatcaagcagtccgccagcggaaccaagcggcgcgtgttcatcatcgagaccatgggcggctactgtggctacctggccaacatgggggggctcgcggctggagctgatgccgcatacattttcgaagagcccttcgacatcagggatctgcaggtatgtgacggggctggcctcagggcccgtccccttgggatccactgggtgctacggagtgaatcatcgtgtctagggtggtttgctttccgaggggcatggagatggagatgctacagaacacgccacgcttgatacacttcgcatcgcccaggtgcccctactgcgtgtcaggtgacggcgggtgtgcctggttgaggacaccttctagtctcatgtgtgaaacacaagcttgtttgacgtagtctgttgtgtagttaatgttgtctcacttatgtcatcaatgattcgagaacctccgctgacagtcaccacccacgtctgcgacaggctctgaaggttgctgcagcttcttttaaatcctgaggcccctgatgctgcgtctgcctctaaacggacacagacatgaccgtggtttctcggcatctgtggctcttttagggaagggtgtcgctgaccccgcggtctgcccctgcttggacgacacagcagaatccaggcctggaccctgcaacgttcaaagttgctaaacttcatgcaagatgacaggccttggcagataaaatgcaacttgaacaattgtctttatttagagagggagtcttgctgtcacccaggctggagtgcagtggcgtggtctcggcttattgcaacctccaactcccaggttcaagcgattcacctgccttagcctcccaagtagctgggattacaggcacgtgccaccacgcccagctaattttgtatttttagtagagatgaggtttcaccatgttggtcaggctggtctcaaacttctgacctcgtgatctgcccacctcggcctcccaaagtgctgggattacaggcatgagccaccgcgcccggcaccattgtcttttaaaaagtttggctcagaaacaagtaacatcctaacagatcaagtaaaaagggccttggcactaattatgtgacatgtgaatcacgaatttctttaccatgtcaaatatttgtggagtcattcactgcatcatgatgtttctgtcaacagtgggtcccataagattataatggagctgccccaaacaggtgcagtttatcttttataaaaacatatctttttacatatatttttataatatatattttataaaaagatgttttttatcaaaaaatatgtatctcttactgtgcttttctacgtctagacatgtttagatacacaattgcctgcagtattcaacagtcccagacattcaggtttgtagccaggaacaacaggtgtgcagcaggctctgcctcctgggtttgtgtgagttcactgtaggatgtttgcgcaaggcttaagtcacctagcaatgcatttctcaaggaacatatccccctgttacatgactcatgaccgtatttcagaaatctgtccaaagatcctgcctcaccagcgctcagcatggcaagggcttaagagaaattatgacagatttttattttttgctttaatttttgagatggagtctcgctctgtcacccaggctggagtgtagtggcacaatctcggctcactgcaacttccgcctcctgggtttaagcaattctcctgcctcagcctcccaagtaggtgggactacaggcacctgccaccacgcctggctaattttttgtatttttagtagagacgggggtttcaccatgttggccaggctgctctcaaactcctgacctcaggcaatctatccgccttggcctcccaaagtgctgggactacaggcatgagccaccatgcctggcctcctactttgtgaaattctgccattgcgcccagtgacagatttgattagatgtaaaaacctccattttcttaggatgaatcattagagaattacctccctcttgtaatcctcctaacatgatctgaaatggggatgttcttactctaagaccatcttttccttaagaaatctgtgtatgaatgtgagtctacaaaattctttggtcagacactgctcatcaggccgtcacatgagattccatagaaaggccacaggtcactctttcctctgagagcaccgagaacatcgtcatgcaaataaacaaggagcaatagagccatgaatgatcactaggcaaagcacggaattaccattttcagagggaccctgttgactctggaaggtgttgctagtggccgccgtgagggctgctcaccgtgccctgtcctcagcgttcatcgctgcagacgtgtcctccctatctgggaggaggctccccaagacccaagccgcgagagctgcagcctccttggccacgctcactgccacacttggttggcacttcccagcctgcagtgcctggcacacagtaggtacttagtagaagtttattgtctgattaacaaaatactctcttccagtccaacgtggagcacctgacggagaaaatgaagaccaccatccagagaggccttgtgctcaggtgagagagagagaccaggggctgatcttaccctcaccgccacaccctggttcttagattctagtctgtgacttgggctggatgagtggtcatttctttgccgctagagtgcactacacacactgagcaggtgcagaagacagctgtggtgcattgctctaaaggcttgcctgcatttagacaactaatatttttgctttatagtctcttattctttgatatcttgcaatcatttccctaattagcacctgatgtttatgaagaaagaaggaaatacagtcatccctcttagcctcagggactgtgtcccaagactgcagtgggtgtctgaacctggggatagtacccgccccctgtatacacgaggttgcttccatctgataaccaaggcggctactgagtgactcgggcaggaggcacagacagcatggagacgcagggcacagggatgattcacgttctgggtgggacagagcaagagagcacgagatttcatcacgctactcagaatggtgtgcaatttaaaacttacatatttatttctggaattttccatttaatatttgtgggcctcagttgaccactggaccatgggtaacaaactgcagaaagcaaaaccgtgaactggagggactggtgttgatgtagaatcaccatagggttgggggatgcgggagtccagcctcccagggccatctccccaagcagggagccacgtgcccactgcacgctaaacaaagtgactccttctcgctcgtttcagaaatgagagctgcagtgaaaactacaccaccgacttcatttaccagctgtattcagaagagggcaaaggcgtgtttgactgcaggaagaacgtgctgggtcacatgcagcaggtaggcccgagactgcatgaggggccacaaagccactgtcatgtgacttttaaaagattagtgtcttattttagccattgtggggaaaaatgtataagtaaattccaagatgataaaaaacatctgaactttttgagacagagtcttgctctgttgcccaggctggagtgcagtggtacaagcttggctcactgcaacctccaccttccaggttcaagtgattctcctgcatcagcctcccgaggagatggcagtacaggcacccaccaccacgcccagctaatttttgtatttttagtagagatggggtttcaccacgttggccaggctggtctcaaactcctgacctcaggtgattcacccacctcagcctcccaaagtggtgggaatacaggcctgagccactgtgcccagccaaaacatctgaacttttaagtgatgccaaacatcaccagctttaggattcttttgttggtgaggtttgagtaatggggattttaagggaactgtcagctttcatgaaaacagtgatacccccattacttggaaatgcttattcaaattaaacacttcatcaagttaaaaactggagcttccctaagatttaaaatggattatcagacatgtagtatacttgacaccccaagtcagaatgacctggaatgagctgcacacaggcacacacgtgttatgagctgagcctgggacacagggtccaggcctcctaacttgcacatactccttcctcaccacctcctattcttatacttttaagccagagcccatgaatcccctgcaatgatgatgaaatagtaggcatatgtgtgatcttcttaaagaatccacaacggttatcagattaaagctgtgacccatccccagctcagatgagttcatgaaatcctgatttaagattttaaaataatgaagattgttagttgacttgttcagtttattaaaatcctcatcttactgagcggggggaacacttgatactttttcttaacaggccaagttcaggctacgggaatcacaggttttgttctgttccaactataaggacctagaaataaaaacatgaattctgcaaaatagaaattgtcatttctatttaacagcaaagtgttactgtataactggtatttcatataactctaaccaccaacagggtggggcaccctctccatttgatagaaactttggaaccaaaatctctgccagagctatggagtggatcactgcaaaactcaaggaggcccggggcagaggtaaggggtctggggagggaggccacagcctcgtgatgcaggccgtcctgccttggtgaaaatgctgtcctatcggggagaagtagggtgctggttccttcttcagttcagtactgagctgcacgtgatgttttactcctgatctctgagtgttgctatttaaccaaccttggattcctgggataagatcagcttgggtatgacatgttctcttttatcactgctagatgcagtctgcagttcttttgtgcaggctttttgctctagagatcctgaacgttggccagcaatttcccctcacagtttaagtggggccttctattttttgaatgtttgctaggacaacctccttgtgactatccatcaaaacttccagttttgaggaagatctgactgctgaatgaattgttcatgtttgtagaactgcatgttcgtagaactgtgcatgttcttccttaaatcagttttgtaagttacatattctaagaaatctttaaactgaagtttcaagaaacatgacttttttataatactcttgttaatggttccaacatggctgttccccactcattcctgagtggctctttgtgccagcatctttctcacccccacccccctcagctttcttaatcagtcatagcagatgtgtgcttttattccggcaaaccactatcactgccagtgtccaacttagaaaaatgacagtctataaaaaccagtgatgtgaatagtttcaatgggtttgtctttttgaagaactgactttggctttgattctttctacagcgattttcttttgctaatttagctatggatgctttttgcctctgtgtgtgtatgtgtgagcataaattagtgtcctgctgtaatttaagctaatttccctattccactatttagtgaaaaattctctccactgggaggaaaaaacaaaagctgctttccaggaagccctcagggcagtcccacaggagcagagctgcacgaggccaggtgctggccccactgcgcggctgttctcagtctcactgggcttccaggccgggttcagcatggttctgaggaatctcagttctcatctcgccccgtgattctgctcccccacctgcccatgttgacagggtgttattaatcttttttaaaatcttttataggaaaaaaatttaccaccgatgattccatttgtgtgctgggaataagcaaaagaaacgttatttttcaacctgtggcagagctgaagaagcaaacggattttgagtaagttggctgggttccctgaggcaataagaccccaatgtgagtacgggacaggggaatggccattgctgttgctgtcggcaactcattcaggggtttgaggaactggcttttctgaagctcagttaaaaaaatactaggtcttggctgggcgcggtggctcatgcctataatcccagcactgtgggaggccgagacaggtggatcacaaggtcaagagatcgagaccaacctggctcatatggtgaaaccccatctctactaaaaatacaaaaatgagccaggcatggtgatgcacacctgtagtcccagctactcaggaggctgaggcaggagaaatcgcttgaacccgtgaggcagaggttgcagtgagctgagattgcaccactgtactcaagcctggcgacagagagagactccaccactgggtcttcgggaataattttaaacaatggtttcatttgatcctgaaattggctttatcatctagttgattcagccgaccctacaaaccctgtgtttctggcaagaccgctcgctgtgctggccaggcggaggcatctcccgccagtgactgcaggcctcactgctgtctcctcttacctccacaggcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagccccagtgcgtgctgtctgtggagtgtgtctcatgctttcagatgtgcatatgagcagaattaaacatttgcctacaactccaacagtcctctgttttagttttttaagtaggagattagtacctcaatctatgggtggctactaaaggttttctcagttttgtgggcaaactatgcacacgtcatacaaggagaacaaagccaggagttcacacaggccaaggggaaggccacgtttactcaccgttccatagctgccatgtgtcagtttccatccacagcagcaggccgggaccctgggcctcgaccccaggctcctgctctcctttgaaagtaaaacatgaatcttagttacttgtcctcttgattgcaatcctagctgcatgttaaaaccaccaaggggtgggtggggcggcggtgggttcaaaaatctgatagccagcttctcctccaggccaagccacagtcctcgctgggacctaggttggaactctccggaagagtcctgccagagtagacacggctgctgggatgacagccctgctgccctggtgggcccccctcctgtagggacagcgtttctgcctcttagctctagtctgcaagagagaacagctgcgcctcagaaatgggggcagagagctgggtggagggagaggagaggccaaaaacaaactctgtttgggaaatcagagtccgacagccaagaaagagctagcgcggaggctttcctttctggctctgtaacgatgaagcaagtgcttgctcaccccaacccacttgcttctcaggacggtttccatgcagccgccgcggtgaactcccgtctggtggacactcccccagggcctcggtgtgatggagtttcctgaatcagcgcaggcagacgtgggacacccttgtgcaccttttcattttacttctgtttttaaataaaggccctaaatgctgcttaaaataatgactcaagcagaggttaagtcagagttgccctttatttttagattcttaaatattctagaatgaggtaaaacgagcctgccagtacaaagtgaaaattctacatggtgcatctttggcgcttcatgcatgattatttcaatgaacctcttcctggtcactcttaagatagatctgagtttttgactcgccagtcaagggctttggcgacactcaatgacataatattcttggaaaaagcagtagcatttctgacttttcatattcagctcggaggtgtattgtctcgggctcctgtgcagtcgagcgccacggctgctcatcggatgatccaggatgggtccttggcaattttcgggttctcgggtccgaggatggccaggccgtgtgtgctcttcccagtgccgaggtacctgagaggaaggcaggcgtggtcagcgaggactggcttctgcgtgagcgctgttagagtcagcacgagggcttccagtcccagacgctgtctcccccgctccccactcacctatcgctcacggccaggagcttgtcgtggctgacagcaaagagctgctctctgtgggcctgcttcatctcatccgagaggccgtacaagaagtggtccattcctagaagacaatccacaggcacgatggagccgctgcccgggagctcgcgttgtgggctgtgcactcatgtcccggaggggacacaggcatctcactgtcatttcacgtgcatgtttcaaccacagggatgtgtctaacaacccagagatcacaccccgaactccagctcccacgtgccacgctgacccctacccacgcctgcttctgcagcagggatgcagtcagcgccgcgtgaggctgatgatgctgtgagcaaaagcggctccagagagtaacgtggccatgcccgggccgtgcccacgtcctccttccaccctaaagagcccggacactgccatgggttggccccactgggtctcaggtcagtaaaacaaatgacaggatgcactcttctcgcccggatgtcaggaagcgtgtttagggtgtcagacgtggaaatcgtatcacaagcaaggatggaggcaccagaagctggtgctcctgcccatgcatgccgggaacttggaaaacagcaacgtcatctgtgaggctgtgggttgagattctcactgttatactcaaaatacctttgtctgaaggagcgacaggagcatctacggttgagaagacagaaagtttggcttcgtcgatgtcttgctgtgtgaattttccagacttagcccagtcgacagccttcccaaaagactggagcgtctctattgtatttgggtccctaggaaacccagagaaataaacgggcaagcattttaccaatggacaagtttatgacaaacctctgtcgacttaacagttcaacatcttctatgggttaacagctctattttatatctgatttagtccaaacagcccactgacaaatcgctcaattactctcaatggaaatttaaatctgatcacataagcctttcaacacgttctccctcttagacaaggtctgtctgcacaaagtcctccctagattatttaaatacacttctctgtgacctcatcaggagaggaaagtcagtggagggtaggggcaggtcaggattacagggaaattacaaagacttacatggaaaaattaagcaaacaaaggttttcctttcatctccctgaagacacacccagggtagtacaggaatcagcctgagggggccaatccagacttcccttcgtgtaaatgcaaagagcccagccctcccttcaccctgagctgcagaggggcggctgtgagctgcttccccatccttgtctagaagcatggcttccagcacagcaagggggagaactcatcagagtggcaatggctacctacgtatctacctacatgcctgcctacctacctaatctagctatgcatccacgggacagggtctcactgtcgcccaggctggtgtgcagtggcgcaatctgctcactgcagtttcaacctccccaggctcaagggatcctcccgccttagcctcctgtagctaggaccacaggcacttgccactgcggctggctggctccttgttaaaaactgttggaatacatgttctcttaggcagcaaagccatagaaaatcaagaatattgctttacagtaacggtgttatgtttatgaaagctaacagaactgcatccacatcaggcacctccaactgaaatgagctaagaacgctctcaggctgtatcagccccctcacctggggcctgtgtttcaggacccccacggcagggctgcaacctcagacagccactatggatactatgtttttttcctatacctatgataaagtttatagattaggtgcagcaagatattaacaaaatacaacaattatactgtaataaaagttacgctgatgggctactattaagtaaaacaagggttctgtgaacagaagctcttggatacccacagcgtatctgatacctagacggctactgggtgaccaacaggcaggtaccgtagacagcgtcagctttcatcccactgcttagaagaatggtgtacaatttaaaacttaggaagtgtttatgtctggaattttccatttaatattttcagaccgagggggactgtgggtaataaaccgtggaaggcaaacccacggatggaggcactaccgtgttctgccaaaatatgctggctgaagccagggtttactgaaggcagaatgcttcctgtttaggctgctggccctaatcctcgcgccagaaaggacattgctgggtgtggctaagtgcccaaggagtgaaaagaagcacacagaacaacttttgtctaaaattcactgcagtagaagaaaatgacactgataatcatgagtagaagactaaaacgacgtgtgcatcccaatgtgtgaactagagcaaaactcacctgtaagagtaaagggtgaaaatcccattgtggctgagttttgcgcctccaccataagcaccgcctttttctcgaatttctgtatgcaagaatttggcagtcatcaaacgtgcaaggattttaagactgaaatgattaaaaaatgcaagttaataccgtggctgataaaaaagcatagacaatgaagtaattgttggattaagtgaaaatgaaaatcgagttgtaaaataatgctgcataaattatggtcccatattttggtcttgttttttaagagatggggtctcgctctgtcgccaggctggagtgcattagtgcaatcacagctcactgcagctttgaactcctgggctcaagggatcctcccacaacagcctcctgagtagctgggcctacaggtgtgtgccaccacgcctgactatttttacagtttttgtagaggcagggtctagctttgttgcccaggctggtctcaaacacctggcttcaagtgatcctcctgccttcaaagtgctgagcttacaggcatgagattttcttttcaattaaccaaaactaaaaagcacaaggaagcacaattttcaaacagttggcttagattacagggttgaagggagaggtggtggggagggaatcttaacacttccagcaccacactgcttaacttgttccaatgcacatgtggcatttttaaaatctcgtgaagtagaaagaggttatttctattataaaggcaaatgagcaaatgaacatttatttaaatgtctcacatcagaatatggaaagaaaggaaactgaagtgagttttataagaatcccttaagaaaacacacactctctgataaagcacatttctaggaacagggccgatttcctctgccttccactgtgaacggtaacatcacattcaagctgattctagaacacatccacctccgacagaaggcggggcagacaatgatgggagggtctgcagcacagacacaggctccttgaagacgcccgtggtgagatcagccccaggtcgccgcttccacagacaggccttttcctaaagtggatgaagggagtcaaataggccaggtgggaaatcaaggaaggagtgggcgtgttcccaggggctgtggtgggagaagtcacgaccatctcgtgtgggtcctccaggagaaacccagcgccactcgggtggctggggcgccgtcagccgggactagcgaggctggagtcagaccctgggggacggagtctccaccagcaccggcagggatggcgttccatccgtccacacattatccttcctgagaaatttctattacttgtatattaaaaacatgctcacttttgaaagattataaaatacaaaacacaaggaaaaaaagatctggaatcccactgcccagggggaacctccacatttttagtgttttctgtctacattttcctgttggatagtggaaacagacaccactcttctgccggcatagcagacagatctgttcatcttctacaaatatggaaataaatgaacaaaacagctgaccacatacttctacagccagctctttctgggcccccactgcagccccacgtttcttcccgcctgcctcctacacacctccccatctgtggccctctgtgacacacgtgcacctcggaggcccggctccttctccaatcaggacaggctgcccaggcctaagcctgccttccccctctctaccaggctcactccttggtttagtccctcatgggggtagctgcctgggacaaggacacaggaagtgaatttccgggatataacatgtttgcacatatctgtgtcatacacacccaactgacgggtccccaaaggtgcacgtctgtgagtctgtcctggtctggccagtttccccagatgggatgaacacagccaaggggcagccacagttcggaagaaggggctggagggccagtctgtaggctgcaaactccctcgccccacgccactttgggaacaggcctgaccctgactcttggctgtggcttcggctgctcaacccagggcctccttccctgagcttctgacttggtggggagacaggggagacaaactccttagagggactgtgaggcggcctccagccctgccatctgcagggctctgcaggaccacctggtttctccccactgccctgtccctctgtggccccaggtcaggcaccccccacccacccagagtctggctcacgaggttctcctgcagcccccatggctctccgggtcacctcccactctttcccttgtagcttcgtgtcttgatctgcctttgctgtcattcacgcatctgtcctcatgaaggcttaacctaccatgtttatcggaaatctcagcctaaattcgatttttacctagagatgaggtgagtacatggggcatgttgaaagcagtctgtgtttaaggtcataggtatctgtattgttcataggactcctcaataatagaaattgtttacaaaaatgactggctctaaaactgggtctctgttcacaaagactgctggttaaagaggagcactcgtagactcacacagccccaggtccaacactcagagtcagcacagacttttcctgtgctaaaacacgccctgtgaactcgaacagccttgacaagctcttccgtaaggctcaggcctgagaggtcccgacctacaccctcctacctggcatgatctgggtccgtgtaggggacagttcggatgcattcacccacgtaattcaccgggaagggcatcaggaagtgagtcttcatctgccagggcttgaaggtgggttcctgagggacacggtatggtcagaggcggctgtgctgccatgcaccgcccacggcactgggactggacccactcaggggtcagaggcggctgtgctcccacgcaccgcccacggcactgggactggagccatctcaggggtcccatctccgtgacactctgcagccaggtgctggggcgcgagagcaaggcactgcagttccgtcactccacacaatttctcactgtaaaactgacatgaagtcctccaatcttgacgtgatgccttaacgtatactgttcaattaaaaacatttcattctacgccgtttatatcacagttacatatttatatttcatatcatattatatcataggaatgtgttaaatcactctactccacaaggaaccaaaccaaacagcatcagcaccaggctgagtcgcggaaaggatctgtcagaccgctccactggcatcgactcagctcgggagctacgttcaaagaagggtgagttgcccgggaggagaccacccagagcagtagccctcttcctgggcacagggaagacgcaccccataccagggccctcctcggcacaggaggacacacccccaccagggccttcactcagtactgtctgagagagaaaaggctcagggtggcagtgacaaaggatgcactgaactcgcaactctagggacacgccagccccacagacaggcggacggaggaacattcgaacatcagtggcagacacagccatgcagggaagcacccacccgctgggaacccggatgggctgtggttcttaccatgaccagcttcctaatgacctgggagccatggggaacgtgggcatctccaccagagctgctgggcacaggtttctgaaaatcaagtttccaagagaaaagagaaaaatccagaactcacttgaaatatataagaagtaacagagtttataaaattcacacagctaataacaagtgttagggcaggtgtaagtgttttaaataataaacgcttaaaaaaaataaaaataggctgggcacagtggctcatgcctataatgccagcactttggaggctgaggtgggaggattgcttgggtccaggagtctgagaccagcctgggcaatgtagtgagctcccatctcaacaaaaaatttttaaaaattagctgggcatggtggtgcacacctgtagccccagctacttgggaggctgagattggaggatcacttgagcccaggaggtcacggctacagctagttgtaatggcaccactgcactccagcccgagtgccagagacagaccctgtctcaaaataacaaaaactaaaaaaagaaataaagtgagtaaaagaaattaagaaaatattaaaataaattttcagacagtcaaggaaaaggtagccttgttatatggtacaaagaaaatattttaacctttctttctgcactttcttgtcattaatctgtcaaatcaagaggacatttaaggtgaaagggttgcaggcagaggggcctggagcagcaggaggccacctcccaaaggctccactcccaggggccaacagagagaccacatccagaattgaaccagggatacgcagacaccaacggagaagacatgagcgtcaacctcctccacggagcagcacggcttctctactgacatccatgaactagactacaactctctaagttaatcaaatttactaagttagttatcaccgacatcactgttccatgtcaaatccatggattcatgagtcaaagaaacagcagtgaacagccttcaggctacggtttgggccattcctctgccagcgtattccagccaaagtctgttttcctatcagactactcactgcaaggcacagaagtgagcgcgggatctaaggccacaccgcagggtctgaactcacttaactggcccaacactgcacaagatacttaatcctcctgaacctcagtttcttcatctgcgtacgggggatatgaacccccacatgctggactgctctgagaattgagttaatgcgtgtaaaacatgagagctgctctggcacccgccaggcgctcaccgggcgccagcaccaccagtgcatacctcgaccgtgtgtgggcgcacaggcctccgttcctttttactccgaccgatgcttctaaggaagtcttcgaccgctttttctgtctgaggcatctgctgaggagtcgcattcactgaacacctgtttgaaaaattacgtatacataaaaccactgttagaaaaaacagttttagtaattcatcacattttgtataactcaataatgttgtttttatagaaaatactgttcagagtgttaaacagcagccaaatgtggaaatgccacggccgcctccctgctcttcagtgcttcaggttatcaagagatttccgcacagttcaatgtggcagctaatgaagccgtccatacgcggagcctgtgactctaaactctagttcttctgaagagcaaagaaaatacagagactattaagatctgctaaccgtgccttcggaattacactatcaaaacactgacaacttttaaaattactgtccagaagtcatcaatttgaaaatgtgaactggttgttaaagcagaacattataaagtgcaaaaaaataccatgctctcaaagttacatgaaaatagaactcttccaaattccacagaattgcaaatactactatcatataaaagctacttgaactctacagtatattgacagagtgtatattttttcctttcagctgtaaatcctgaacttattctagttaaagtaacagcaggtaccattatattaatactaactatatcccaggcatgtatgctgccttgcagatattctttcttttattccttacgataaacctgcaaaggaaggttttatggaggaggaagcagaagacgcaagtgggtcagctgcccaggaccgcctgggagcgagtgtgagtgctgacccggcggcaccagaagccaggcctgcctgagcccaatgccaagagaccctgatcgccaggcttcacctctggccacccacagaccgccctgtagaatctgccagggattctcaggacatgactggggaaaggcatcaggactctctgtgaagaaggacaagtgacttcagcaaacattttcttgttaagtactgatgaatacatcaatgtcactgacaataagatgctgaaaataaacaatcatttttaaactttattcatgctcacacatctgagggcataaggccaactgaaggtataggactgagctgccagatgtttcctcaaagcatcacataattttataagaaactgcacttttactctggtcttcagcaagctcacctttacagatacctcagttacggaccatgtgcttttggaagcaatataactacttgccctcaatctatttgcacttctagcacaaaattagcctgctttcttccccatctcctacaacttttaataggcttaaaatattttcttagtttgttagaacacttgacatttacaataaattctataacctttaccaagcactctatcttgaagtttctacaagtaagaaatacctaaaaactatacttaatagaatgaatcataaaatatttagaaacaaatcacacatgcacctcatattatcaccatttaacaagtgtttcttgatacgtgggagcttcctcaggatgggtttgatatctgtcatttctgcaatcctcttcatcagccgcacctaagccagaggaaactcgctcagagagaggcagaggctacaacagacccgctgagtctgaaccaagcacctgtgacatcagaaccctgcttgggcaggggttatgtgtgcgagtgcacggcttgggcagggctggaactgggatgcagggtggtacaaagaggaagatgagtcaaaaccaaccaaccaattcttccccatatttagtcagttagaaagttagcatttctgggacataaattaatgtattcccaaagaaattagtaactctggaatatgtggctaaaccggagtaatagaggttccttccaagcttcccacctgatccatcccgctgaaggtctcctgcaggtcccctgcgggcgtgagggtccggcctgccctgatggatgcgtacaggtgcccagagtcaggaattccattggcgagctcctgggcggtcatcttcaccagcaccttgaagtgctcctcttcttcaaagcacgggctatggaaaaaggagaagaaaaaattcctggagacccattcctcacgtcccttcagtatcatggaaagttgattaagttttcagagtactttaacaaccaaagaaattttataagtccatatgaactacaagtaaaagtcagacttggaaaacaacaacacacacgagtaaaactgtctcctttaaagtacttcaaacaaagatctctagtacaccccaagaatggacaactcttgcaaataaagttacttgttaaatatttcactccatagctgcatcatgtctggcaggtttcgatccaggcagagagaggagaaaagcacaccctgaaccaaggaaaacacagaagaaaggaattagggccgaattgaacagtgacagacactggagaaaagcttcccaccgcagcagtcgtctgacggtaccaggctacctgctcgtaggtgtccatgtgtgagtcgtcggggagcacgtggggagaagcactcatccctccggtcttcaattctatctgctgagcctgctcccggtagtcaagaaggccgcagcccagcctgacacagcagagaagcatcgccccgattacaagtcagtctttactgaatcatttttaaaatcgtgcatcttgagttacaagttgcttccattaattcaataactgcggctttgccaacctctctacacttcgaaggtcataagcaggtgcactctggccttcgccctcgagagttcatgtgcccccttccccagggagaccccagtttctcccgcctaggaagttagcgtccagaggcacaagacacttgggcagccagtgtctgcacttaaaacaccattctaaaataggcatttccagttgtaagctcttcaataaatgttttatgactactccctactctcttcacccagatcaccgtgatacatacttcctttgttttgctcgaatgtctggtagcctgggcgggggagtccgaagactaaaggttttttaagtttttaagaaaagcagtttcctctcagcactcatgcttttgaaagaaacattcacagtgacactgctaatgccagcaataattgagtcaagggaatgaccatgaggtgttttctaaaccgctacaaaaggatgaacagtggcagctatatttaaaaagaaaggcagggaaccttcaaaaccctgaagacatttttccatctgagcggaccctcagccagggtgcagaaggtgtcacagccacatagctttctgcagcacgcagacaacttcatctccacagagggaagaccccagctgcatgtcaggttgggcagtggtccctgaagctggctgcagggttccctgtcgccctattattctggatgggaacaggagcccacagccctgtctactgcttgtcctgcaacctcggccacggcagagctgggcaaaaagtcaagtgttgatgtgtgcactcgtgtgtgtgtttccagatctgtgcacaccccacctagggaggacgacagcaactgcagggtcggcttggaggaggagccacgcacgcagcaggcacacctgttcctaaggcagccccaggccacactgcacatccaattacttacactttcggattaaaccatcaatcctttccaaagcttcataggctgagatggagatctataagtatctccttatattataccgtagattcataactatttcaatgtaatatagtaagaaaatgttactttcataaaaaattctaaaccaatatattgtacaccatacttacacactaacattgtaagttgtgattcactgaaggtaattcctactgatgcattagaatacagatatgcacacaaagcagacattaataagacacacaagggtatgttgcgactcgtacttggtgaggacgctgcagaagaggggcacatagggcctcagctcctcggggagtgtgttcaggctggagaaggcccggaaatacaccatgccattggtgggctgggcgcagtactgaacagggatatctccagctagaaaaacaaaagggatttaatttttattgctgccagtaaaattctaaccacttgtaatatttaaaaacaatgctatttattgttttttcaagaatggaggtttaagacttatactagagtttatataaatttcccaatcatattttcatgactaaaaactggaactgtcttcaatagtaaagcaacccgtgctctccaaggaatgggaaaggaaggatggaaccacgaacttctggtctcataactgcgagttccagttacccaacctctccccgtcaaccagagggaactctgaccaggtgcccccgagacccctgggcccacatcgcacccgtcctcagcgctgctcatcttccccaacaggccctgccaccctctggccccacaacagaaggctgccccagggccccaaacaaggctcctggtgtcccccacccacccatcctgacctcaaggggagggctggacattcagcttcatatgtccctacctagcagagcaccctagaccagcggagggaccaaggtgcggaaggatgactgatttattctcactcttagcaaacacttaatgagattcacggacaaaaactgccagggttaacagatcagagagatgtcagcctcgagttccactcacatgcgcccacacacacacacacatgaaaataaatgagatacaaacatgacaagcgctgtcagaagacaaaaggtgggctggagacgcttcacaggacacagggatgcccagggtgaaatcccatccccgtcctcaaggtgcaagtgagagccatgctgccctcagctcagtcacgtccggccacacccgctggtaagctcagcatcaacactgtcgcaggtgaggttaccccaaaggtgcctctcctgctactagccaggagccagagagaaagggggcaccctgagaactcaaaagcagtgacagaccacgtgacaaaaagtaccacggaacaaaaggtgccatggaatgaaacgtgtcacggaacaaaacgtgccaaggaacgaaatgccaggacacggcagggggataaacctggtctccaacttcctttcaactcagcactcagctttctgggggctctcgtccctctgcttcctctatgctgatggcagggtaaacattaggaaaaagggctctgaggacgcctcgatttttaaaactgcgcttcacacagtcacagcgtaacccaaatcctcatttgattctagaagcaggaaatcagagcgccctatcaaacccctctcaggaacacacacacacacgggctcttactgagtgaaggagtctatcaccaccgagagttaagaacaaggcagaagaatcgtgtagagcgagactatgaacgcacagggctgctcaagtgtttcagggaaaacctccaagacatgactctactgcttctgtgaggagtgacatttaattcccccaaggaacccgagacccgggaaaagcgtagcgttcacagtgacctgtcaggaccacgtccaactctgtgacaggtatggtgggttcaatatcggaaactttcaacgctggcagacaagaggcatcttgaggtttgctttgttgactccgtaattctagacctaaaaaagaaacaagaaaaaggaatattcagggccataattaaaaggtttgatgcaacttgtctcctatgttattatcttaacatccagaattagccgtccacgccaagtgtggggagtacaggagcactgtggtttgcaaagtatctcctatttccaggctgaccatatttagacgcactaataacctgcttagtgggtagcccttttcctaattctcattttcaattattaaggaattctgctaggaagtggtggtttgctcaagcagcttctcctgcacccctccaaagtttacattaaatagattcaacttgtttttagagttttcaaaccatttcttgatggactgaaatttagtgatctttatacttatcttctttttgttttgagacagggtctggctctgtcacccaggctggagtacagtggcaccatctcagctcactgcagcctctgcctcctgggctcaagtgatccttccgccttagcctcctacgtggctgggactaggggtgcagaccaccatacctggctgatttctgtttatttttattttttttttgtagagacgaggttttgccatgttgcccaggctgtctcaaactcttgacctcaagtgatcctcccaccttggcctcccaaagtgctgggattccaggcatgagtcactgcacctggccctatacttgttttctattgtttcattttcactaatttcagcaaaagacttacacaagcacataaatcacacaaattacagtggtgcttagaaagacacttcctgggcctgacagtgcatgcatcaatgagggaggcagcaccttcacagcagactcctccactgagccacagcccatgtggagaatccagaagacccaggcgtgctccccgccctgatggccatcagtgaagcggcttcacagtgctacaccgagccaagcaagtatacaaatgcatgattccacgactcccggggagggctgtgcccagttcccactttaactcagtccccgcagacagcactcctggtgtctgctgggctgacctcccccatgttccatttccaccttctgaagttccccgagagcgtgccacgcacttagacacgggaccttggggcgcagtgagcatctcaggcagtgtcatccctccacaggtgccccactgtgggctccagcccttctgtccacctctggagccgcaactgccatcaataaccacccctgctcccagcagcatgtggagcccaggctcccaatggcacggagctcagacctgggctctgcaggcttcccctgcctgcttgccacctacctaacatcctgactttcccgacctcacgccactcggagattttctaatctgtggctttgccacaaagctccctcctgcctcttccctgacccggtttcccccgtggtccctgggcccacctgcgctagagcacgccacagctaccctgacatccagggctccttctctgaatgcactcactcacagttggtagaaaaagcctctggcactttctcttctctgttttctttcagcacatcacacactccctgatggtggaggctttaccccttcacagtgcttaagacacacacaagaccagaaatcggaagattcaagcttttactacatagtttcccattccccttttctgcattgttgttctctacagattggcttttaattcacagaaccctaacactgccatgcacacttgaagacttactgacctgaaataaccattcaatgcactagcactgtgccctcctttcaaagagctacacagcgagtgtgtaaaggagaaatctgtagtgtgagcactgctcattaacctactggtttggactacagtatacggggttttcttaaagcacagctctgaggccaggccacgaatatgaagtaatttaggaaacgtacaacctgttgcctactcatggaattatcttgtgtagtcatgaataatttcaattaaaagcgggaagattggagcttgtcacaaaacagagcttaataaggggggaaaaagagtaaggttaaaaaatagagcttaaaacagttgtctctagtctccactaaaaatacaaaaaatcagctgggcgtggtggtgggcatctgtagtctcagctacttgggaggctgaggcgagaaaatgacgtgaatccgggagggggagcttgcagtgagccgagatcgtgccactgcactccagcctgggtgacaaggcgagactccgtctcaaaaaaaaaaccaaaaaaacaacaaaaaaaaaccagttgtctctaaacaagaattcagatagcaagagtaagagcaggttacaaactgacattaatttttcttttacatgatgtaacttcaaacttagcatgatcaaaatggagtcacttactttccacctaacgtccactcttacctcctgacaagcctgacaatttctcacagaatcccagcccaattagcttttttaataggaaaagtaagtgcatgtgtgtatgtgttgcatctatttttaaaagacttaatacataacttacaagcaataatattcacaattttaaagactcaactgagttctgacaactgtggcaagctatgaagccaccacatcatagtactgggcctttctagcaccccaaaactctcccatccccactgcagtcaaccacaccccgactgggcctccagcagcttctcatctgctctctgtccctgcagctttgccacatctaggcttcccatgaatggcctcaggatgtcatctggcacccggcttctttccctttgtgggaagcttcgagatgcaccaataccaagcatgcatcattgttgcgctccttcacagctagtggcatttctttgtaaggatgtatatgttgatggaaatctgggttgtttcaagctttgtgcagacgcctgttttcatttctcttgaaggaacgttaggagcggggctttcctggtccgtgcatgttggctggcactgtgagaactgtgaccccgtttcctaggtggccacaccattttggctcctttggcagcatgtgagcattccccctgcctctcaggattgatgcatttggtgctggcagtaatttttaaaatgttagtcattctagtaggtgtataattgtatatcactgtagttttaatctgcatttttctaataattatgatacatttccctaagaaagtaatgagattatttcccatgtaatgatttatgtgcctatttgccattaggaactcttagatgatatctgtcaaaatcttttacccatgtgttaattgggttgtgtgttctcattactgaattgttcgtttttcgtatattctgaatacaggcctttatcagacaccatttttgcaaatgttttttcccagaggccaaactacctttgagaatccatttgggtccccttctctcccgtggcctcctcccttccttcgttccacccggctgctcccccagcggctgccaatccccgtctcacttttcttttcactcccaccatcctggcctaggtcgtcatgtcatgcttaggtgtctaattgcctctcagcagttttctccatccaatttctctatttttctgcaaaactatcctgaatgaggctgcagctacactgctcactgacccgacagttctcctgccttaatacatgaagcacccgtgtgctccccatcttccatacaggccctccccagagccacagggcacacctgtctcccccacacacgctgtcctccctccatgcccaccgctccaccatccctgtgtgcctcacgcctgtcccacagaatcctggtgctgctctgtggctggcacacacccggtatgcctgagacaggcctcttcccaacacacagctctcaactgtccactctgctcacaggccaggcaacacgcactgcagcagaacaatggtactggcatattacggcacctgataaaagtatttacaaaatctgtaaaataaatacatcttttcaagctacttcttttcaatgactcctgcgtttcctactgagctacacgggcgattttctgagaatatctgaactcaatgcatcgaacgtgagctctgttggcgcccagcggacacctgttggttgaaataatacctgcctccaactactaactcactaacaagtccactaggcccgagtgcaggttagggactcgccagctcggaaggaagcctctgacctttctcgtagatctgctgcctgtctccgggggacagagcctcgaccttctgcttgagcttcgtggcttccacctgtgcctgcttctcgtgatacttgtcatctggcctcatcgataaagtcagcttatgctggttattctgcagcaatcacagcaacaacaaaagccaagtgaaaacaagatcttactatatcctaacactcaacaagcttctgctggtgtgttcttggtcctgtggttccactttcccactttaaaaatagtaataatagaacgcacctcaagagttgttttgctgatgcaagtacacaagccttataaaatgcttaccaccatacctgcctatgtagtaagcacagaattcatatatgctgttattctactgttattattattatggtcattaagtcttaaacatatcaatactaaacattttcattacatcttagttgtaaaaaggtttgcactttcaagtactacagatcttggattttagtctaattgaagataatatagaattctattttttgtctagcgttcattctactattaagctctaaaaggctagaactacatttcccattcaatacttcataagttattagaacaaaatacatgttgacgttaatataaaaatgaacattaggtgatttcatgtcctttccttgtttcaacaattaaaaaactacacatgcacaaaatgctcccgtataaaatactacaaacaggtgagataactagaagacaccagaaagttcatggaaaataacttacaacagctgagagaaactgcaggtcaaattattaaatcatatctcatgtctaaaacaatggaacctactggagagtttcccttcacagcagacaacagtctctcccaccacgggaaccctttttaaaagttctaccatagtaatgagtacaaagcaaagaacaggcaaccaagcacaactgcctaaaaatctgagaaaacaaacgcgcaagcatcaaaagaattcactcatgaaaaccagaagattcattacatttgggtgactgttcacatattttatattcttctactaataaaagaacaatatatgcagatgttttgttcatacacacaaacatacatatattcacacactaaaaatgcacatatacatttatctaaaaaattcaacttgcattacaatctggaaaataattaagttaatgtaagcatttaaatttttaattagaaattaagtcacccattaacagaaattacttaaatgtatagattatgttcctaatattcctttcattagtataaaattcaacttcaaaattagagaaatgaattatccaactttcttaccttaaaatactgttttactttttcttgcaaaaattttggattttcctgcaggcactgtctgaatttagctaactgatttcccaacttcaagagctccacagggtccccatcatggttccagcaagaagctatgtactggaaggaagatttccacatccacaatgcagctggtaccacagtacaacctccaccaacagcccagacttgatactaaaatcctagtttctgtatttaaatataccacagatgattgtttataacaaaagtcatgtaattctttggatggagaaacaaaaaaacttactttagccctgttttgttccaataaaataaaaagcacaggctgaaataatgtttaggaaataaccaacagattactagttataaacccttacccatttaaagtaatctatttcacataaaaatatcaaaatgccagttaagctagtaacaagacaaaatgtctattataaaacaaaaacaaaattgttgagagatcacttactgatgtcagcatcagcccaaagctggtagactgatgtttcatctgtatttcaattttatgaagtaaagcctcaattcgatcatcttcaaatcctttcctaaagaatacaatgaagaacaaagatgggccagacacaatggctcatgcttgtaatcccagcactttgggaggccaaggcaggaggactgcttgaggccaggcatttaagaccagcttgggcaacacagagaaagcccatctctactacacaaaaattagctgggcatggtggtgtgcaccctagttccagctacttgggaggctgaggtggaaggatcacctgagcctggtaggggaggaaaatgcagtgagctgagatcacgccactgcacaggaggctgggtgacaaagcgagaccctgtctcaaaacaaaacaaaaacctaagatgttgaagagttttagtaacagaaggtagcagagataatatttaaacaactaaatatgaacaaaagcatgttatatgacagagaaggaaggccgaaacaatgcatcaggctcagcttctcccaaaaagcacacaggaatgaggaacgaaagcagattgttacaaacaagctacactcactcaactacttcatcaatcgttctgtctatgaggcttctgacggtctcaatgtctttctccacaatcccttggaggccgacactaaagtaggcctccctcgtgtagccattatatctagaagacaaaaccagaaatgatgcactggaatccgggcacgttcatcatgccctcgtaatatgcttgatttaaagatcagaacgaagcgccttaaactccagcccctccactgaaaagctcattaaagcagtgttctcaagtaactggttctgtgtacatccatgtcatttttacatcattttttaaaaataaaatttaaacttttgagttatggcaggataaatatcaaaacagagaactgctgagatttacaaaattttaaaaattcctgtagtcccagccactctggaggctgaggcaggagaatggtgtgaacccgggaggtggagcttgcagtgagccgagatcgcgtcactgcactccagcctgggcgacagggagagactccatctaaaaaaaaaattctaatatttaatgacctgacctgtaagagacaacagcatgacattctgaggccctggaaaagctgtctttgtgctgggtgtttttcttttggacaaatgcccccttggggggacacaaatggctggcactggatccaggatctcatccagagttccctgatgggggcggccatcctgtgtaccatgagacactcagcaacttcctggtccgccatcttccgattatagcaatcaaaaatccaaaaatgttccagacattgtcaagtgtggggccgggacagggtgcggaggtggaggagcaaaactgcccccaaccaattagaactactgatctaatctaatcacaaactcacccaacatcaggagaaaagtctgtgccaaggccagattcaatcaaggctttgtaaaagggagaattgggcccagaagtcaagagtgaagacagaagacttaatgtgaaggcttcaaatgtgtcggtgatgctgcattgaaaaaaaaaggaacggggaggtaagaaaagagtaaagggaaaattactggcccttatgcacattttatttaaaaccactacacatctttctagaaattcttgcatttcaacatttaacaattttatgagcagaagagaattttccttaaataccgggatttttgaaggggggcacaaaccatcaaattaacttcactgcacacgaaatgctcaccatgggacagcctgccaagcacttttcacacgtgatttaaatcacaggcactgtggcagcaccattaaggagacaaggaacaagccaggagaggtgccagccacggagctgcaggctgagcacgggagggcccagagcccaagccttcccttcctgaacacccccgggcatggttccgacctagtctcgtgaaaccaccggaattacaaagttttgtatgtggtatattttgccgaggtgcatgttcatagtaccattctcacactcaaagggacctgtgacctcaaaatgtgagcacctgctggtctgaggcagtcttttctctgtaggaataaagctttgaaatacaataagtaaattacttttcttccggagggctatcaaaaacgattttcctcaaaaaccattttggatgttattaaaaacttcgacattttgttctctattcctaaaatccacttaacccctgaatcctaaccgtatattaattaacattcaattgtagaactcacttccgaaccttctaataggaacattttcctcatgtttttgtcttgtatgagctttgacagcatatacttactccggtaagaggaagctaacgctgacggttgtttgtttagagggatctgtagcaaatgaatccgggccacatgttatctggaattccctctgtaaaatgatgtgacgttgtgagtaggcacagtgtctgacgggttgtcaactactctaggttatctggatacacgaaatggagcgaaacaggctttccactaagttaactttcctttcaaacaaattaccattctttcagcttgaaaagctctcccatactctgtaccaaacatgacagcatctgaaatcccatcatcaatacccagtccaagtcctcatgtcaacatatttaccaggaaggacacaaacacggtggggcactcacaggcttgtcccagggtgtctgagctggcaccacggtgcttggttcaattttctggaatttgctcagtgcttcctcgtgaatttgtttcagatgctgttctaatggaaaattaccgtacgtgaagaacctaaaattttaagggaatataattagtctgttttagtttaaaagatgtgagatcaagtgctgtctgtttcactgaaacacagcacaggagtgccccttacccaaggtctcgcctttcggtttcagtcacccttactcaaccaaggtccaaaaatatcacagtacttcgagagaccaaaattcatgtaacttattacagtatattgttataattgttctattttattattagttattgttgttaacctctcgctgtgcctaatttataaattcaacgttcattcacagggcatggtgctattcctggcttcaggcatctgctggagtgcagtggcaccgtcacagctcactgcagcctcaagcaatcctccagcctcagcctcctcagtagccgggactaccaggactacaccaccacacttggttttggtgggggtttttttttttttgagatggagtctcgccccgtccccccaggctggagtgcaatggcacaatctcagctcactgcaacctccgcctcccaggtttaaaagattctcctgcctcagcctcccaagttgctgggattacaggtgcccaccaccatgcccagctaatttttgtatttttagtagagatagggtttcaccatgttggttaggctggtctcgaactcctgacctcaggtgatccacccgtctcagcctcccaaagtgctggaattacaggcgtgagccaccgtgcctgaccggctaatttttaagttttagaggtgggttctatgttacccatgctggtctcaaactcctggcctcaagcaatcctcccatcttggcctccgtaagtgcttggatttgcaggcatgagccaccacacctagccaaaaatcgatcttacattttaaacttcatctagatgtgacaaaaaccaaatgaggtatttgttaaaacactttataaccctaggtacagtaatatagtaatccaactgacaatctcacaaaactcaatttttggcaacaaattcaaggttatacacgtttataaagataacacatttattcaaccagaggaaaaaggttacaatgacagaatttatctttttctttactatatagcctgagctatggttaaggtttgggaaactagtatcttacagaaccttcagaaatttctcactctagaatttagaaacaaattttacacactcggggttgagagaatccaggagcaatcaccacccctagtgttcagatgctgctctccaaagacccttccccattagccacagaaatcagagctccctggggaaacagacagttgaacctctggagcagggagggcccggctgtgcgtgcattagggaggtgggggtgggggcgtagaaaccaaagaagttagaccaaaacgggcccacagctggggcaaatgtgggcataaaaatgaataaattccatctgatcacataatctcaaatatatacatatacagaaatatttctgtgaggtcagagtggtactaaaaaacaaaacaagactggggaaaaaaaaaaaagaagaaaagaaagaactctcttctccatgttgggcgcagtggctcacacctgtaatcccagcactttgggaggtcaaggtgggcagactgaactcagaagttcaagaccagcctgggcaacatggcgagactctgtctctacaaaaaaatataagcactagctgggcatggtggcgtgcgcctgtagtcccagctactcaggaggctgaggtggcccaagaggctgaggctgcagtaagacaagatcatgccactgtactccagcctgggggacagaaccagaccctgtcttaaaaaaaaaaaaaaaaaaacaagacagcctcttctgtcaccattaaaagtagttcctgcaccacccctcctcctcaaactggacttcccagggagagcagccggccctgccttttccacagaaccatatttcaagataacccgatagcccagctgatgtggagctcttctttgaagaagtccagcaaacaaatgaagaagttacagaattagaaaacttcgcaaactctaataaagtaattgattcaggcaataatcctcaatgaatatgaaaaccattaataggttgatgaggaactcattatcacaggacaccagaaactcaagcccgccagatggtctgtggctgaagggaaaaagcagatcttcccaaggcagtggctgactctcagcatggaccccgctggtgtgagatccccagtggaggcgagcagacctcacatgatggtaggatgtggccgtctatggagagctccccatgagggactctgcttacaaaggcacagcctgactcaaactaagtctttggatctaagttccagtgctcaggaaacacaggaacatggcacccaacaccaggcgggaacagccaggccacctggaaagtgagtgcgccagaaagaaactgggcctgcacactcctctgccgtcccctagagggtgcccaggagaaacccgggccgaccaggtgtgacctgtgggaccccgtgcaacaaacactttggggccaactagaaaatctgaatatggaataagaaataggcagttttaagaaagtatgttttattctattaaaactgaaaatggcattagctcatgtaagaaaaaatcctcatgttttaaggtcacaaattcaaacatttacgggcaaatgatcatgacgtctataatttacttccaaaaacttcagcaagggaaaggatatctattacatgataagtgtttaggggctcattattctagtatctctacttttctgtatgcttcaagttttcataattatttttacataaaataatcttgcaaatatgtttttacattagcattcatatgtaaatacaattagtgttttatataagatatatgactatattattattataatgaccttgtattagtgacataagaacaagcaatgtatcagaaagtgaggatgtaattaaggttcagtaactgcatccactattggaagagcacttctccgtgccaaggagagggcttcaagcttcacaccccgtgtcaaggtgggcaccatccatgcacccccactttccacgcaaccaagctagatgtgaggcaacaggctgcggggccaggaccctcctctgggggactctaaacgctgtgtttgtaaccaacatgctgagcctcctgagggctatcattgtaaatgtccaaaatcaatgtccaagtaagataggcaaacttaggccaagaatcttacctagacttagatatttcttaagcattgctaaatgtgagagaagccatgccataaagtgttaagaacacaaacaagtcaacttttcacaatccaccatcaaacttttccaacaaaatattacctagcattgcttgggtgatagtgagtggcatgaaactgcttaagctgctcccatgtaagctccgggatgcacagtgggtcacccccggagaccactgagtacgtgtggtcgggaagaagtctgttctgaaggtgctgggagaatatcctctcattgtctgtcttgaaacgtaaaataaataaatcataagtatacatgtaaaataatacacacgttacattacttacaatatagccaattgatcacattctggtgcatacacctgtaatactttgcaaataaagctgttctaatggtttaaaaaaaaaaaaaaaaacacccacgcaggcattgtttaacaaggtattcaatcattcatcacccacgcacaggacccaaggattgagaagaacaatggattttttgatgtgtggtgcaacaaacgcatagctgagggctgtaaatcgggacggatcagtcggtctgcccaccagccgtgagggaagtggggagaagctgtcaccccaacttgagttcaagaagactccttggaagaaaagaccaccaaattgagaatgaaaaggtaagaaatagttcaccagccgagaggagctacgggaatcagagagcaggccacccatgagcctcagggacaccaggacagacaggttgtccaagtcacaaagggacatgaagacatgggcccaggacagcagctcttaatccaaaatggtctcaagaatcctttacactctgaaaaattaacccatttatgcctgaggttgcaatttttttgtaaaaaatcagaccttggcgatgaccttgagctgtaggacataaataactcccacaagcttagggtgccaataatggaacactaggcataaatgcgttttaatgaggacccaaacagcttttgattatgtgggcgtttttgcctgtgtaggtgcctgtgtgtgtttatataatttttctatattctaaattaaagctgagacatttaaaaaatacttattcattaaggtaagccatcattacatgttgatataaatatttttgaaaaatacttctcataacaaagtaaaaaactgattagagtggtgctgtgttgccttttttgcaaatctctgtagcgtctggctcagaggtgaagctggactcccccatttgctctgtatgcagctcgctgtgtgtcacacaccttgccatgcagcctctagaaagtacaccgtgtacttgggcaagaatgaatgaaaagacactgtcttggtagtggtatgaaaatagcttttatctcacagacttgctgcagatcacataccaggggtccccagacatggtctgagacctgctgggaagaacagcagcctggccctgctaccccgacttctgctcacagcactgaccccagctaattcaagaatgtatcacctataatgagaatattaaataaaatcttccagatgtgtctatatcatgatattgtacatgggaaaggtaagctgaacacaacataaaaaaggaagaaaacttacaaacgctcccttcatctcattaaagacgactcctttaaagaccaagggcgtctgggggtcgctcggattctcatgttccagccgccatccttcctgcctgaggacaaatcattataagctgatagtgactcaaatactaaagtctgtatcaactagttaatcattcatgacataccagaaatccagctcgcgtaaacatgggaaaaaggtggcatccaaatacaccgagaggagattctgaaagtccttgggattttgtgtggaaaatggatacacagtataatcactagctgggtacaaatgaaaagtgaaattgtaaaatataacagatttctactaaaattattgactctcaagactcatgccccctttgtcctaggacagtaagctgtagctattcttgggatggggcagtggccccatgctctggtccctggcctcagcagctgtcccagctcataaccccaagtgccggctttcccatcccgtctcaggatctgcactcgacgggcaccagggctttcttcagcgaatatctaaactctctcaagtttctccagagactttcatacatctacaaagatgacctcattctgtaacagcatggatttaacccgctcttcaatgtcactcccccacagaatgcactgttcatcgtcaccctatccactatcgtcagtcttactaaaagtcaaacatcaacattagtactaactctggcattgtagcgatatctccaagagaaaattgttttgaacttttctgggaaaagttcacatacgttttcttaaaacgctagtttttacaatctcgctaccatgtggctttcctgaaggattaaatttctaatgtccttcaactagagagaggtaaaaatttttctagaacatgaattgcccactcccctcattccttctcagaaactaactgaattccagtgggtgtgcctggcaaacccaaaagcagtttctgttcaggatgctggtcttacctgtgaaggcgttcatgaacgtggagagggaccggttcaacattttgaagaaagggtctctgcacggatatttctgagacccacaaaggacggtatgctcaagaatgtgaggaacaccagtactgtccatgggagtggtacggaactgcacgctagggaagagagaggaatggcacgctagggaaggcgaatgaccagaacgcaaaaggttcagcttagtgctgcggacacagttcccagatgcatcatcacctcaggctactagaaatcatcattctgacaccacaatcctccagcacagggttttccaactataatgtaaatcattgactcagactgtaaaattgtattttgatgagattataagtcagtgtaaacttttccttatttttcaagatgctctgtcaataaaaatactagtgagatgatattttaaaccacgtaatgtatagccatgttttaaatcaagcttgtccaacccgcagcctgcagcccgcatgctcaggatggcttgaaatgcagcccaacacaaattcatacactttcttaaaacattgaggggtcctttatttattatttttagctcatcagctgtccttagtgttagtgtattttatgcgtggcctaagacagttgttcttcttccattgtggcacagggaagccaaaagaatggacattcctgatttaaataaaaacattcaagaccatgttcttacaatgcaccacacacctgaacagattattcgtgtcttctctggccaggtgtaaatacctggctcctgtgtcatcatgggtgagcttcactgcagtcaggaacagctcgggaacagatgtcacctgagttaacaagaaaaacacgaccagttaaacttagacaaaatggcctttgaaatggttatgttcgacacactgagaaaactggcttttctgcctgaaattagatgatgccgggaaggcagtatttcagagctggagagaagagaaccatcttgtccaggtcccttatcctacaaacaaggaaagacagacctaaaaaaggcagatgagaatatgtgtgtgtgtgtatagaaaagagagagagcgagcgagcgagcgcgagagcgcacgcgcttactactggctaggtattttagatttttttattttttaaattttttattctttttttggctaggcattttctaatcatgtcacatataatcctgtgagggaggtattctcatactcatttacagacgaaaaaaccgaggctcagggtgatgaaataagctgcctaaatcacagagccaggattcaccctggtgtctgcccttcccatggtaccatgctgcacctaagtaacagagcgccctttccaatgtctgctgagtgtctcctgcttttgtgtgctgtgcctcagtaacacagcgccccttccaatgtctgctgagtgtctcctgcttttgtgtgctgcgcctcagtaacacagcgccccttccaacgttggctgtgtgtctgtttctgtgcatatcatctcctgtagtgcgcagaacgggcctgcaaggaggggaaatgctagagtgggctagcctgcgacagcagggagaggctctaggatcagcctttgcttctcttagtttaggatgggttctcggtggtagctagaagcacaaagctgtggcttccagaacagctggaggggccgggaggatagaaatgcccacaagacagacgaaagactccccactcctggggcggcgtggaaggtcatctcctactttaggtaagcctcctggtaagtgaccatactcctcggtatgaaagaaactgtcttctcttccagtcatgccagccggccctctccctcaatcacacaccacgtccctgtgatcaccacaccactcaccaccccctcctgccaggtgccatgagtcacctggccaagcgcacacagtaagtcgctggccaaggtcagacctcgggtctcctcagcccaatctagggagcctgccacgcaacagtcatgcataaagcagaccactatgacctgcatcatctaccgccgcgaaattacttctgtttccaagctcactgtactttgtaacagatgatcaatgcttttgaagtcagcagatacagtgagatgtttgctttctaataatatatagctttaataataatagctttcatggtagctatttctcaaacaagaatcatgacttatcgtaagtttctatggctggacacagtggctcacacctataatcccagcactttggaaggccaaggtgatatggtttggctgtgtccccacccaaatctcatcttgaattgtagtttccataatccccacatgttgtgggagggacctggtgggaggtaattgaatcaagagggcggtttcctccatgttattctcgtgacagtgagcacgttctcatgagagctgacggttttataaggggcttcccccttcacttgatcctcattctctcccctgccgccctgtgaagagatgccttccaccacgattgtgtttcctgaggcctccccagccatgcagaactgtgagtcaattaaacctcttcactttttagctcatactttataaattacccagtcttgggtatttcttcatagcagtgtgagactagactaatacacaagcaaaaggattgcttgaacccaggagtttgagaccagtctaggcaacaaagtttccatctacacacacacaattagccaggcgtggtggcaccttgtcccagctacttggcaagaggatcgcttgagcccaggagttcgaggctgcagtgagccaagatcataccaccacactccagcctgggcgacagggtgagtcccagtctcaaaagtaaatacatttctataaaatttgagaaataaaggaggagaatctaccgctgtgggtgaggcccttattaacagtaacctgtaccataaacccaagtgtctttgcctggcctttgcaggatttcacaaacgctccaagtcttttcatgagtcccatgcctggaccttgtctggcgcaccctagtcactgccctggctcccttgctggagccctgaccgaaggcagccacgttctcacaccaccctctccaggagctcttccctctgcccccagcagcagcagctcccactcctcctcctgcccttgtccttggccctccgcgtggcgtccaccatgtgcctccggtcacagccgcagcagtctttctagacagtaagctgtttgtctttcacgtttgctataacatcaagcatagcacaaagccaacagctggccaaatacatgaagcgtgtcattttcagttaccatgctaaatagaaacaatgcaaaaggtttaggcaaaataacaaaacaaaaaccaaatgaatctattttaatacagacccaagtaagtacaggtccacaattgcttctttatcattctgaaacccgaatggctcagaaaactgaaaggttctgcggacgtttagagcaagctatttgatggcaaaacctgactaaacagatcagggcagtgagtcttcatgctcatgctcagtgaaacatcaggtttggctgcagaaacgctagtgtgtctgattacagagacccagctggaagtgttactctctaaaatctcacaagaaccaggctttgcgggattccaggaagggactggggctcatttcactcacaagctctgttcagccgagtagctgccacacagcaggagctgggccagggccttgggacacaaggacaaaaacgctagtctccgccctgaagggctccgtacataggccagaagccgcacctgcaatgtatgtggatttataaggaggtgccgaggacgacccatacctggtttacggtgaatccatggatcttgtctcctagtttatactgcagagccctctcacaagcccggttactgttccatcgccacgctctgtggtgtgcatgtctagattaaaagtcatctaagttagatgagttgcaggaaaagtatctggctaacattattcagccacatagtgaaaatactctcatgtaataaagattattaaagaaaaattaaatattgcatcttccaaagtcttgcacattccagaaaactgatttctggtaaggtcctttccattttaatgatctttatcttaactaaagcttcaatgttggaaaccttttctttacacttgttcacaaataactataatacaattacagtttaaattccccttgtttaagagacaactcttaaacaaaagggcttctttccttcacagaatcctcaaaagccttcacagtataccaagaaattcacactacagttaaatcccattacatgcctaccgaattggtgaaaacttaaaaagcctaatattaccgggaactctcatacactgctacagggagtacaaagtggaataactttggaaaagcacttggcattctttagaaaggctgaagaggccgggcgtggtggcttacgtctgtaatcccagcactttgggaggcctgggtgggcggatcacctgaggtcaggagttcgagaccagcctggccaaaaattagcctgatgtggtggcaggtgcctgtagtcccagatacttgggaggctgaggcaggagaatcgcttgaacccgggaagtggaggctgcagtgggccgagatcacgccactgcactccagcctgggtgacagagcaagactgtcggaaaaaaaagaaaaaaatgctgaagattggaaatccattcacctcttggtctctatcgtccacaccttacactgcggccccagcactcacagacaaaaatgtcagcacgaaccctgacagtcccaaactcaactcacccggaggtgtatcgacagagaatggataaagtgcggactaatcgttcaatataaaaaaaaaaaaaaaaataaaaaaaaaaaaaacccttaccaatttaagggcctacaggggcatgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaccatgtcggccaggctggtcttgaactcctgacctcaagtggtctgcccgccttggcctcccaacatgctgggattacaggtgtgagccaccgcgcccaaccctatttctaataattattctcacctgaatgagatggctcacacctgtaaccccgcaatgcgagaggctgaggagggggatcaaaccagcctgggaaacagagcaagatccctgctcttaaaaaacacgtaattattattctctccaattgtattatatgtcgtatgggattttctacattaatgtatcccaccgaaatatttattttaaagataatatgtacaggaagaaaaaacctattcagtcactggcaatattatgaagatatgctataaccaacatttgcttactgatttagcaaatttcagaattatgggacagaagcgttttaagaagttacttatcaaggacatgataggaaactcctgagcggtaaggccaggccgaactcatgccacggacgccccgtgcctcccggcctgggccggcagcgctgaactgttaccttatattaaacacgggctcgtggattaccatgaacactaaactgcttcgtcatttttttccccataaattgagtcattaaaaaaacaaaacagttcaattccgggaggcgtcagttctctgaacacagcgagactttaagtgtgggctgtgggcgcctcgggtctcttaaggactcggcctcccaacaaaaatgaactaggagcaaagctgtcagcgagaaccgcaaatgccgaccccatttactacccccgttaaagcccacgctaatggagggccccgccgggagcgccgcgggcaggcccggcccccagcccggggcatcgcccctgggagtaggaaggagctccgaggtcctccggcctcggagcctcggatgcgggagctccaggaagggctcggggtgcgggacgcccacagcttggggagctgccagccccgggcgcagggacgaggacccctacgcctccggcctgccctggaccctcccctcccgggtaccagcgcgccgagcgcctcccgtcgcagcgtctcacccgccgctcagccgcctcagcacacacaggccccgccgcccgccgcagcgccacattgcgcatgacgagcacctggctggcgaggaacccctcttaacccgacgcagggcgcggggcggggcttgccgtgacagctaccactcctattggtcaacgcgaacagcgacgtcctctgcgataggctgtaggtgaaaagggtagccctccactgctctgggacgggcgggagggcggtgcggacggagatgggcgggaggggcggggccgacgtgccgaaggaggcgggcaaggcgaggggcgtggtacgggtagaaaggggcggggccgtcttgccgaaaggggcggggttcggccagcagcaggatgtggacagatgataggagggggaagtgggcaggcgagaagtggggcgtggcgagaggcgtgtgtatgcagatggagtggggcctggtgaagggcggggctgcgctggtgaaaagaggggctcctggaatggcgtgctgtgttgggtggggctgtgcaagtgatgggaggggcttagcgaggggtggctctttgcaggtgaggagtggagaccagtgggagaggggattgcaagtgagctgagccttgggggcggggcttgcaggtgacagggtggagcctagtgggcggggatgcaagtgagctgggccttggggatggggcttgcaggcgatggggtggagcctggtggggcggggctgcaggtgagctgggccttgggggcggggcttgcatgcgagaggtgggtccttgtgggggcagggctggcagaagtgggtggggcttggtgatggaccgcggtgttcaggtgagggtagtggcctggttgggggctgccggaagctgggccaggtgaaacttggtagccctctctggccttggtgtgggcgttggtcctgtttgtagggctgagctgagctccaaaggcgttctgctgccccgccaggcctgaaccttggggtctgggggcttcttggatgagatctcaaggctgcatggcaggtcccagggccagggccccacggtgtcacacgtatcacggatggccgccagcgaagcacagcacagctccgagctgctgcatgggagcctgtggcccccgctgctgcctccgctttcctcttcgtttcgtgtctaggaagatgcacctgagccccctgacattgcccaagtgcccaagggcccttctgggaacccccagagaggctgaaggaggcccgcgtaggagtgggtggttctgcactgtgggccagaaggggccctgggattagccacgcttggagagggtggggtagcccttggaggaagtccgcaccaagtctgaccttccgggtttctcagagcctctcttccttcctcccttcaccttctccctctttttttccccttgtatcacgaatacaaacaggctcaaatctccctctgtctcctaatgggctctgaaaaaaaaaataaaaaattaaatggtaagtagatggctgcagtcggcttgaacaagctaaaactttggaagcaatgtggaaggtaatactgtgggaaaaagtcccaacgtgtctaccctaaactctccatagggcagccagttctgggctgcaggtaaacacgtacctccttattgaagagcccaaaggaaccagaacacaggcaataataggagcgacagacacaaacacgctctgcgcatcacccgtcttttagggagaatttgggtgtgtgcacacaaaatatccgatctaggtctcaatcaatttagaaagttaattttgccaaggttaagggcatgcccatgacacagccccaggaggtccagatgacatgtggccaacatggtcgtggcacaactttttttttttttttttttttttttttaataccgtgtctcactctgtcgccctggctggattgcagtggcgcaatcttggctcagtgcaacctcagcctcccgggctcaagcgagtctcctgcttcagcttcccgagtagctgggattacaggcacccaccactatgcccagctaattttttttttttttgtatttttagtagagacggggtttcaccatattggtcaggctggtctcgaactcctgacctcgtgatttgcccgcctccgcctcccaaagtattgggattacaggcgtgagccaccgcgcctggccacaacttgcttttatacattttagggagatatgagacatccaccaatatatgtaaaatgtagattggttgggtccgaaatggcagggcaactccaagtgggggcttccaggttgtaggtagataagaaggaaatggttgcattattttgagtctctgattagactttcactgaacacacaacttatatttgagaggagggtagagaagcagtcactgatgccttagtctgactcagtgaaacaatggggcagaggaagtgatcagatatgcgtttgtctcacccttgagcctcaggaggatgactttgagttctgcctgtccttggtccacaaggaatttccttgtggacaaattgtgagaaaagtatgtggctttttaaaatccttatagctgtcttacttagaaataaaatgggaggcaggtttcacagttcccagcttgatttttccctttagcttactgatttgggttcccgagatattattttcctttcatgggtcatacatattaataggtcatcataacatctctgatcttgggggagacagttgggtatcattaaccctattgtgagtggccaggaaaatgaaacactggaaggttatagtgtttttatttctttgaaaatagatgctgtgtaagtctaataattaaggcttcagagtctgttcccatagcattcaaatgtcactgatggataacctagataaacaaatgcccaaacatttacaaataattatttcgaatagcattcaacctaatgttaacacctacaggtagtctcagtttatattaacacaaatgactccaacacagaaattaaaaatccgaacttgtctatgcaatttgctatgttacaaaaacatatcctatgttatagtgaaattcattgttttagcgaaattagaaagcaatttaaaaaaaaatcagaatagattgtgactggaacttagaagggcaatcaagtgaatattaagtattaaaggtttaattgtgtctactcaaaaagatatgttggggtcctaacccccagtatctcagagtgtgactttgtttggagatggtctttacagaaataattaagctaaaatgacatcattgggtgggcctaactccaggatggttcatgtccttataaaaagggaaaatttggatgcagagacagacatgcacacacagggaaaatgccaggtgaagataaaggcaaatattgggggtgaaacctttacaagccaaggaatgctaagggtcaccagccaataaccataacttcaggatgcagcatggaacagactcagccttcaagctcagaagaaagcaatcctgcgatatctggatcctggacttctaacttccacaacggcgacataataaatttctttttttctaatctacccagtttgcagtactttgttaccctggctttagcaaacaaatacagagatgtcaaagcacttttacctctgaaagaaaaatatgcagtgatttaaccaaatatggtgttttccaaggttacatgtcatgaacataatacatgcttttggaaaccctttatttctgaattcatcataaattaaaagtgatgattgtcggaaattaaaaacaagggattagctcagtgcctctaaatgtaggattatagaaatgtatggaatgtcagcacactgactattaatggcaaagcgtaaggagaaagagcctcctactttctggaaacccaggtgccaatcctagtaccgttcattcattcattcattccttcattcttgttcactccacaaatgattatagtgttacctatttgctagccactgaactttgctgcttatgagtttgaataaaacatttcatatttctgttgaacttacaaagacagactcacctgtcaaaaaagatgaggccagattttcttcaagtttactttccaccctaaaattccataattttatcatctcaggtcttacttgtgacagcagccacagcattgacttcagctttcaacgtgttttctgtttaaaatcacccattgagaaattcaaattagttaggctgattgtgatttaacttttgcttctaggtatgttccctgatttccacctttgagggagatcagctctttccttaaatttagtttaactttgggtgttttaagttgttatagaaagcctaaagtgttaactttctcttggctcagacccttaataattttttaaaactttacaaatgtgtatacacatgtaaggaaaaaacccagggttacttataactaaagaaaagtcacagtaatgatgggatatttattattttatctattggataagactgtttcataaaacacaggctagtgaggtttgtgaagtgatggtaattatgtattttcatcctctgggtagtatagtatagtgctactgggtagcactatatttttcttgccttttttttaaagcacttcagcattatctacataaattgtaaatgcatgcacttttttaccagacatttcacttcatgaaatttctcccacagttgcattctcacaagggcgcagtgatataaaagtataaatgttccctgcagcattttttgactacaaacaaatatagaacaacataaaagcctatcaggaagagttttcttaaataaaatttaacatatttatataattaaatgctatgcatatactaaaatactcatatgtatcatttttcgtatatcacacacatactataaattggtaagcaaaacaggtagcagcaactccattctacatgcaagctgcagctctcacctgagtgggaaaaaaatcaactcccttttgaatgggaagaatccatgggagtatctaattgtgaatttagcaaaaacacttgaatgaaggacctttacaaaaatctaaataaatggcaaaacatactatgttcataaatgagaaattcaatttgataaagtggtcagtccttactaaaaatgcaatatgattgcagtaaagagcccagaagagcagaagcatgaagtgagcctgaaatacatacgaaggagaaaagattcaggaatgggcaagtcagctttgaagaagatccgggtagaggacttcttctccctgctattaaggcaagccttcttactaagtacctgtttttaaagacttagaaagtcttacaaaactgtcttacatacgacagtgtggtattggcaccaagagaggcaaagaggtcaaaagaaagaataggaacagtcagcagtagacacgctcccatgtaggggagacacttgtatggagaggtgcaaggtatgactgaggcaggtcactggagaacaggttcaatcaatgccgtaacgcatatgggaggaaatgaaactgctgcttcagttccccccacctaccttaaggccatagtgacactatcttctatttcttctaagggtttgcaagttttacttctcttacccatgcttttaatatacatggtgtgaactttatttctgctttctgtaatagaaaaagtcatgaagtttaaaatgacctcagaataggccaagcacggtggctcacgcctagaatcccagcactttgagaggccgaggagggcagatcacctgacgtcaagagggtcgaaactatcctggccaacatggtgaaaccctgtctctactaaaaaaatacaaaaattagcagggcgcggtggtgggcacctgtattcccagctactcgggaggctgaggcaggagaatagcttgagcccgagaggcagaggttgcagtgagccgagatcacgccaccgcactccagcctgagccacagagggagactccatctcaaaaaaacaaaacaaaacaaaaatgacctcggaataacttgttagattggaccctaactcacagcgcaatgcttagaatggagtttaagcagagaaaaaaacctctgcctgccttaatatgtttgtcatccttaacactgattaatcacatgctatccttaatgtgtgttttatccttaacatgtgttactctaaacatgtgttaatcacatggcatccttaacatgtatttgctaacactgaaaatactttaacaggaggcaatatcttgtgttccaaattgatcaaaatgcttaaaatgcaaagacccacttacttaaattcacactaagagtgaataatgttctaagggaaattattgtaaggaaagagctggcaagtatctgaggacctcagaaaagagcatcatcaccaatggaaatgattaaatggggagagaaaaacaaatgttgggaacttccaaagacaaaatgtattttctccaactgtttattttctaaggctagccattgggcaaattccaattgtttagtacgtttagactttttaacagtaaccgaaggtgccaccgttttcactgtaaatgacttgacagcttggggaaggacacgccagcccactctgctacaacacagaacaattgtagttaaggctctgtgtttgccctgttatctgttttgtggtcatggattgcattctttatgagacaagccattttgtaatagttgtgatgctttaaaatacttttatcattggtttcatgggtgagagtgcaggtgggtttgtaatcgtcactctttgtttgaaaaaatattaagctcccaggataggctatatagtttgctgctgctaagttttggataagtgtgtgtgtgtatgtgtgtctgtgtgtgtgtgtgtgtgtgtgtgtgtgtgtctttttttttttttttctttttcaagatagagccttgctctgtcacccaggccagagtgcagtggcttgatcttggctcactgcaacctccacctcctgggttcaagcaattctcctgcctcagcctccagagtagctgggattacaggtgtgtgccaccacgcccagctaatttttatatttttagtagagacagggtttcaccatgttggccaggctggtctcgaactcctgacctcgtgatccacctgccttggcctcccaaagtgctgggattacaggtgtgagccaccgcgcctggccagggataaatgttttgggacgagaacttcaggtggaaattaaagacattatccctacctttatggaactgttggtctagcagagattacagaaaaataaatgaaaaatcactgtgcagtctaccacattctgtaacagataaacacacagtatgctgtgggagggcaggggtgaagatcttatcacaaaattgtggttcaggagaagacttcttggagaaggtcagatgaggctttccaaaaattatgagttcccaacagtttaatttgtgtgtaggagttccttattgcggctgtaacaagttgctacaaacccagtagcttaaagcaacacaaatcaactaattaattaagtagagacagactatagctatgttgctcaggctggcctgaaactcctgatcacaagtgctccttctgcctctgcctcctaaagcactgggactataggggtgagccactgtgcctggcctcagatttattaacttgctgttgtggaggtcagatgttcgatactgatctcactgtgctaaaatcaaggtgtgggccgggttgcattcccttccggaagctctgctggagaatctgcttcttgccttttcccgcctttggagcatgctcacactccttggctgggggccctccctccatctttgaagctggcagtggctggcccaatttccctgatgccagtctctggttctggtgcctctgccttgctctcctcctctctgtttaaggaccccctgtagttacctcgggcccaccccaataatccaggataattttattttaaggtaatctgattagcaactttaatgccatctgcaatcttaattcctccttccacctctcatagcatattcacaaattctggagattagaatatgtacatatttgggggccattattctgcataccacaatgtttacataaaatctcctggccaagtacagtggctcacacctgtaatcccagcactttgaaaggctgagacaggtgtatcacttgagatcaggaaattttttcaccagcctggccaacatggcggaactccgactttattaaaaaataaaaaaaattagccaggcatgatgatgcatgcctgtagtcccagctactcaggaggctgaggcaggagactcaattgactctgtctccaaaaaaaaataaataaataaataaaataaataaaatctccattctgtattgtaaaatagaagaacttttaaaaataaaatatttagttgcttataaaacaaaatgttttaccaacctgttaatattttaaaataaaattatcagatttatattcctaaaaagaagtagtctattgacataagccccttttttcctacattttttcttcagcttcttttttcagtttcattaatggtcaaatcattattgtacagattaaatgtgaaggctttattgtaaattgttggtattttcagcaaagcattctacaatattctagctcatttgtatgaatgagaaattttgatatgcctgaaatagaatgatagaaaatgcatattataatctaattttcaggcatcactttttggagctttgagagaaattcctgtcagttatagaaagaatgaatgggtctgtatcaggggatggaggaaggaaaagggtgcccatgagaacatttatgcaccatttttgtgcggtattgtttgtggcagtgaaataaatgttccttcctgaaatgtcttttcagcggaagcaagccagaggtaatgtcacatttgtaaaatagaaagctcagtgggagaaacactgcttttccactcctcagttcatcttttctgattcagacaatatcatcaccaaaagttggtttattgtaacacacctcccgacattctaatcgtgaaaattactgttccttgataatgagacccccttcttggggaacagtgaggatcttttgggtatgagacaaacaaacttgtgccaaaggatgggtcccggtgggtaagaatccaggtttattatgtgccacaggctgtctgaagtgggaagaggaaggaggtcctatttttttttttttttttgagacacagaggggaaaaggccagttacacaacaaggagagaggactcagagggaaccaaccctgctgacaccttcatctcaaacttctagcctccaaaattacaagacaatttgtttctgttgtttaagctgcccagtttatggtatttgtattcacttgaggccagaagtttaagaccagcttggataacttagggagactctgtctctacaaaaattgaaaaaaaaaaaaaatagccaagcatgatggcgcgtgcctgtagcgctagctacttgggaggctgaggttggaggatcacttgagcccaggagttggaggctgtagtgagctatgattgcccattgtactctagcctgggtgacacagagaccctgtctctacaaaaaataaaaataaataaaaataaaaaacaataaataaatacataaataaaataatcatctttaaaaaagtatcatactatgattttctaagccctaagagtgtatatcccactcctggcaccatttctagtgtgtagagagcattttgtgttgtcttttttgttgactgttcttgccagtccctgaaaatgtcaccgggagctggagtcagttcatcggttccccaactctacacgctttgctttgcagaaaagataattacgtttctctcctcaatcttaatctctttcttcttctttttcttcatcattgaaaagatcaccaggaggactgaagagtgggaaggagaactgtattgcgattccattttgcaaattgggaagagacagtttctggtgtgcgctgtgggtgccctctcttggaagaggggaagagaaggttgggttttctgcctcacagggtccgcatcatacaatagagtcctgcatactcagcaggtgtcgggagaaagctatacatattaatgagggggttgagcacacgtgcaatggataccatatatgtaacatacctctcatgttcacgttggagtgggttttagcattaaaatgaggtggcatgtggctctctacttcaaaaggtgaactacacaaagacagtttttgcacagcctctatgagttgctgaaactggcttaaggtctgcagttgcttatcagaaaaaggtgtttgtaaggccagccctctgcccagtcagagttgttgtggtctggcttttaaatcagaattaggagggctctcataactcctattcttaggaagtttagcaagagtgtgtttttcttgcagccttaggaatttaggaagttgtcatgccagtcaagtcctgaaccctagacttataggtaaatttcatttccttaaccttagagtccatcttagttaataaagggatacctattttggtctctcagatgacattttctttcccctcttctcctcctcctccttgtcctccttctccacctccttcttccccctcctcctctccccccgctcctctattgcatccttcaagacagaaaagaagctatcagatgctctgcatcctcctgcctaaaagccttcaattggtcttaattcctacaggatttcctcatctgactctactgctttttgtatgatatgtgtaaaatatgatttctaccagattgcttaggattatcctttgaatcgaaaagaagtggtcgtattgaactagttttgtcgtcagaaagatttgggtttggatctcagtttcagcacttttgggctatttgactttcagcactttacctaaattctttaaattttagtttcctgtaacataggagtaatatttcttatctcatagaatatataaagtatttagtgtagtatctttgacattaatagaaactgaaaaaaatggtactttaaaagctttaaagctgatattaccaattactaccgtcataataataatagttattctaacaatcgccttactgcaaacagatttcttaaagggttcttaaagatttctttactatcccttatttgagcaacgccactttaaagtacatatgaacacacatttatttagcctacttataatctgttgtttcttcacagtattaataaacactaaaaacatttattctcttagaaatacttaaatttgaaatgaatggggatagtttcaattaacccaaaggaagagatagctatagacttctcaggacccttaaatcgcgttataggaaattactatctcgtttgtaaaatgaaatgggggataataatcatagtgctcatgacacaggacgttgctaacagtgaaggcagtaatgcattggaagtgctcctccccgtgccctacaggcagcttttgcaacaataaagagaggagagctgcccatgggctatcgcattcctcctcactgacagcatcttagtctctctaggaggtacccactcaacagatgcagttcacttttttttttctttgaggcggagtctcgctctgttgcccaggctggagtgcagtggcaagatctcggctcactgcaagctctgcctcatgggttcacgccattctcctgcctcagcctcctgagtagctgggactacaggtgcccgccaccatgcccggctaattttttgtatttttagtagagatggggtttcaccgtgttagccaggatggtctcgatctcctgacctcgtgatctgcccgccttggcctcccagagtgctgggattacaggtgtgagccaccgcgcccggccccagatgcagttcacctttatcagcacttctgaattctttgctgccactttagttatgatggtaacataaactgccactttagttatgatgataccatagaaagttgtatttagaaaagtatcctgcttcaacgaacatttttccactacatatttattccactacatatttaagaataaatatatagtcagtataatgatctcatcatgcttgttcttgtgcgtctatttattaatttgtatcagagaaactaactgttgaattaatatatatcatttcgattttcttctttttcagcataaattatacataaactatttaaacacagattctggtttttagaaggcattttgaatattcaggttcttagagtactatgaagaggaacattaaacctgatacttagagaaaacatacatctcatccatgaacctagttgtgatatggacagaaggcaggaaaatactgggtggaaaagggtggtccccagggagggccacaccgtcaaacctgggaccatggcccaagtgagaacatgcattcttgttttcctgcttgaatgttgctttttggcccgccctgcccccatcctgtacccataaaatccccaggcctcactggcagagcagcagagaaggagagaagagaagaagcagccagacattggagaaaagtagcttgacttcagagggccggcttgacggtgggaccttgaagagaagttccactggggatggccaaactccaggggaagaccaccttcccactccattccctttccagctccccatcccactgaaagccccttccactgctcaataaaatcctgcacactcaccacccttcaattggtttttgtgacccacttcttcctggagcccacacaaccacctgtgtgtgggtgcaagaggctgtcacactgccccttcactgagctgtttaagactgaagccacccacggacgcaaagctaaaagagcacagtgtaacgcacatcctctgaggctctgggggtcttgggcaacccctagatgctgccgtgggcccacacagagttctgctcctgccggttgcccagaagcacacatcctggcctctgtacctgctcacctgtgtgctccccatcctgcaaggggttgagagctgcaagctcagtaaatgagccagcccctttctgagtcccttgaaggggtcaagggaattaattatcccctttttttttttttttttgagacggagtcttgctctgtcacccaggctggagtgcagtggcgtgatcttggctcactgcaatctccgcctcccgggttcacgccattctcctgcctcagcctcccgagtagctgggactacaggcgcccgccaccaagcccagctaattttttgtatttttagtagagacggggtttcaccatgttagccaggatggtctcgatctcctgaccttgtgatccgcccgcctcagcctcccaaagtgctggaattacaggcgtgagccaccgcgcccggcctatcctgtttcagttgggctgtcttggcagtcagtataattgacttggaccaactaattggtgatctgattaattgcctcatcatcttctaaatgaatcccagcaaagtccattcattgcatcggaaagatttagcttccaaatcaatgtgtaggggatttgttgacaaactcacttcattggaaaacctggctaggattcaactgcttgttccaaatcattcatatgtgaaatgaaattgagttttagaatttcgatttattttcattcacaagacttgctctctagtgtcatgaagtagaaatgtgtcaccttcacggaagtgaataacgatcacgctcctgcagatacggtcatgcttttgttgtggcggagcagtgtctcagatctctgctactcaacatgctcccagaacagtttgtttctgatctaccatgaggtgaggttgaaacctgggagctgagaagaggttaaagttctgaaactaagagtttagaagttcagaaattgaggaaatttgagtgtagaaactgaatttagaaagtgtagcaacttttactacattttagcaaaaatgttatttatttacatttaagataaaatgtggagttcttatttaatatttgttgtattttcttttcctagtaa

SEQ ID NO: 12123 - DNA, 17730 bp, Human
cacctgcaatcccagctacttgggaggctgaggcacaagaatcgcttgaacccatgaggcagatgttgcagtgagccgagattgcgccactgtctaccagcctaggcgacagagcaagactctgtctcagaaaaaaaaaaaaaaaatacaaactcatacacaatagacacatcccatgcataagtgctagaaacactcagttatagacaagcatatacaatgaagatacttaagcacacgcgcacacacttgtgcacaatacacacctgtgcccacatacacaaatccatacccaaactaaagacacacacaaacacgtgtatgtatacaaagatgttatgggcaacatatacaatacatatatgcacaaacacacacctactcaccctcacacacatgcacagtgaccctccacaatgattctgggcccaggaagcagtttgtctaccccacgaaccccagcttgtttgaagctcgtcaggatgttccttgcagaccccgcttagccagctggtgactggcccccgcctcctgaacctccaggcttagggccggccaggcaggcaggctgcatctctggcagcccctcgtgggtgggcaggcaggcaggcagtggacgcagaggtcactggggtgagagctggggctgccctggcctccctgctcttggctggaatgtgagctgtaggggccacttcccaggcctcgctcctcccccacagccacccaccagccccaggcccagccaactcgtgactcccagtcctgccaggttcctgcagcctgggagctggacacagaaggcagtgagaggagtggtggtaaagaaagatccagaaccaagggagggcacacacaaacgcagagagagaggcacagtcttcacccacagagacagacacacacacgcagagacaggcaggcgtgcagactcacagtcccaccgaaagatacacattcagacacttccaaacacacccagatacacagcggacacgaacagatcacacaagcatacagagatacagagagacctgacccccacacagaggcgtatttggaggtacagtagtcacacgtactcagaccacacagaggctcagatgcaccgctcatggatattcacagacccgcaaatgcccatgcacacgcgcagatgcacacagacccccgcgcagcgtacagttcctcctcggccagggaccaggaggagatgcctgagtgagaccactctctaccacagggggctgccccgcagggagggcctgggaagactgcttcccaaggaggcaacaggcctgatcctccagccaggtgccctgagaggtttcctgtgggaggcccactgtgtccgtgcctggctaggagggtggtaggtcgggttagagttctggagtcacgtaggcttgggttttgtctctgccagttcctcggacacacagatgcgcgcacacacacaacacacacacactttccaagaatgcctatgtccattcgacatatgcaggcaggggtgctctcggagcctcggtttcttcatctatataacctggctaggaatcccttggccccctaggggtgtgggcatggctgccttcccaggcatcccggacggcccttcctgcagaggcggttagatcatgagccttgacggctgacgctggactcctggatgcccccatcccaggtgaccgccctgagagccgaagcagggctgtgggccctgtgggcgggcgcggcgcggcccggggagctgcgggctgggctcggcgaggcgtctggacctgccgagagcccctcgcacgcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccaggtaagagctacccccacctagcctggctccccagacctccccatcccagcactggaagcatgggactctgaaatcacagacccactccagggagcagcaactccaaggatgtccacacacttcctaaaggccaggctggacttctttcgtttgggaagagacctcaggctggctgtcccccaggtcctgggggctgtcttggtgggggcagggaagccacagggagggagggagggagggaggtttcctgtctggcccctggagccctggtggctttgctaaaagcatctgtccactaatcccaggcgggtccctggccttgtggtcagggtcgaggccccatggccaaccaggcgtccccaggacctctgacctggcctggtgggggtggcggaggagccagctgaagaagctgttggtggggaggctggccctgcccccaccagggctcaggactgagccgtgggctcctgggtgggctggggacgagacaaggggtctcgctgtgccttttctcctgggtgggtggccggaggtcctgagtgcagggcctggggaagtgagcagggcccttttcccaggagccgggtgagtctggctgggagccagcttgggcagtgaaatcctgacaaagccaatgaactgccttcccactgcgttgtcccactgccctgggagtccccagccccagcccaagagtaggagtgggctgggcagtccctgaggagtccgagcagcccagccacccgcctgcctgctgcagggctggccagaggtgtaacgttaccggctgcaccagctcatggcgccacccgctccagcccctcagctcccaccagctgatcacctccccctgggctctggcacccagccaaggcgggctgtgcagggcccagcagggttggcctgggggctgggtagaaggcagacccgcaggattggaagatctttgggatgcagcaggccaagggtctccaaaagcttctagcctcccatccttttccaaatgaggaaaactgaggccagagaggggtgggacctaacctacccagggtccagtgagtttttagtggtactcaggctgctctgagacagggcagagcatgtgcagcaagtgggaaggaacccagaggggcccctaccttcttgccatcacacttggcccaagagtgcagagctccaaggtacccccagctcacctctgcacttttctgtccatagcagtgggccttgtctgctgggaacggctcgtcagaggtggaaggtaagctggccaggctgggggtacgcatgctccccaagcccctctcttcctttctcccaagcccaggtgtggcatgaagcgtgggtgcaggttgataaaagctggggagagcctacaagctagacatgctgggtgatgactttggcagggcctaagagatcccctcatggtgacccagagactagagaggtgtgggctggagtcaccagcacacggagagtggggctggggccagtatagccagggttcatccagctggctcagagcccttccccagcatgatttaagggtatggatggggtcttggaggacagggtggggagtgagtgccaggggccagaatgggggtctgggagctgaatgcagtgggcagtcaagaggatcaggaatgggtgaggggccctccccagcagcccagccctggtggaactgccgggatctgaccatgcgtttccattgattataaacagacagaacatagtcgcgccctccctggcccctccactccccgccctggttgcatcaagagggagtcttcaaagggcaacgagacgtttgccaaagagacatatgtacagaaggcaggaggcccatgccaggccccctacctcgctcctccctccctgcctctccaagacgtgcaaagtggccacacaccaccgctgaggtttcccctgcgccatgggagagtgggcatgtagggacatgcacacgcacacgcgtgatagccatctgcgtgctgggaacaccctctgctgggctgcctgcctggcagcccgcctctcccgggcctggccatactctgacacctaaggcttaggcccctagacccctgagcaggtagaggaggtagctgcccttgacttcatggatgcctcccttgctgtgcctctggaaccagcacaacattatgctccttgggatttggggaaggacccatcccctacctccacactatgccctttttggtgcttttagtgtaggtcaggccacagctaccaaagatgccttagcctcagttttctcatctgtaaaatgggagccttggctacatgatgtctatggtttcttctttttccgagattgaaaaagggacttgtcctctgactccagggaggagaaatgggtgtacatatcacccaggatttgaggtggggaggcctggaagtgtagattcattaggtcagctctcctgtcacacttatcaatcagggagtctgcaatctgaccgggagaagtacaacgagctttgcaccccagctctcaaaatctgaaaatggcatccccacctgttaacaccacagccagagacagcatggccagccatgggcattgatttttactattactattcacggtaacaatgttaggcattttctgtcattctgttttgaccacaggctgtgaagtaggaaggggttgtactccatttttacagatgcaggcaggccctgaggctcagagaggccctgggggtcgccccaagcctcagacactcctcatggatctggcagaaccaagtgctcccaatagctccgtggctgagcgggcatgagcagggtgtcccttgtggcaggctgtctgtgtgccctgccagtgaccatggagaggacacttgtgggcttgggctggtggccagtggctctgcccagccctgtggcccgtctccagtgccctccacagaaacttgctctcaggattaagcatttctctcctggggtctcccccatcccaggtggtaggtaggcaggtgggaggctcactcacagggctggcgagagagctgagggcacacttgcagcctcaggagcagccctggggaccacccagccctggcagtgcctgagggggccctgagggggccacagcttcccgttgctctcacctccaccccctcccggagcaggtctggggccagcggaagtgctctcggggacagctgagcagagctctttcctgagggacacagcccacatctgggagcggtcactgtactccctcagcccggcccctcacccagccccttttgtttctcccacacacccatagcggggccttcagggatgaattgccctttcctggtggctgccaggtaaaccaggctccagcccacctccttctcagccctcccccaacacagttcggccacagggctgggaaagtggcagattccagggtttcagggacccggaacctgcatggtgggatgtggggtgaggaaaggaaatcccttcttctgctgccgaggcccagccagttctgccaaaggtggccatggccccgcagcccagctgggtgggtgtctgtttgcaggatggagggggctggggtgccccttctctgctgctgtcccctcgctgacggctggtcccagggcaggaacctgagtcttctgtggtgctttggcagctcattattcctctgctgttatttatgttttccaaggtggagattaaacgttcagagtcacgtagtgctcatgaagattttaaactaaacacacagctcaaggagctggtgatagggaggtgctctctgacccaggattgcaaaggcaggcttccctgcactttgggcgcctttggggagagaggccttgtttcccactgggttccggggcagtatccagtggcgcggagtggtagagtcagaggaggcctatggattccccccaccaccagcccctaggccctagtgccctctaagcagagcacggcagaatggagcagaatggagcagcaaacaagcagataacactgtttattgcctctatgactgcctagccagctccacatggacacaccgcctctgggtattttccaccagtttgcagcctttcccgagggcctctgctaggactgaagtttatttttcttccgagattaccaggaggctcatgtcctcataggctcagtggaatggactttggccccttctgcctcctaggcagaggcatggaagaaatgaggggttgctgggagaggccattgttccatggcagaggctgcaggacccccagctccccattcttccccactagctgaggatgaccatcagatgcagagcaggatgacccaggcctgggggtgtttctctgtccatggtctctgggctgggctgggttgcaggcactgattcacaggcggttggtcagagagggaaagaccttagcaaccatttattcccaaccttcttttttcccacctgaggaaactgatctatccagaaaggttaagtgatctccccaaggtcacatagccagtgtagggccaggactggaagccaggtgtctgactctggccactctccctgtgagcctctatttggggcctggtcctaggccttcccccgaaagagcagcatcttttgagggattccagatcagcccccaaaagatcccattcacgatcgccaggacatcgtgaggtcagggatgacccggatgatcctcagtgaaatgtcatctaatcaaccaggagtgacttagcctgtgtttacgggtacgtccatctctgccctcatggagcctcgagttggttgtaaaggagataagagcaagcagtgccggagataaggcaaccccttgaggccagaggccaagcagtgctcaagggaggctcatctgtgtgcactggaattgctggggaagtcttcaaagaggaggtggggaggcaggtcgtggaaaatggcgggtggactttatttggatagaaatgagaggagggggaagaagagcagctgtacgggctgcagagtgcacaagccagagctgggagtgaatgtggtgctgccgtggctcagtgtgagcgctggttggactcagtggagaggagggtcgggccacattgctggatgtggtcttggttgccaggcagaggagctggcacagagtggggcaggaaatgagggagccgtggaaggtgtttgagcagaggaataagggaaggccaaccctccctgcatgactccaggaatgactgttttctgcaagttctccaagttggaggaagcaccgggtcaggcttgagaaagatccagagggcctgggtagctgccggggctacaatcctcaaagctccagggagccaaggcagacgtgggtgcctgagttgaggacagagcaaagcttgggaccctgagagattctgttccatggggatttccatccagcagatgagctaaggggcccgcaggcatttcggagggatcacattaggagttcagagttgagggagctcggatggggctgggggctgaacctggaaggccagcagggccttgggagccaggtttagggcttcaaggggcaggtctctgctggcctgacccagcccccttgcttcctcgcagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcaggtaggtccataccctgcccagggggccaccgaatctgcccactagaaggtacctggagagggaagaagataggcccaggtcccagggctggagcctgactcccaggccagtgctcctaccaccccagcccagggcctcttcttcctaagccctccgatggctctgagcccactcatctccacccccaccagcattctcagcctcacgctgagtcctatcccaagactcagggtgtctagttaaagctggaaagaaatctgcttgtataaagtccctgttgacaccaggagcatttggtcccttttcaagcaagtgcagcttacatgtcacacacgcagtggtttactgagcacttactgagtaatgccaagcactgtcctaggcgtgccacaagtggtgtgtcattcaatccttcaaggctggtgtcattcccatttcacggatggggaactcaaggttcagagatgttatttcacttgttcagcaggtaaaagagtcaagatctgaacacgggtctctctgactccagaacatgagcccccttcctgtgctattgctgtgctagtgctcccgggcagggagggacaggggcctccctcagatccccatgcagctgagagagctgtttgccccacgttcagagtggagtgagggcctgtagtccacaggctagcaggaaacagagtcgggttctccttacaaggagagagagaagagtgccggaaactcgtgggccactccccaatccaggcatcaactctttcttccttcagctcctaaagatccgttctggggaccggccctcctacgtggagctgacgttctctcagcacgttcgctgcgaatgccggtaggtctccggggtggggtgggtagcaaggaaaggcccccgtcctcttggcagcctcagcaaagatgggtcccagggcagaggcaaaggctgcccatccccgctgcgggctgaacttttttccagactgagggagaccaagagggcaggaccaggggtggctaccattcattttgtccccccaccagccagttttgccaagggagctggtcccagcagctggggtacagctgttgagatactgcaagggaagagagagggtgggtccctcccagcctcgcaggggttcggtgcgtgtcgttccccttctctgggatgggaggcagctgccacgggcctctgaaagaggtgcctggaggcaaagacattgcaagtctgaacttcgttctgggccaagctgtgtgcccacaggagcgggcaaacggggctgagaagcagcaagaaggacaagctcgggtaggagaaaaggggcagaagaagagtgacactgtggcttccttgatgttgcagcacccctctacggcccctcccaatccacagagcctctgaccagcaccagtcttgctgcctgtgctgggggcacttggaacattggttagcaggagcaacaggcctggcactgccagctaggttcagggaagagagaaatgggctgagctgctgctcctggtactactgggccatggatgaaggcaccagactagaagtccagagccctagccaggggcggcaggagggaagactaccacttattgtgtacctattctgtgcctagccccgcaggaggcacttgaatgtttctcatttagtcacatacatttattgagcacctaccacatgccaggcattgtcctgatgggatgcagtggtgagcaaggttcctgctctcataacaaccctgggaggtaggccctattgtcatccccattttacagatgagaaaatcaaggctcaatacagtttcatgatttatcacagctagtgagtgtgggaggagggattctgggccctgacctaactcgtaagccttcgtttttcaggctacctttcatggccatgaccacttttctaatagcccccaggcttagccttgcctcctgggcagggctatggctgccccttttgttggagtgttggagaccctgcctcaacttgtttccacccatccctccaagccagagcttagccatataacaagagctcggtaatgaaccctcctgggtgcaatgctgggtggtgacccagagtcaccttctccatcccctttgccctgacagccactcttttggggcaggcagatgaagagactgaggttccaagagtgtctgtcacttgcccaatatggagaggtacaaccagacagtcccaagaggccctggtaccttgccctggctcccaagggaggaaccagctgagggtagcatgtcctggccccaaagctgactgctaccatgctgtcccatgtctctacccactgttcccagtgaagactgaggccctatcccctgccaggggccaggcaacagggacacctttcttcttgcttctgggccaacagccacagccctgggaggcagagcccagacatgcctggtgacttcagggctgatgctccctccttcctcccaccccgtcgctcactccccatgttgttccggatggagtggggctgtgccctgacaggcagccagtccgctgtctggccatcatctcctgtccctgaggaaattcccagaatgcaccctggaaggaacggaaaaaagcagcaaagaaagtgagaaagaaaaagcaacagagaacagacagaaacaaccaaatttgatgccaagaggctgagaagtgcagaagcgggtggcaggggtccccaggaggttgatttgtccctctcgtggtggggtcaccagagcctggagtgggagtgaagccttgaggctctggccacctctcccttgccaactccatgctaccccctagtggcctcagtgtcagctgcaggaccaggactggggatgtcggaggggacctgtccgggcggcagggagccccacttattgctttcctaacgttcctctgcccctctctctgtctgtttccctaggcctctgcgggagaagatgaagccggaaaggtaagtggtttggctggggctcggggctattctcgggcctgccagcctctgtcctagcatggggttccccagccaccttgtcctgacgcttggcttattgcaggaggagacccaagggcagggggaagaggaggagagagaagcagagacccacagactgccacctgtgagtgcgcggggtcccagggatggcgaggaggctgggcccgaggggagccccgccttgccgccagggttaggttggggagggggagaggcaggactgaggccagtcttgggggcagaacagggagctgcacctcctcaagactctagggcccaggaagcatcagtggaccttggtttttgtcccggcttagccctaggtttccattgaccttcaacaaatcatttcacctttgtcagcctagcttttctctgtgtagaatgaggggcaggaggtccagcaaacattcagtcactctacaaacatttactgagcacttactgtgtgtcaggtacatctgtgagcaaacaaacaggattcctgcacattagtgtttaccttttagtgattaaaagtctgtcatcagctgagacgttatctggggccacttcctagtagccccggggaacatgtgcccctcgccactgtctcccaggagtatttttgcctgtgggtccccttgctgcttctaacccacttcgtaccttgtgggcagcagaatggagccccaggcctgagtgtggctgggagagaaggatgagaggagggaaaacccaaatctgtgagagtaaatagaaaaaataaaatatttcacgtgcacagtcaatcagtcactgaagagaggtggctctccttcaggggctaagcctcccccacgcacgtgactccaggaagtcatttcgtgctatggagtggagttgacccaagccctgaccccatgagccccactccatgaagacagggatcctggggactgcgccccctaggggtttatgctttcatctcttttctgggcccgcgcggcaatttgggaaacaagctggcagggaagtccatccaggcccgagttacccgccggcagccggaggcagaaagtgtcccgtggctcctgttcccaaggcagcagtcttcagacatttcactcgggaatctcctgaaagaatttcaaaagtggccgggcgcagtggctaacacctgtaatcccagcactttgggaggccgaagtgggtagatcacttgaggtcagaagttcgaggccagcctgaccaacacggtgaaaccacatctctactaaaaatacaaaattagctgggcgtgttggtgcatgcctgtaatctcagctacttgggaggctgaggcaggagaatcgcttgaacccgggaggcggaggttgcagtgagccgagatcacgccactgcactccagcctgggtgacagagcaagactccgtctcaaaaaaaaaaaaaaaagaattccaaaagcccatgtgctcccttgcccattcttaagttgacattgaacattttcatcagaattataagtcaagccaggctcagtacctcatgcctgtaattctagcactttgggaggccgaggcgagtggatcgcttgaggccaggagttcaagcctagccggggcaacatggcgaaacctcgtctctacaaaaaaaatacaaaaactagctggacgtggtgccatgtgcctatagtcccaactactcaggaggctgaggtggaatgatcacctgagcctgggaggtcaaggctgcagtgagccgagatagatccactgcacctcagcctgggtgacagagtaagaacctgtctcaaaaaaaaaaaagtataagtcattacaaaggatataatttctggcatattattaatattttaatacaaagctattgtagaacactctccaggtgtatcctattaaatacgccattttaatgttatactcaccatcatccacttttaagaaaatgaacaagcaggccaggcgcggtggctcacacctgtaatcccagcacttttggaggccaaggcgggcggatcgcaaggttaggagatcgagaccatcctggctaacatggtgaaaccccatctgtactaaaaatacaaaaaattagccgggtgtggtggtgggtgcctatagtcccagctactcgggaggctgaggcaggagaatggcatgaacccgggaggcggaacttgcagtgagccgagatcacgccactgcactccagcctgggacagagcaagactccgtctcaaaaaaaaaaaaagaaaattaacaagcaaaaaaaaaaaaaaatacaggaacacttcctttcataattatatatttacattgtttcttttttcctggaacttgtatttccatttcactccccacccccaagaatttcagcctagtgtaacagtacttttaattttcagaagtcttttattgattaccttgtcatatttatctgccacaaaaaaatgatatatgagtttgaattattttaaatttcctgtgagcataaacctaaattaaattttctcctggaataaattatcaaaataattcttattagcaccatttggtcaaaacagcacaaatacttcctattttaatagatgttcaacataaaaatacaatcaatttgattgggaatgcatctcaatgagatggatgtggctacctcgtttcaattagtgaatgaatccattaatgaatgttacttcctgccagactgagacaggattctgcattaatttaattcctgtttatcatttttttattgatgagaaggttgagaaaccatgttcacataaataagtaaatgagactagatgtcactcaattacttgaactccttccttccaagttatttgccagaaatctcaaggtgctctgctaagaacaaattacttctcatgatatcctggctgacaatttggttaagctgttcttcagttttgttgaaagccttggttacccagtcattagccatattttctttctcaagacctacatcaatatctcaaattgttctttttttcatgtcctcagaatacttttacctggcagcaaagcactttatgaggatttagaatgagcaagatgtgttgtggccagagaagcagatctcagccactgcctcacaaaaataattttaaggcaatgtagacctggaggctgaaaatggatttctttaaaaccgtcagtactcaggcctcacgtgcgtctagcggtactcccctgtttggagactgctgtcttagggtaatcagaggcatgattgcatggagtgtgattaggttcaaatgtggctctgtcaccgactggccgtgtgaccacaggcaagcttcttcacctctctgggcctcagtttcctaatcttcacaagaataatcagggtgccttcctcgtggaaggttgttgagggttaagaagacagtgcttggcacagggctgggcacatgggtaagtgtttggtgaagggtagctcccagcttctcctcagcttgaagcaagcagggacccaggagcactgcgccctccccatgctccctgcccaagctcctcctctgggcctgccccctcctccataggaggagaccgcaccctccacagtgtgctgatacccgccccgtctgtgcttggtctctggcaggtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaacgctgatctagtgggtgtgtcttccggggcagtgagtgtcagccgggaacggaagccagacagacccagggatcggggtgtaacaggaagagcacagcaccttctccgagcctcagtttccttatctcaaaagcctcgctcagtcgacgagagggcatgtcacagctcacgacaacatgttagcttgctccttccttcctccttttgacagctgaggacacttaggcccaagaaggtgaaatggctgatggagagttaagagcactgaagcgggggtcagaggcctggctttgtctataactcaccgagtggcactgggcttccctctgccttcacgtttcatctctgacctgaggggcctggctagatggctcttctggctttgacacatttctactggggcccaggctcaagtctcggtggccctgggtggtcactggagactgttcctgtggaggccacttcaaggctgccccggaggtcgcccaacctgcttctacagcaccctggggtcgccccttccctaacgaggagctcccaagatgtagttttgtttccaaagttgaggagaggctggtcccagccactttttaacagcatcaagagcacaatctcctcctctcccagggcttagggctgccccagcccagtgccgcaaggactcccgaactcctccggccctcctgatagacatcctgggctgggtctcagggcgctgaacggcagcacgtatagcctgctcgggctgctgaacagacgcaaggaccagcagatgctgcccggatttctctgccttttaccccccagttccttccgtcttcctcctcagtgctttggcaggaaaaaaataaatcttcttattattttttaatggttttttttttgagacggagtctccttctgtcgcccaggctggagtgcagtgccacaatctcggctcactgcaacctccacctcccaggttcaagcgattctcctgcctcagccttctgagtagctgggattacaggcgtgcgccaccatgcccggctaatttttgtatttttagtagagacagggtttcaccatgttgaccaagctggtcttgaactcctgacctcaagtgatccacccgcctcagcctcccaaagtgctgggatgacaggcatgagccaccatgccaggcctattttttttttaatccaaaccacttactatcaaactccactctgcttctgacctgcaaggggtgtgtgtgtgtgtgtgtgtgtgtgtgtgtgtgtgtgtgtgtgtctgtgtgtctgtgtctttgatgttatatgctgctatatgtattgggggaagagaagttcccccattctctcctcagcctcacttcctcatttgaggctgctgaggagaaacccacagggacccaggggcacaggggcctgcctggggctttgaggggagctggggatgtccagcggagtggggtggccctgctgaggcagctgtccttggtgccctgttcaccgaggcctggggactctgcaggacacgctggtcagaatgtgcttctggctgtggtcatagacgggtgtgagtcagccccaggagacatactttgccaaagaaatgcacttcctctcctgcctctcctctctttagctgcagctgttctgagctgttgcctttgacccactgtgaactgggaagagcacccatcccctcccactggccaggcctctagctcagccctgaggaccccaacccaggcccggtagcatcttcaaggcttttggctccataaggtcacccacatggcgggcagcctcccgacccaggccagtgacccctgtagagagcaagacagaaaccagaaaagctcctggaagccagaagcaaaactccacatccgtgggcaggagcctcgcagcaggaatgggtaggaaggagccagctggcctacttgactatattggcagccgttccagccatttaggtcctagagggatttgcttgtcatctatttgtggagcacc

SEQ ID NO: 12124 - DNA, 14823 bp, Human
aggcatccaaattggaaaaaaggaagtcaggccagtgcgaatgtagtgagttatctcaatctcacagtaagttacagattgaactccttgttctactctttccccacttctcactactgcacttgagtagtcttaaaaaaaaaaaaaatcaaattgccccctttgaagatgacatgatacctagtatatagaaaaatctaaagatttcaccaaaaatctcttataactgatacattcagtaaagttgcaggataaaaaatcattatacaaaaactagcatttctgtacaccaataaggaattagctgaaagagaaatcaagaaagcaaccctactacctaggaaaaaatttaatcaaggaggaaaaagacctctacaataaaaactacaaaacactgatgaaagaaactgaagaggacacaaacaaatggaaagacatctcgtgttcatggattggtggattggaagaattaatattgttaaaaatgaccatactttttttttttttttttttttttttgagacaaggtctcgctctgtcacccaggctgcagtgcagtggcacagtcacagctcactgcaaccttgacctcccaggctcaagcaatcctcccaccttggctcccgaataggtggaactacaggtacatgccaccacatccaggtactttttatttttatttttgtagagacagggtttcaatttgttgcccaggctagtctcaaactcctaggctaaagcaatcctctgtccttggcctcccgaagtgctgggattacaggcgtgaccaccacgcccagccctcacgttcttattcctatgtgggggctaaaagagttgatcttatagaggtaaaaactagaatgagagctgagcgcggtggctcatgcctgtaatccccaccactttgggaggccgaggcgggtggatcacctaggtcgggagttcgagaccagcctgaccaacatggagaaaccccgtctctacaaaaataaaaaattagccgggtgtggtggtgcatgcctgtaatctcagctattctgggagggtgaggcaggagaatcgcttgaacccgggaggcggaggttgcggtgagccgagatcgcgccactgcactccagcctgggcaacaaaagcgaaactccatctcaaaaacaaacaacaaaacaaaacaaaaacaagaaaataaacacacacgcacacggaggtggggcggcggagtggcggcagggaggaggaggggagaggtaagaaacaaatgataaaacaaatgaagcaaattgttaacaataggtgaatctgagccaaagtttaacgtgcgttcttttgccctattcttgcaacttttccaaataaaacgtttctctaaaatcatgtctaggggacctggattccaagccgagccccttttctcactcggtgcatgaccctgaatgaattccttcctctcggttggtctcagtttttcagcacagatggttctctctgggtctggtaatcaacgtctcacaactctgaggacgtttgcagacagggctttggaaggaagacggcccttcgtttcccccaaagggtctcagcctgccggtgatttcaccacgacttcctccagagttccacctgtcctcttcatcagccatgaacttgcccctactaatttttgccaccagctggacgcccacctcctctttcccggagccctaaggctctccttgcggcagtcttagcctctgtacaggataggcacgtgcatttagccccagaaaactacagcccccaaaaggctttgcggcaacatcctcgcgttgatcaccaaagagaaaacgcttttctccgcgggcccgccgctgcatagccttttgggagttgtagttcatctgctaagagccgcagaaccagggtgaggttctaagccacccttcccagaactcacagcgctcttccacaccaataggaagcgtggatcttggaaagcgggcggggcagaggagctcatgcgcagtatgtgtggttggggaattcatgtggaggtcagagtggaagcaggtgagaatggagggggcggcaaaggctcgtttctgggcatctctgcagtcctcctctgctccatgatgtgcactttgggcgaggagagtgcgtgcgtgagtccgacttgtgagggaggggagaaggggctgagcccgggacgagccaggggttgctcagagtaagggaggtgtccatggaggcagggtgaggaataatccagaagctattacaaatgtaaagggccgggtgtcccagcctcagagaaggaagatttaaatgcactggacgagatcagggtagtctcaggagttgaggtctgggaagtagggagggaggatttgagactggagcgggcaacgacggtggggcggagcgttagaaagttacatgctggcgtgatttctagttaggtcaactgtgcttatgcccaccccgcctcagccccaccctcccagttattccagagctcactgtccctgtgcagctagttagagcctttctcccaaatgggttcttcagttatcttggccccaggatgtcatccagctcctgcttccataagaagcatgtcgttcttaatacacgatgttgacaagcagtatggtgaggaggtaagctgtgtctgctagcattagacctctgggttctaattctggttctaccacttaataactgcaatctcggcttctcatgtaacctctctgtgtgcctctgtttcctctgtagtaatatgcttcatagggtaattgtgagaagtaaataaattgcttttattaggctacctgatataagtgttagctgttacggttactttttttgttggcatcaacatgtagcacattttttaagttatttttttcaaaccataattgcaccaatctaacctcacagcctctttttgggggcctacttgtccaggaaatgagagggtggtttagtgtggtgctaagttctctgtggatttcaagcccatgcattgttttcattattgaaccaagtgtcccagacaccttactttaaatggttgagaaaaaaagagaaatcagccaggcatgatggctcatgcctgtaatcccaacacttgggaggccgaggcagggggatcacttgagcccaggagtttgagaccacctggggcaacgtagcaagaccccatctctgcaaaaaatgaacaaaattagccgggcatggtggcacacttctgtggtcccagctacttgggaggttgaggtgagaagatcgcttgagcctgggaggtcgaggcttcagtgagctgagattgcaccactgcactccagcctgggtgacagagcaagaccctgtctccaaaaaaaaaaaaaggaaagaaaagaaactgaaaaaaaaaaaaagcagaagaattgatagtacactttccaagctataaagcattatttattaggtatccttcaatggatgatttagcactttcaggaatggggaaataaatagccaggttgaaaagtgactgttgtgtgtcagagagggccttctctgaggatttggcatcaagtttgattgtattttgtttttatccccttaggtgtgagagggtccagcagaaggaaacatggctgccaaagtgtttgagtccattggcaagtttggcctggccttagctgttgcaggaggcgtggtgaactctgccttatataatggtgaggcatggagggacagtgggtcactgcactttcctaggagttttctgttggtctgcatagcccatgtgacactcttgatggtagctgccgtcagtgaatgtgtttgtggccaagagggctcacctcctgccatttcataccacaggactgcattgttatcagagcccctgacctttcagtcataggttctctcagagcctgtattcaaaaagagcttcccagcccacttcctagttggatgtgtccagtggcttctgtcaaggtgaagtgaagccgcaccacccaaatgctgccgcacagtgtctggatttccctggctatctgaaatggagatctcatttgttctcctctgcttgcatgtggaataacagcaaaggctgcagatctgtttgggtgaccttgtcctgaacaggaacttttgctgtgctgaattcgggtagtttcagagaaagtatctttgagatgcattgcccagcttttaacagtgtaggagggaggttaagctggcttttcttccactttactgtggaagcttcctcattggtcaagcaatggatttgacctgactttatctgtaggacctcctttaattctgacattctgacactttcacatgctgcaaagcagcaatagattgacccatccggtgtgtggctggctgacaagaggagctttactttcagagtgaagatatttggaccaatgataaagttcagagaggcagctgattagaaaagcctgcttggcttatatgacacatcttagcagtactgtgatccttttggccacatctgcaactagacagaaattgccatcataaatttctctctgtgccaagacagctctataaccccttaaaactttagcgaaacagagctattaggaagaaagagtaggctcttcgaaatgtaggattcccataatgagggtgctacttctgggagcactaggttaaattggagcccgatggatatgtggtaactgggaagacctcactgagttttagaagttttggtagatgattcctggaaatatgttggtgggagttcagggatagaatggtcattcagaaaatcaacagccagttccctcaaggagaaaggatgctaaggaacaggtcctattaccaatccttggggacatgtggaacaggaagtgactgcttagttttgcagctagttagaagtctctagagaccaggagttggggaagacagagagaagaggggagacttaataagtgaacagaaagcaccagggctctttcaaagacatgatccttttgtttaaaggatgagaggatttttatgacatgtcattgtcctttcttcctagtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaaggtgagtcttgcctatggttcaggtaaagtagggagtgtggaagaggtgctctgttcttctgtgtcacaggagcatctgtgggataccaggatccaaaagagtttgaactgtacatcataggaatgactagactacttgccctggagagcttgatatggaatcttagaaatacccacttatggctgggtgcggtggttcatgcctgtaatcccagcactttgggaggctgaggcaggtggatcacctgaggtcaggagttcaagaccagcctggccaatgtggtgaaaccccatctctcctaaaaatacaaaaattagccggtggtggggggtgcctgtaatcccagctacttgagaggctgaggcaggagaattgcttgagcctggggggcggaggttgcagtgagctaagattgtgccacttcactgcagcctgggcaacagagtgagactctgtctcaaaaaaaaaaaaaaaaaaagcctgcttctaatcttcccatctctttggaatttctttccgtactgttttgcagttgttttcaggatacattatgtacctatttctaaaactattgataggagcttccagagatcagggagttgtaggtattaatacattgcccacctctcttggtgcccagttcagggctgtctcatgggcgcttggtccatattgttgacatctgtaagcaagccgtgacagtgctttggctccaggcaggcctgaattgtccaggggaaagtataattctctccctggatcctttaaatggtccaagtaatgagaagcagaacataggatcagtctgttaaccccttatatgtgttacacatttgacagagtgcttttacgtctgttttctccttcaattttccccaacatttccgcaaggcccagaaagcaaatgaaattgtccccattctcatagacagggaaataagctcaggttggctaaggcttagagaggccacatcattagtaaatagcccagatctttggactgatagtctaacaccgtttccaccagacccgaactaacctctccaaggctgactcctgacttggccacaatcaccagagcatgtaaaggcctcaccctacaattcttagcattgccctgtctattgtcttaaaatgttcagtgttgcaaactttgcatggcacctgttagacatataatctgaattatgtatatctgagggcattcaggggataccaaaaagctgctatcactgaagcctcttaagaaattataaactctttatgatgctctattgggttctctgccaaggaaaccaggcatacctgcaccttgccctctgggatcttataatcagcagatttgcttataaattgtagcaaatttggagccaggcacagtggtgcgtgtcagctactcaagaggctgaggcaggagaaatgcttaagctcaggagcttgagtctagcctgggccacatagcaagaccttgtctctaaaaataaaaaataaaaattgccaggcgtaatggctcacacctgtaattctagcattttgggaggctgaggcagttggatcacttgagcccaggagtttgagaccagcctgggaaatatggcgaaaccccagctctacaaaaagtacagagattagctgggcgtggtggtctgtgcctgtgtagtcccagctacttggaaggtgtaggtgggaggatcaactgagcccaggaggtcaaagcggctacagtgagctgtgatcttaccactgcacttcagcctgggcaacatgtgaccctgtctcaaaatacataaataaaaattgtagcaaattggagtaggagaggtcatataaaagaccacttgtggccaggtgcggtggctcacacctgtaatcccagcactttgggaggctgaggcaggtagatcacctgaggtcaggagtttgagaccagcctaacatggtgacaccctgtctctactaaaaatacaaaacagctgggtgtggcggcgcgtgcctgtaatcccagctactcaggaggctgaggcaggagaattgcttgaatctgggaggcagaggttgtagtgagccgagattgtcccattgtactccagcctaggcaacaagagcaaaaacctgtctcaaaaaaaaaaaaaaacaaaaaaaaaacacttgttttcctacagtggtttttatttttaactccagtgtttgtcccctaccctaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggtgagtgaacaggggcctttagcctcgagcccagagcaccaccctgggagggtgccaggtggcaggaagcgcttggcagtgggttggttgggatgtggctgctagtttcctggttccttttctgcttcctcattaacctgacctgcccttctgctcctccctttgaaaccaggctcgctttgatgctggagaactaatcacccagagagagctggtctccaggcaggtgagcgacgaccttacagagcgagccgccacctttgggctcatcctggatgacgtgtccttggtaagatccttcgggagaccgaggaggggaaggggctgcagttctcgtttaggtgcctggctccatttctgggtagacgctattaggtcctcccttctgctttgctagatgtgagacttgaaaacacggaaacatgctgaggtgaggcagtctccgtgggtttttcagttgagggttcttttaccttccccctgccacacacatttttcttatgacctctggttgtatccagatagtctctaaccactaaatgttttaccttctccaaactgttacccagagagtgatgccttgttaaccctgtttgacacaggcagaaactgcctggtagagaccagagaacagctcgggtagtccttctccctagcacagacctcccagcctgactcctgggagcttcctaacactttacagtccgaagctcagtgaagtaagctctgggaaccccagtgaaaggtgatagagtgtaaacgaacggttggattcccccaggcctggtatagggggcaagggacatctctgaggcgtaagctatcctcttgagacactatagcttgtgtgtttatatgacattggatgtcataactcagaaagcaatgcaggcaggatagcgtttcaggttgaggagggtgaggggaaggggtcgtgtttctagattctctgggaaaaaccatttggagtgatttgttcgggcagtgaggtaaagtgtttcctgttcagttctcccgtgcattgctagggaaaggcactgcctcccccggcatctgtgcagctgtttaaacagccacttgacaacacccagtgctaacccctgggcactgctccaccttgctccgcctgctggaagtcctgggggcttggggctccctctgctggcaagaggccaggctgcagccattctgtgggcccttccctcgtaattaccgttaacctgaacaccttggctgtgagaaaacgctgagtaaaaacctaagggaaaagttggcattttactagactttaaccacatactccattctggggaaatgtgggctgaccacaagaaaccctatctaaggtgtgagaagaaaattaggtttcatggggaatttgctgccctcagctggcccttgtagaaataaattttattccttaattatacatttcatttttcatgtctcaggatcagattttcttacccaaactttgactaagaaactagaaatggatcaggcgaagtacaacagctgcagttagagttaggaggttaaaaattctggaagagaatgagaccaggatttactcttcaggagaagtttggagctgcttttttaaaaagcagaggttgggagagtggaggaaatgaaacaactagaatttgatggcaaaaccaatgctcttctcttgattctttttcaataaaaattaggatgaataagtaaattgctctaggctgggcattaggaattctgaggtcccttcccattgtttgtgctatctttagggacagtcccgtcagacctgacatgattagggaaggtctatggatcatcagacttctaaaccctcatgccgaccaatgactttacctgctttctctttcttttaaaccgtttaacagaaccattcacattgggaataccatgatttgcgttccaccgtccctcgtcctcttcctgttcagtggtggagctgctgtgggaagacgcggactggttaatccataaacagagagcatcaggctcttggatccctgggaaccagctgcctccctcactctcagggaccctgttttccatctggccttccttgggctttgaacaaggcatcaaaggcccttggaagagcactagtcagtggcgggggtcttagaacccacagttctcctcctctggggaggtggtcgattgagtagataccttctggtgcctgtgggccccatcaaaagcccccggtgccatttgctacatgaggtcactgtactgagagtgacagagtaatatacaggagcagtttgggcagccagagagtctgggtgtaaactcagtttggatacagatacggaggtggaagagtgttctggcctcacggatgcctccagctgctagagccattgctggcctcttcttccagcggccatggagccctcccagcagtgctgtcgaagcaatcacactgcctcatcttgtgctcactctctccccttagacacatctgaccttcgggaaggagttcacagaagcggtggaagccaaacaggtggctcagcaggaagcagagagggccagatttgtggtggaaaaggtgagccttcgaccagatggcaggagcctctctctcccctttctccggcactcagcttccccatttgctgggtggcctggaaattcatcatctgtcatcccttcttccgggataatcagaaggggcttgaaggaattgtacttctgcaattggttccagagtcttcaggggctagtcaaggatatgtggagttatgttcctaaatcactgaagggtaatttttcttccacttctctgagatcaaaaacactctcttacaaataaaaatgtttctcctggagtattttcagcttcactgagaagtcatttttaaccatagttacatagtgaaagctgacagcaaaaaagatcaaacgttgcaccagatgtgctttcgtcactagatttttttctagtgctaaatccatccagatgtgtcaaagaatgtgatgggacacagtgtatttgcgtagcagcctggtctttctggtatttgcaaagacatgttcatttattgttgtccccttcttcccaccaccagtatccctaattggtggggagatggggacagcaagaaataaaatgggaaaagagggatagatttaattttggagaatgaaaacactgtgtgggcagagacttgtgttgctttgtatctgccataacttcagagattataataagtctagtacagtgcctggtgatagtaggtatacagtaaatgtttgttgagcaaatagacgcagggcccagtcatttcaaaattgtatgtaatttcagggaggcttaatactgtcttcttcctcacactcctgaaggtcacacgttgcagagagctgtcttcctattgatattggtagggcaagcctaggagatctcactctgggtgcctggattctggtcaggaaccagcctaactcacaggcagctctaggaacagtcaaaagtgcatgctgctcttccttagccatcccgaggttttttgtttgtttgtttgtttgtttgtttgtttgtgacagctctgtggcccaggctggagtgcaatggcatgatcatagctcactgcagccttggcctcctgggctcaagtgatcctcctgcctccgcctcccaaagtgccaggattacaggcatgagccaccacacccggccctgtcctggctttgatgaagtcctttagacttaaggctggaggaaaagatgagccttgaggattgattccacctttcttttgcttctgttttccttggccttggcttctcctggctcagagtagggttgttaaactagattgcaattaatattaatgaggactttgaaataagacaaatattcctgcagccaacagagatgtatccctcccgtgacaaggagtgagcatgaaaggataggggaggactggtgggcaatgtgctctgcttccccccgcttcccccgctagccatcaggaggaagtaaactccccgagttccttcaggagcctgggaaggtggctttctggtgaagggcctttggttgtagcctgacatgcggtgccctgaggtttgatctttgtctccacctccattcttttaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcagccatgggttggttttttgtttgtgggagccgtgggatcagaacagagtgttctagcagtttttgtgtgtacatgtttgcattgccagctgggacagagtctccagtaaggcagaaaatgctttgttttcagaaaacactttgtgttgtgttccagatccatccccaacccgaagggaatctctgtggtagcaggtgaggtttgtcatgggataggcagtgaaggtaggtggagggcagttaacttgttctgtgtgttttggtgccactactcactgggagttacaggcctgcccgccaactgccagcaacaccttcccccaatgctagggaagtggttgacgtaaataatgtgtccggtagccctcagttagatggcttggggcactctgcagtaggtttttttttttctcttgttttcttttcctttctttctttttttcttttcttttttttttttttttttttttttttttgaggcagggtcacactttgttgcccaggctagagtgcagtggcatgaacatggctcactgcagccttgacctcctgggctcaagtgatcctcctgccctagcttcctgagtatctgggactacatgtgtgtgccactatgcttggctaattttgtattttttataagagaccaggtctcaccatgttacccaggctgattttgaactcctgggctcaagtgatccagccttggcctcccaaagtgctgggattacaggcgtgagccactgcgcccagccagtgggtttgtattgcttattctgctttgctttgacaatagggaaattggaaatgccttggcatttgaggggagctgagtttgtgcattttggatgatggggagggaaagcccaccgcaggttgagaaatgaactgtgtcaatcacccaccccaaatccttctaggaacagagtggaaacagcatgcagtgagtggacagcactgactgtgctttaaatctgctcttcatttaatccccaggctcaccacctggccacagagaggggtctttaagaagactccacaggctgctctctgacctggattccacatttcctcccccagagtgatcgggccaccacctgtcagctggggaagagggagacccgatgcacagatttgggatggagccagggattgagttctcccaatccctgcatcctgcacccctcccagggcctcccagcagccatcccgggagcagaccacagtgtgtggtgggctcctgaccctcagctgcacctcaaacctccctcccgtgagcctccccgcatccagcccatctccctgccgcctccccagcatcatttatctcaggcctcaggatatctcttcccactttggctcttttgctgtaagaataggctttcgaatgatgaggtgcctgaactcaaagcgcattaaagattggagcagaaagagcctaattcctaaataagttccagaccagcttccactctgcgcccttcctccttttcctgctgtttattgctttggacacccttttgggggtgggaggacaggaggctcctctctctttcccaggctctttttaaaagagcagttgtgtttcctgcatttggcgggagattgggtttcatcctccaggtgtctgtaggggagccctgagctgcaaagctgccttgcactgctttgaggttgctagtgccttcaggtcagccctttcagtggcaggagggccaggtttcctgctggctttgccattagcctccctgccagggatggcaaaggcatatcccagtggcagcccaggggcctcattttgccttgacttccgccaagtaattcttttcacaaatgttcaagggctgttaaccagcttcttagcccctgatggcctctgggtttctccagaaactgccacaatgggcctttatcagctcgggattctctgggccttggatcaaaaaccatgtcctgtcctggccagggaagggagagcaggaagtgtcttcctcc

SEQ ID NO: 12125 - DNA, 20565 bp, Human
ctgctgcacaggatctcccaaaggcctcaggagtctgtgatcagccaaactcaccctgcacccacaaggtgggcaaggagaggctgagggcctggaagacccaccccagggagctcagtgtatggactaggagggcacagtgtggaccacagaaccctcaggatgagcagggacaaagcccactgaccaagcaggggaagtcacatctcagtagacaaaactatttccttctggagcccaaggccagcacagcatcgtgacaaagcaagaccaaaataataatgggccaccccttttcactgcctcagcagtaacattgaccaccccctcacccaagaccgctctctccagactggaccccaggggagagaagggagacaaaaaggaagggaactccataatgaggctaaattttaaatctggagtgaagtgactgagagatcactgaattgggctgagcttgcctagaagtgactaggtaacttgttttcttttatcagtcagattatgggtttagggtttgaaattaagctacatctggaagccatcatcctcatcaaactaacacaggaacagaaaaccaaacaccacatgttctcactcataaatgggagctgaacaatgagaacacacggacacagggaggggaacattacacatccgggcctgttggggggggtggggggagggagagcattagaactaatagctaatgcatgtggggcttaatacctaggtggtgggttgacgggtgcaggaaaccatcatggcacacgtttacctgtgtcacaaacctgcacgttctgcacatgtaatcctggaacctaaaacaaaataaaaaaagaaaatctaagtttgcaaaccacaaaaaaagagagaaattaagctacataaagaaattatggggtttttttgcttgccattgaaatctgtgattgtgtgttaacacccacaagtgagccagtggttagctaaaataagacccagggctctggctgccttgtgtttctccagggctctatttctctatttttccttccccttctggtgtttggcctataggactctgtagggagagcctgggtcagccctgcacaggtaggatgggcagcatttctgtgggggtttgcagtgaggggtcggggggccatacacgtgtgtgttggggagtgggcttcacttttgtcacaggactgccacgatcatttggggaacacctgggagtcccaaccaggtcatgttttggcatggactaacagatagggaaggaggtgctacttcagctcagcaggtcagcaccgtccttgctatggagccgagcccgggtcctaacaagactctgaggtcagccatgttcaggggagcccagaagcagcgagtctttcatgactctggggagtgaaacaggaagggccacagtcctgccagttcctggagctctgggactggtaaaaggggcttggcaggaggtgtataaggggcatttttgtccaggctaagtaacctagggagtcggaggggattccagagcaactggggatatgagaccaaggactacgacagccactcctgccacctgtgccccatcagatgatgtcaacttcaaatcaagcattgggccaggtattttagagctaataccgggctatatcctctacctgtagatttggtattaccatccctcttttccagatgaaaagaaataggaaggtgacttgccaaaggtcttgcagctagaaagcgacagaacagcatcttcacgcttgacattctgtccctcatcctgaagctgcaacgatggaggattcccaagtaacagagtctccccaaggtcaaaggaaaccaaatggagccagccaggaaggccaaaatgaaaggaaagcaagggatctgtgagagtcacatgaccctggctggccacggtgcctgtgggagagtggccctttaagagcccaggtgtgggtcaaacactgagcagagtttcagttttggcagcagcgtccagtgccctgccagtagctcctagagaggcaggggttaccaactggccagcaggctgtgtccctgaagtcagatcaacgggagagaaggaagtggctaaaagtaagtgttactgctctgggatccccagacgggatgctatctggaaagggctcgggacgatggctcaggtaaccccctccattcccaactcccagtctcctagatagtggggtgacaaggacaaggaggcagactgtgtgactgtgtgtggctggggagtaagcgtgcatatcgcagtgggacgagtagggatgcacgtgtgtggaagccccccatccttttctgagaaatatcagcaggtgggaagggacctctgtggtcagcatatgtaattctactctttcagcttggtctgtgcctggatttcctaactcctcatagttgattaactgtgtggccttagacaagccacctaacctctctgatcctcagtttcttaatctgtaaaacaaagatagaaataacacctatcattcagggtcaatgtgggttcaaatgagaaaacacaggtgaaatagctttgtaacctctagaatgaaataggaattgtttcatatttttcagtttagtttaattaatcaaggatttattgaacaccaacagacctggaattagatagtgcgcataaagtatggcacctagcaagtcctcttccattctttgaggtttcccacttgtggctttctggcaaaggcatgttcagctccttttttctgggcttccaagaacctctgaaatcctttgcaattccacctcgctttgctctagcagattcctgccatgggagacataaatgtgtgtcatcgcatcatcctgcccttcctagaggtagaaaaaaagaggtcctcacgggatcactgagtgaggtggagctgagccccacaggcagcatgatcaactcctgctgttcctcctggctctgcagccagcagatctcagacatgggcttcccctccctttgcccatcctgacagcagcccaagccagcagtgggaccgtccggcacaagggcagcagcgggtcaagctccatccctgacccccagttccctttgtgcaattgccacagtgcctggggccattgaagctgctcctattttgtgccatcactttcccccttcactaggggaattatagatcctttaacatctggagaggagatgccaatttcaggggtttaggtagaaggcagctgtctggtgcctggacataggtcttcccagagccagatctggaattctctctccatccttgtcccgcccctggatgtgctaaagtagcagaaagaacactgagccaggagtcaggaaagcaactctctctgcttatctcctagtgccgctagacctctgtggctttaggtgataaaaaatggggtcacacaggcttccatttagtaaacccacttgccctgggctttcacaccttcgtctcattctcccttgataccaacgaggaggtaggcagggttggttttgtgatgtcattccctagttgaggaaaccaagacaccgtgagtctatgtgagtggtgtgaagtcaccagcaagtttgaacgatgaggttttggtacagccattttgatatggtcatgaggacattttgatgtcacctaaaaagcaaactatccaacttaaaaaaaaatacctatgcattgtgctcagcagagaccttcatctatgtcttgccctctctctggaggggctggggctggagtcccaatgtcactggcatcgacacagtatggtggagtggaaagaggctttggcgtcaacatgcctggttatacccatggttatgtaacatatcctacacatggtaggtgctaaataaatagcagctaatattttccaggaagaaatttctctgttggcacctacctctgggtccaggtgtctcttcattttttaattttttatttttttgagatggaatcttgccctgtcacccaggctggaatgcagtggcgtgatcttggcttactgcaacctccacctcctgggttccagcgattctcctacctcagcctcctgagtagctgggattacagacccatgccaccacacccagctaacttttgcacttttagtacagatggggttttaccatgttggccaggctggtcttgaactcctgacctcatgatccacccacctcagcctcccaaggtgctgggattacaggcgtgagccactacgcccggccccaggtgtctccttataagaactgccttttccgtgaaaggcagagaggaaagaactgaacaaattctcagttcgctaagattgaatatcctgcttcttcctctctccactgcttcctctcaataggaagaccctctgaggtaaagcagagtggctaagggcctatgctcttgatctagaatcccatctaagtcacttaccaactgtgcaaccttgggcaaatgtctcacctctctgtgcctcaattatctcactcatgaaatggggttgcccattttgtcccatctcctatggtggctgtaaaaatggaacacattaacacatgtaaagcacctggaaaggactcagcgtacgttcttctagcctagcccatagtgcttgtctcctctcttatccacatgagtccaacctaagtagctcactctccatctctctatcttcaaaggatgtccagcaagcagacttctactctcataccaagtccaggggacctttcttcctctgaaaaagagggaaacctgagattagatggacaaaggtttggactccacaccatgagagatgaagtgcagtcactttaactgaacaggagctagttaaatacattttataaaaagaaaaactatccttcagcacagcttacactcctgccccaatccacaattgtggggacatatgttacacatatgttgggatactaacttagtaaactgaaaatgatctagcacatcctagcctcagcagtgaaaaaacaactgctagtttaaggaccagaaaacgtgccctcatgcatgatataatatcatatatataaaacccaataaagcaggtccctttgctcatttaaagagtgataatggggtagtgacctcaaattaggattctgctgtgggtcttggggtcgagaatccctataacccttagatttccaacctgtgtcatgaggataacaacatctatctcttgggttgttgtgctgatggatgaagtcttacaagaaaagaacctagcaaagcatttggcacgtagcaggtgcccaacattatgttctttttcttccttccttaagcaaatcctttaaatccagccccagccaccctgggctggggaggtctcccgagatttgaatccccaggtttggaagaaagtctctggttttgagaggaaggggtctgtaatgattctgaaagctcgaggtcctttcaaatgctactagagaaattgtgcttcaagttttagctttgggcaaagaagagctcctgttcctgaaagcaggggtatcctctcctgccaatcatcccatctaggactggactgtgtgcatcccgctgatgttgccatctgcccgacctgcctgtgcatgcctgatgctctcatccctggcttgagaccatgcagagggtaatgggtgcacacacatgtcccctctctacacaaacatgcacagccacccaaacatgtcacaaaatgagaagtctgggacagaggtcagggtggtcttcaccttggagaagctggcatctgactctctgcaacccaggccaagtccagaggagggctgcatcccccagctcagcttgtgggaagaccactcctgtctcacgcaaatatgaggcagcttgcttatctagaggtgaggacaggaacaagaagcaaggacagctgctgctggtgtgggttcttaaaagcaggcagcattttgtcctcccacctgtgactgcacccaccctgtgccagcacaagtagaaaatggtagatctcccaggactttgcagccagcccatcccaactgtttctgagacttcctggcctcctgaaagctgctcccacctgggagcatctcccatggcagcttgcagtgcccacgcaggtgatgacatcccagctagtgtcccctgattgcttccatgttggagctgactggtatttggccaaggccccactccaggcattaatcattgacctggtaagaaaggtctggggcaattaaccggactcaagagagcctcaacgttgccatctgacacccatatttgttcccactccctccctttattcttccaaagaactgcagaaacaaaatacctttatattcacaaggaaataaaaggttccttgctgggaaattcccctgcaacaaagaaataaccaagataaacaactctattgcctttggctcaagctggtgaagggagtctgggagcaggagcaggggccagggtggtgagggaggtctgggagataacgcccagcttcctcctgcttacagcgtccttatctttatgggcactcattactgcccaaacttacgatcatttaacactctctttgtcaagacaactccaaagtttaaagtctgtcaaagtctgggaaagtggagacttctgtctcctcctctaggctgtagttggggtcttgatgacagctgctgtcaggcagacccctgggaccctcaactctcctcagccctgggctgtgtccacggtggagacaaagtccacacaggctgctccgtctgagtggtctcatcttcgattcttcatctttgtctgccaggccttaccaggcaggattacaaagaccctaacacctaagcttttaaccccaattccataaccaagttgctgggaaaacgtaagcctatcattcagcatctcaagacctcaatgttttatccataaaatggttgtgattatacccgtctgtcttatttcaagggaacatataaagctcaaatgaaataatgtaaatggtagtgctttcataagcaacagggtctctacaaataacacaaataagcataaggtaaaagcatgctcttgtatttggggtgcgatacagtagtggagaggttaagcacatggactttgcagtcagacaaaggtgggcccaaatcttccccgacccccattctgtgtacccccacacatttaaccccatgtgcccttgaggaaagtacttaaccttgaagccttcatttcctcccatgtgaatgtggataaggatactaacctcacagggctgatatcaagtctgtatgagatagtacacataaattattcaacacagtgcctgagacagaataagggagcaatcaatggggttaggaccatcatcattacatttacagccttaataatcatgacacctcctctgtgggtctcagtttcctcatctgaacacactgtgaaatatgtcagcccgcttcacctcccaggaatgtagggagggcagctgaaacagagagatgggggccacgtattggtaggaaccaatcacccagcaagccattcctgagatcttacggtgtgcctgggactgtgtctcatgggcagggaaacagagcaaatgacacaatatctctatcccaaaggagcttgcagcttagttgagaagacaaaagctacttctagctattaaggatatacaagtgttgaaggatgataagactttgaattgttatggaaaaagtggaggcactgattcattcaacaggatttatgtcagttgctggagatacaaagccaaatagatgtcacagaaactctaaggtcaactagtcttggaagacaaggggcgcttcatctccttgtgattattgtttttcagcattgcacaggagaagtcggcctgagtggtgcggcgctcgggacccaccagcaatgctgctcttcgtgctcacctgcctgctggcggtcttcccaggtgtgtctgccaggccccaactctccaagctccaccccttcagcctgcccgactccagggttcacctccctggggacactaaaatcagactcatccccagggatgtccctctcaaagttggcacttccttgaggaagagtcatacagagaagacactgaaaggccacatctgtgagcattggaagtcagggacaggaatggcacttcctaatctcaaggccaggggtctgtgaaagatcttctttgagaataacaaagaccttaacttcaaccaagcatctctatgacccgctgtgaaatctgagggaagtcacttatcctttctggctctcaatatttttatctgggggaaaaaaaagaaaagaaaatcatctacaaagtgcttttagaaatataaggaaataacacatggcaagtgcaaacatgtaacaccttacgaaagtggtgttattgtttgaaaaaacaatggatggctggatgctggctcacagctgtaatgccagcactttgggaggccaaggagggtggattgcttgaggtcagtagctcaagaccagcctggccaacatggagaaaccttgtctctactaaatagaaaccaaaattagctagcatgcacctgtagtcccaactacttgggaggctgaggcatgagaatcgcttgaacctgggaagcggaggttgcagtgagccgagatcgtgccactgcacaccagcctgggcgacagagagagactttgtctcaaaacaataaaaatatataaaataaaaaacaagggttatcataaatttgtcattcccttgtccttgaaatggttatcattaatgaataacaattccaatttaatcatgattaaaacagtcactttatttaatctcagcaattttccagctgtgatatatgataaattatcaacacagggcctacgtgtcaggtagaaaaccacatctactcatagtgggttatctggaacaggctttacctcccaagggcctcagaaagcctctctcttctgttcccacagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtaaggatccaagctccttgggcttctgggggaaagttagagggaattctctaaggtgcatggagggcttgaggaggaacttcctgacaaggatgtgtagccgggttgggggtcagaaggcacccctttccccaggcaaagacttctttaacaggagaaggagacagatagggcctacttgggggtgatgagtgaacccttctaggacttggtggcctataacattttaggctttctggagaccccagcttagaagggtatcagaaggacaagttttctggtgtttgctacaggtagaaagggaaatctgacatcaggctaaggagatagaaaaggtagggagagatttacagggatccttaaattcctatcattaatgcacctttccatcaaggtttgggccgccaaaaggcttcttgtaaaatgcatattttttttttaacctgggaacccttagtcttttggtattatcagggtaaattagattattagatcttgaccaaagaccaagatcctgaaaggatgggttgctaacaagcctattctagttggagaaagagaaaaaaagaaaagctctttctgacaagggtttaacaatgaggctgttttagatagtcaagggcaactcaaaagagaggtctacggagaaaagaaattcagggggactcccaaagacatgtcttgctcctttggaatatgcatactattgtctgtggactaaatgaggaggtcatttaggtggggatcaagattcaaaaccacagaatctttagaggtgaagagggcttagagttcaccctaaccggacacttagaagaacatgctgatgatgggtatgcagcctctgattaagcactttagcagaaactcactgctccctgagacagcccatttcacatttagactcttgtaatttttagaaacttctattgtatgcgttgaaatccatcaccctgcatttacattcattctgttcatttcagcacacattaatttggccacctactacccagaggcattgtgcttgtcacagcagaggggtcaaacatgagaaaaacatgttccagccttcaaggaacttccagtccatggagaacataattacccatacaccagattggatgtaataagtgatgcagatgtatcaagaaagcacagggcagggagagattagtgttagcttgggaaaggtttcatggagaagaccgctgtcaagctgggccttccgacagcattcctctgggaaggagggcattccaggttataagtccacccacaccctaactaggaatagcaaatagtcctatgttgcaagaaagtagaatcgtaacttgcctgccccctaccttgcacccctcatcctgcaggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgagggtaagaccctagagagggagggggagtaggtggggcagtctcgcaggtgagagccaagctcagctccctctgagtgtattcatcaatagtcatcaatcagccaacagcatccactcaatgaccagccccgaactggaggctgcgtgggctgctgcacaggacagcaagaaaaagcaacctctgcctgatggcagctcctaattactcttctgttatcaaagtcattttgatggctgtccctgcttaacaagcaagaggtgagtaaagctcttgattgaggcaggacttatagactgtgtttcagggctgtggcaggctctgcaggggtcctctgtcccctcccctggcccctgaacaagatgggtgcctcatccctcacattcagatggaaaaaggattggcttatcttggtctcaatgcgttcccaggagtgccccagcctctaaatgtttcactgtcacatttcgtagggttatttgtgaatttcagcaccatctggcccactcagccctactccagtgagccatcagcatggtgaaagaattaaatcccagctccttctcatcccagagcaccctgcatagagttgccctcgtgagaagcagcaaaccagtacttgcagttccaagtatctgtgcttgtgactttttttttttaaaggggcttatattctctgcatgccatgtccacatccagctctgggttttcaccagaatcccctgcatctttggtcacctgcttctctctggacctcagctttagctgcctggagaatggctatcgtctttgagatgccccttggggccccaacaattaagctcacctttgctacatactttatagtttacatcataccatcctaaatatattttcttgatttgggcataatccattgggccacttttgtggaatacacttgttagtgtactaaatagacaaaaacctacacagagggagactttgtaagaagccaaagaagagctgatatcctctccttcaactccttccattctctgctcagaataagatgggggaaaagaacaacatgtgcaggctgatggggagactccaagcccttggagtctggccctgatggctccagctgcaggctctgtgacattaggaaagctccttttcattttctgaagagggtaaggtgatgcgtgtaaacttcactccccatcctggctgagaccccgggaagaaggcttctcaggccacgcaaggctcttcctgcgtggccatcctcccatcccatctctgtctgtgcttccagagtccacgattccccgcagccccactgtggtgaagggggtggcaggaggctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggtaggagttgacagggagggagaaagctctaaaacctctccagccagcagcagcatccccaaccactcttcctcctttttcacccgcctccaccctgatgggccagacctcaggagggagcccacctatccagaggtcacattttcatgcctataacacgcaccttacactctgaattaccatacatggtacctcctactaccaagaacatgggcttctttcgcagtgtgcaggcatcagctgaagtcaaggattgcagatacctctttgtattgagtctagaagagaaggaagagtgaggaaagcaaactgaagtccatgtgtgaagatctatggtctatggtagactctggattgatcatggtgctcatcaataataattattacctaggcacacaattacatttcttctgtagtcagaataacatacttatttctaatgctatccaaagaggatatgtagactgaacatggtggtgcatgcctgtaatctcagcaccttgggaggccaagacaggaagattgcttgagcccaggagatggaggctgcagtgagctatgatcgcaccactaccctccagcctgggtgacagagagagaccttgtctcaaaaacaaaaacaaaaatatatatatatatgtatatgacatgtggacaaagattcccaccagagtcacttccctgcagcatctccaagtaccaacttctgtgtttatttctacctccctccctcctccaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcgggtgagtctccaaggacagggcctgcacccctcagacccagaggcaggacttcctgaaggcccctgcctgagagcttctcaatcagtgctggcccctatgtttggctgtaagaggctgaaagtggagagtgggaagggaggggacatttaggtcctatatagcctcgttgagcccttcaaaagggacatctcaaataaacataccaactaagtaaaaatagtgggtttgctatttaacctcggcattaagacaactcccagctgaatgtggtggctcacacctgtaatcccagcactttgggaggccgaggtaggcagatcacttgaggccaggagttcaacaccagcctggctgacatggagaaaactcgtctctactaaaaatacaaaaattagctgggcatggtggtgtaatcccagctatttgggtggctgaggcatgagaattgcttgaacccaagaggcaggggttgcagtgaactgagatcgtgccaccacactctagcctaggcaacagagctagattccatttcaaaaaaaaaaaaaagacaagtcccatagttgccacttcaacccagattgaagtctcttctatatctggaaatattcttctctgtatagaagaataatatgcatacatcactgtcatatgcaatatgttcatcccccttccccctgccaaagctcgccctcgaaagagggccagataccttcatttacaaggtctgatcaggaaaattaggaaacatctagtaaatttgcatttcaagtccccttttaaaatttcacatgaaatgttttagccctaataagggtatttgtagtccctcaagaaatcctattgggtctggaccctgcggatgggactcactgaggggcccatcgccaggctacctccagggggcagcactatcatacccagctgggcagtcaggaagcctggggcagcgtctcagagccttgaaaatctcccgggcataagtgatgggtcagcctttatgcacagctggtctatgacacgaagccttgaaggtccccactatacttttggtagtaatggggcagagatcatctgtgacagctgaagaaggccatcacagctgtttctaatgtcatcctgggtcctaccccaacagccttgagatcgaaccctgaccctgtgattcctcatgaagtctcccccagactccttcacctcgaggagtaagagcatagagaaaaatcacaacccaggcccactcttccctgctgcagggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcaggtaaggaaggattcaaggctccccactcggagaacaccccagagccgagcacctgaggctgggccaccaggtccaaggaggaaagcccatctgtctcttgagcactggggcagcccttactacctctgcttatatgtgggagggtcctatggtaccctctgcccttctcccatggctggggaggtgtttacaattcagttcaatcttccaggcctaggatgcaacaaggcccagtgcgtgcctttgccagtctgggaaggcttcttagaagaacagagctagggagctgcatcagcagggtggggtggataaacctgggaggaaaaaggactaagccaaccttgccagcacatcgtcgggcccccagatctcccttccagggatgaactaacttaagccttcttccagctctgaggaacaaggtggaagctccagagcgctggtctccaccctggtgcccctgggcctggtgctggcagtgggagccgtggctgtgggggtggccagagcccggcacaggaagaacgtcggtgagtccctgggatactccctgcctcccacctccaacccgagccctcagtcctgaatcatccacccatagaggaagctgctgtgtctcttctttttcatgagctaaaacaaaggatcccgagaaagcaggatggggaaagataaacccacacatactcgaaactgaaattcagagctgctgtccaaatactaacactggaaaatcatctccaattacccaggatctaggttcagagacagggctgccaggaagaggagattgggtttcaggagaccctgggcttggactaattggataactaatgagctgtgtgacattgagccatccttatgccatgcctcagtttcctcatggctcaagtcaaggatgataatcaggacctcacggggctgatgtgaggaccaaaggagatgctgtgcattgaaaggtcccagagtgacaaagatcagggattaccaagtcctgattacccaggaaaagggactggggaggagactcggatcatttccatccccctgggtcatagtcagagctgcaccacctcagctgtcctgcagggctacagtggatccgcccagagagaagcagcccagcctggccttctaggtcccagcccctgtccttacaccaactcctcttcctcccggacagaccgagtttcaatcagaagctacaggacagacattagcatgtcagacttcgagaactccagggaatttggagccaatgacaacatgggagcctcttcgatcactcaggagacatccctcggaggaaaagaaggtatgaccctcactcaagggaatgctcagcccctggggagagtaagaattggtctcacatctgggttgggaaaaggaggctagtaagggctaacctaccctctttcttcacacagagtttgttgccaccactgagagcaccacagagaccaaagaacccaagaaggcaaaaagggtgaggaggaagaaggaagccccactacatgacaaagaaatgcagcatgaggggatgcagttagacttcagaaagaactacctcaacatgggggccgatcccagaatagggaggatgatataaatagtcctcaggagtcctcaggactttttgaggaagaactatatcttactggttgtgggatgctgatgtggataaggcccaggaaggaggtgagctatatgattaggctgtaaaactgcaggagagaggcaggccaggagatgaggaaagcaggtgcataaaagatgggaagctacaatgccaaatgctggtgattaaatggatgctcttcctgggttgggggacccaaggacctcaggccacacatcctcccttgagggtttgctcaggaccagctttttgcctgggcctaggagacatttgcttgcggtgggcagtttgaggctagaagcccctgctcacttctcttgaagccccaccagaggcaactcctgccttgggtgccatataccatcccctcaatctgccctaggactcaggggaccaagaaaaataacatctcatgcctttaatcccgaggtgagagtttttgttgttgttgttgttgtttttatcatatctactttttcttgaaacatctctggcatttagcaaagttagaacgagttattcctgggacagccttcccctttaactttgtggtgccaaaaagctacctgtctgggctggtggagaaagaaaaacatacaccaccgtggttgaccccagcctaggccaccttgcccgtggactgtgtgggcagcttccggggacaggcccgggcaacagaggcggttccactccgtgtgtcagaaggaggtagtgagacagaagaagatatttttagaggctgcaactttccatttctcaaaatgcgtccttcttggtgagcatgggggctgggatgagaacagtgggccccaaaggcttgtgttgcttggaccaagatcacgaattcaggacattaagcacctcccctcccctgactccacccactgagccagtgcccccaacactgatgcctctcctcttgccccttagtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttttgtagagacagggtttcgccatgttgacgagactggtctcgaactcctggcctcaagtgatctgccgcctcagcttctcaaagtactgggattatataggcatgagccactgagcctggccctgaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccaccaacgaggctcagactgtatttgcacccaataccttctgtctcccagacagcctcttcagagcttttcttttctttttcttttccttttttttttttaagacagggcactctgttgcccaggctggagtgcagtggtgcaatcatggctcactgcagcctcaacctcctggtttcaagtgatccttccacctcagcctccagagtagcttggactacaggcgtccaccaccacactggctaactttttgtatttttttgtagagacagaatttcgccatgttgcctatgcaggtgttgaattcctgggctcaactgatcctcccacctctgcctcccagagtgctgggatcacagatgtgagccactgcatctggctgccttttgctttggtcccaattttaggcaccctgggacccccttgtctgttaagatcattcctaggttctggtgctgaaccatgtcatatcctctaagggctgcccaagctgtctgttggcagctagccccccatctcacccctagactcttccacagggcttctgtgtgtggagagttctctctgcaagagagttctccccagtctgccatcctgcctgatgtgaacctttgcttccacccaggccttaaacataatgctgtggatgctatga

SEQ ID NO: 12126 - DNA, 71645 bp, Human
  misc_feature (1)...(71645): n = A,T,C or G
gtcttggtgtgactttctttttagctatgtgagcacagacaatttgtggacctaagatttagtttgtatatttgtaaaatggaggtgggggagtagccatggctcacaggattaataatgaaatgctgcttaccaagaactaaacagaatcatgtgtgcaaaagtaccctgaaaactacagagtactttacaaatgattattcttactgggtttagcctcccacataagggagggagatctgtgagggatggggatagggtgggatctgagggccacatggagtagggaatgttttgggaccttttctttcttgctaaggaaagagtagtgtgacaataccaaggtaactgctgtattccttgggtatttttctttaaatagtgttggcaggatgggaactgggagagaaggaaaggatgcctcatgatatttgtaggaattgaggagggataaacaccttccaaaggctggctactgcctatagagaggataatgctgagctggcaagtaatgtaatcactaacactcactgatgtcagccagctagtaaatgatagaggtgggatttgaagcaagcagtctcactccttaccctgtgttcatagcctcagtgctactcagagagatattgggtcttgggagaacagaaagggacagcaaaattgtggagttcattctttttgtttgttcttgagacagggtctctccctgttgcctaggctggagtgcagtgggctcaagtgatccttcgacctcagtccccaccctgagtagcttggactataggcatgcaccactacatgtggctaattttttaagtttttgtagagatggggtctcagtatgttgcccaggctggtctcaaactcctggcctcaaaggaacctcctgccttggcctcccaaagggttaggattataggcatgagccactatgtccagcctcagaattcattttttttttttgagacagagtctcaccctgtcacccagactggagtgcagtggtgtcatctcagctccctgcaacctccgtctcccaggttcaagggattcttgtgcttcagcctcccgagtagctgggattataggcgtgtgccaccatgcctggctaattttttgtatttttagtagagacagggtttcaccatgttggccaggctggtctcgaactcctgacctcaggtgatccacctgcctcagcctcccaaagggccaggattacaggtgtgagtcaccatgtccagcctcagaattcattcttaatggattccttgaatgcccatgagacgtcaccagcctgggacatctcatgggcatgtaggcataataaatttttctgggcctcatctgcttttctatgcatttttatttctatgtctaccttccaaggaaggaagagatgtgggataatctgatcaagtcatattgctgccttctgagcaacactaatagaaggtttgggacttggaggatcctggggaaattaaggcagatttcttgttttggtattttcatatctgctttattttgcatctgttttataaaatgaaacttgagggactattcttgccttttttttttttctttttctgttgagacaggatttcactatgttgcctagactgatctcgaacttctggtctcaagtgatcctcccacctcggcctcccaaagtgttgggattacgggcatgagccacctctcccagcttgttcttgcattttgtaagatcacatagagtatcaaaactggaaaggacctgggccatcacttccctgagaaaaagtgactttctcaaggtcatgcagttagtagcaatgctggaactgaacgcctaccccgcagatcacaacatgacccgtgaaaggacctatcctgcaacactttggagtttcgtgccgacccaattagtggctttgtctttgggaaatttacttccccaaaacactgggacattgggatggaattcactcaccccaaatcatcaccctggttaaggagactaaagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagaggtgggtgcctaatattagagagttgtttcacacacgtggctcattcctcaagcctcgctaagccaagcccaccaggaagaagcttgagtggaagcattctctccagccacatctttctctctttctctcatactagatggcgtcctttgcagcaaaccgtaagttataaggatgagggaagaagagtagagggccaaaaggattccattttgaggaaaaactacagtttgccttgccaggtagaagaatcaggtatgagttctttttgtctcaggtaataaactaagcaaagcccagatagtagtaatgatggagcccttcaactattgacgtctccctaagagccctcattttctgaaagcagagtgtttgtcccattcctgactcgccatgctgtgtgtctcccagagagtgaaagaaattgctgtgactgcgagcaccagtagagtggatttaattctcaccaagaaaagggaggtggtttgcaaatgggttgttttgggatcctgggagaggaacattgtagccagagatattagattttcactctagactttaaggaggcagatttttttttttttttaaattaaaagataggggccaggaatagtggcttatgctgtaatctcagcacttgggagactgacatgggatgatcacttgagccaaggagtttgagaccagcctgggcaacatagcaagaccttgtctctactaaaaataaaaataaaaacaattagggtgtgatggcgcacacttgtggtctcagctactcaggaggctgaagtgggaggatcttttgagcccaggagtttgaggctgcagtgagctataattgcaccactctgattgcatccaggtttcactgtagcctgggtgacagagtgagaccctgtctctgaaaataataataataataaagagcttgtacaattaacttgagaggagccaaaatttgagtctaggtcaggaaacctctagaacctgtgttccttctgtgctatgctgaaggggactgtgagaaaaaaaatgttcatgaggctcgagtcctgaatgagatggagcttccccaagagccagtaatgacacaagtggttcttaaagtcatttctggaagacaataggatcacaagggtttaagtctatcagatcatgttaaaaaggaactcattcatttattcattaatttgactaacatcttgattgtttactagtgactttaggtacttttaagtcattgagtgggggaaatatgggttgccttgtgaactcatcagtggggcctttttgatggtcagacttcttggaggaaattaagtgtttgcagagatctgaacaatgagtaggaattggggcaggatggggaatggagtgtggtgaatgaggtgaactgaaagcagtttaatctcaccagagccactgaaggagtttgcattttatcttttgggcattcattccaccattgtacattgaatgtgcactgacactcttctacgtgcacagcagtgaagaggacaggtaaaacccttgcctagtgcttggtgttctgagaaaacttagttcactcatagttcttagtccactaagagtagttcactaagaattaaaccaagctttttaatgttactgacaggaattctatactgatagatagggaattacttggagagattctctagttgaatgcaaggaaagtttgagaaggactctcatgataatcctatagattatacagggtagagacaaaaggtgggttaatgattggttgattgttcattcagcaaaaacatcttcagtgcctcttctcattcattcttacatttattcactcatttatcaaatgactggcagtgcaagtttggcagatggttaagagcacggctttggagccagattacttgggttcaaagcctggctccaccacttacaagctgtatgaccttggaaaagttatttaacttatctgtgcatcactttcctcatacgtaagatgagggaaataataataccagacaaaatttgttgtaaaatgaaatgagttaattaatgaactacttagagcagtgcctgatgcatgtaaatggtgactcaacagctcatggttcttgtaattattattcctcaatagcaggtttgtgctaaattctaggaatacaaccttgaattgagtgtggtccctgaccttgagggaaccacattgcacccccctcccacccaaaatgcaggtaaatggatgagtttcttcatggagtggggtaatcctataagctcaatatgaatcgattgtgataaggtgccccaagagttatatatatacagtcttaggcagcatttcccagcgtcttaatatatagtcttaggcagcatttcctagagattatagaaactagaactgtggtgtttattattttggagatctctaaacttaagaatctgataaatgctgtggggtgtctacttggaaaaatacattacaattttgccttcaaacagcctccaaacctctgatcctatgatgaggagctgttaactcttctcctctgggttggtcagaccacgctgagaacacagtattaacagttctgtactggagcatgtacttcgtgtaaaacattgtgctaagtatcctgggggagacaaagataaatacgaggtaatccatgcggtttaaaggcttagtggaaaagaatgttttgtatgtaatgagatgtttgtagatacatgttgaaatgataaaagtaagaatgttcatcttgagcaatggaacgagatttatctatacaaaaatttaaaaattagccagacatggtggtgtgcacctgtagtcctagctacttgagaggctgaggtgggaggatcacttgacctggggagtttgaggttacagtaagctatgattgcaccactgcactctagcctgggcaacagagtgaaaccctgtctctttaaaaaacaaacatagaggctgggcgcagtggctcacgcctgtaccagcactttgggaggctgagaagggtgaatcacctgaggtcaggagttcaagaccagcctggctaacataatgaaaccctgtctctactgaaaatacaaagattaactgggcctggtggcatgtgcctgtaatcccagctactctggaggctgaggcaggataattgcttgaatccaggaggtggagattgcagtgagcggagattgtgccactgaactccagcctgggcagcagagcgagactccatctcaaaaacaaacaaaaaaccaaacaaaaaatgaaggatgttacttaaaagttgtgttggtaactgtgttaataaataaataagaggtaatctttttttgagatggaatctccctcagtcgtccaggctggagtgcaatggcgcaatctcgggtcattgcaacctctgtcctccaggatcaggcgattctcccacctctgcctcccaagtagctgggattacaggcacctgccttcatgcccggctactttttgtatttttgtagagatgaggtttcaccatgttggccaggccagtcttgaactccctacctcaggtgatccatctgcctcagcctcccaaaatgctggaattacaggcatgagccaccgtgcccagccatctttattcgttttttttttgttgtgttttgttttcttttttttttttttttttggagactgagtctcactctgtcacccaggctggagtgcagtggcactatcccagctcactgcaacctccacctcccgggttcaagtgattctcctgcctcagcctcctgagtagctgggattactggcgcgcatcaccatgcccagctaactttatatatttagtagagacagggtttcaccatgttagccaggctgatctggaattcccgacctctggtgatccgcccgcctcgacctcccaaagtgctgggattacaggcgtgagccaccatggccagcattattcttaagattagtgggctaatgtctataaaagtgctttgtagctataaatacctatacaaataaaagctattatttttattctagtcactagtagggataatccaaagcagaatgcacataaatgcagtagagcacattacaaattataaaaatattcaaaagagcaaagtcacttttattcatggggggatgggcacgcactgctcttatattacagccatcgcacatcccccatgaataaaagggtgcagtggctcacggctgtaatcctagcactttgggaggccggggcaggcagatcgcttgagtttgcaatcagcctaggcaacgtggtgaaaccccatctctaccaaaaagacaaaaaattagccagttgtggtggcgaccacgtctgtagtcccagcttctcaggaggctaggatgggagaagatcgcttgggcctgggaggtggaagttgcagtgagccaagatcctgccactgcactgcagtctgggcgacagagcaagaccctgtctcaaaaaaaaaaaaaaaggaagaatgacatgatcagagctgccctgtaggaagattatcctggcagtggagagcagatactttagggggtcagcaaggagacagactagttagtggtctgtttcaatcattcatcattcaggtgagaaaaaggaataataatttttttggtgcccaataaaataatttttcaggtaaaagaataatcattcaggtagaagaaaggaataacaaattttttggtgcccaatatatgctttatataggttatttcacttaaagtcatcagaggtttggaaaggaatggaccaatttaagagagattagaacaggaaggctgggggatttcctttcctgaaggattctaagaacgggagagatagctgggtgcagtggcttacccctgtaattccagccacttgtgaaaccggggtgggaggattgcttgagactgggaggtcaaggctgcagtgatccgtgatcacaccacttcactccaacctggatggcagagtgagaccttgtctcttaaaattaaaaaaaaaaaaaaaaagactggaagactggttatagctcagcctgggaagagcactggagagggagtctaaggacctggactcccacttctggtctcacctctatcactgaccagctatatgacttcacacagtgccccttgctcattggttctcttgtctaccaaactgtggggtgtgtttgtttgctttgcttgtttgtttatttttatgtttatttttttgagtggcctgggagagtgaaatgttctgggatgggggtgtggagagcatggaggtgttctagaataatcaccaacatcagcttaaacacttttttttttttgagacggagtctcgctttgtcgcccaggctggagtgcagtggcacgatcttggcttactgcaacttccacctcccaggttcaagcgattctcctgcctcagcctcccaaatagctgggaccacagacatgcgccaccatgcccagctaatttttagtatttttagtagagacgggctttcactatgttggccaggatggtctcgatctcatgacctcgtgatccgcccaccttggcctcccaaagtgctggaattgagtgagccaccgcgcccggccatcagcttaaacacttaatcaaatgtgatgtgcctgggtttccacaacaggatgggaaaaagaccatgaagtttgggctcacacacatttcagtttaactcttgattttatcatttacaagttgtgtgacctttgggccaattattgcatccctttcctgttttctactttcctcttccataaaagaaggatgataacatccacatttaaggattgttgtgaggactaaataagacaatacctggcacaaaataccagaggggggaaaaaaaggtatatttccttccttctatttctgtgatgctcatatgcatgtagtcttccctcctgtctccccacttctctgccttccttctctttccctttcaccagcacaaagtgtaacaccctcactcccgttgctacagtgggctgtactagtttcacagaccttgaaatggcacatacacgggaaaggtgtttcgacacagttcctatggactgttggtgccggatgcttacacggtcacaccctggtcgctcatccagcttaagcagtcagtgaatccctgctgagaatgacctctgactgttgctaccctgggagacactgggcgagggtcacatgggcaaggggctggtggaatgtgagcatgctatactgtgccagtggttcaccctttgcttagtgtagacttaggttctgtcttaaggacatctgtctctcttgggaccttcctgtgcaaactggggggataagagatcggagaaaggcatcagggcatgtacaaagcaacatcaaaactaattgacatgattctttgctctatacccctccccctcgctaaagtcactttcttttttcaaaatcttcatgacccataaccattccatgcacagagatgcaaaaatggtcagttaatatccaaagcaaaagcgttgctcttgttccccaggcgacagggccaccatttttatcagtgtgaaacacagagtatcagggtattaaggagacactgagaataaaagtgaggagatattggaaggcttaaccagggaaggcttctgaagatcgttttttttttttgagacagggttctctgtcacccaggctggagtgcagtgtctcaatcatggctcagttgagcctcctatttcagcctcccaagtagctgggactacaggtacatgccaccacacccagctaatttttgtgttttttgtaaagatggagtctatgtttcccaggctggcctcaaacttctgggctcaagcgatcgtcctgctttggcctcccaaaatgctgggattgcagttgtgagccactgtgcctggcctttctgaggatcttgaattcggatggaagcaggagagagagaaagcaggaggaagagaaaggcacccccagtggtagccatggctttggggccctaagagtcaggtgcaaatggaaatagggatggggagtccataccacgctgtacgtgcaggtgagcagggctaaggggaaactgaaacctacggctgcaacatgtctaggggtgaccaggctgacatgggcagtccttctgggatcccctgtggtctggcaccatcaggaccactgccttcttcccattccccccatcgagatattcttcctgtggtttgaggattctgggacaccacaggcatcttggagaatatcttgtttctcagttcttttttttttttgagacagagtgcagtgcagtggcgcgatctcggctcactgcagcctctgcttcctgggttcaagagattcttctgcctcagcctcccaagtagctggtgttacaggcacccaccaccacaccagctaatttttgtatttttggtggagacggggtttcaccatgttgcccaggctggtctcgaactcctgacctcagtctgcccacctcggcctcccaaagtgctgggattacaggcatgagccactgcacccagccttcagttctctcttaaggcgttgcatcctgagtagggtttctcctttgacctggctaaagtagaatccttggtcttccggctgggttcagtgtccttgactgaccctggagcaggatatccttctggcctgctaccagggagaatggaggctcccagcttgggaactgcatggctgtaggcagaggaccgtggccacctggatcaacctgggctaagaatagccaaggccagggtttggaggggtcagtgccttaaaggggcaggctgcccagtgggcagcattgtggggactgtactctagaggggcaagaggttcctacactcaggagcagagaccagggggaggccatggagctatggggcctaacattagagagcaccccccccccccgtcttttcatggctcattcctccctgggaaaatagaagtcttaccatttccagggcctgttgggttgggtgctcccctccttagattctgctttttaatgcaaatggccctgggagggactaacaccttgacctctcacacccctgtgtaaatgagtatcagatgtttaggggtgtttcatttttctgtttttctctggattgaaagactggaactgcttgaaaaccggtgtccctttcctttcctaccctggtctgtggggaccccacggcttctttacaccttcctgatttagggaatgaccggccaccctggggggcctgccagaaggcctgggggcatttgggagagggctcttgtgaagctcttctgcctgaggctccttctgtggcattctctttgcctgagtgccctcagcctgctggaacgcagagaacagcctgcttggggaagggccggagctgccccctggtgctgagagggcctgttttcctttttcttctgggtttaaccttttttctcagacttctttgccagtgacactaagaatgtgacctcggcgtggtggctcatgcctgtaatcccagcactttgggaggcccaggcaggtggatcatgaggtcaggagatcgagaccatcctggctaacatgatgaaaccccgtgtctactaaaaatacaaaaaattagctgggcatggtggcgggtgcctgtggttcaggaagctgaggcagagaattgcttcaacctgggaggcggaggttgcagtgaacggagatcacgccactgcactcagcctgggcgacagagcgagactatgtctcaaaaaaaaaaaaaaaaaaagaatgtgaccttatgggtctaggccagcttcctctcttctcttctgggagagctggtgagggagtgagtgagcaggagggtgtgtgtcgggggagagtagggtgtgtatggggagggtgtgaggggtatgggataagcatgggaggtgtgtggtgtgtatgtagcggggagacatagatgtgtgtgtggggtgcagggggaaaagtatgtggaggggttgggggttacacatggtttgtgtgatccctatggcttcaggcccccaagagtgactgtaatctattagggattgccttgatatttgaggagttagcattaactgaagatatcctgctttatcattagactctgagtctagcttgctggttgaggaacaccacgatggcacagggacagtgggctgggctgtgggcacgtggtggagagccttcctatcccaagggaggaaagaagcatggcgcgggggctggtcggcgccttagccggttcccatgaatggctggctctgcctttttctgcttgacttcctttggcccttctcagagctgagcaggtggctgtcagctgccggcagcccaccacccacacagcctggccctgcccattggctcctgcacccaggcttacaggcagtcacccccatcctccccacagacagcaccaccacctgggagctgctggccctgcctcctctactcttatgtgtgtgatccttctgggtactggggctctggcatatctgtgctgagtgtatacttgcaggggagagcacagggctggggccaagagtgtttctgagtattcccaccatgccagcctcccttcatcgggtctacaatcttttcccaactctggaacagctccagtaggagagacagtacaaagtcacttagcctgagtggtcctccctctcatctgggacagaaaggaggaccctgtcttcaagaccagagagaaccttttggacatctgagaaaggtgctaccagaaagcaccctaacaatcattataattgaacaaattggagacgcttgctcaaaaagccagtgtcagcccagcaaggatgtcttccttctggaggatggtctcactggcattattcagtgctctctggtcagtccagtgcctctgcagttaccccgacgtacatcctcatccccttggaatggggctgggccctcgtttgaagtacgcctccacactgcctccttgctccttgcagacctggatgggttagcccggccccgccgagcccagtgcagaagacctgcggaggcagctcctctgccgtggcctctcctgtcctctctctgatgagccctccaggcagagcagagccttgttgttatgttgtttcctcactttggtgccctggctggatgggaacagctgggacttgctttatggactctgctgaacaggctggcatcctccagggagttttccccacccacacaggaatgaatcctgcagaactggattcccaagggcatgagctaaggaagctgaactgaggctggaggtgacagtggtgacaatctgggccttgcagaagacctcagtttataggaagcaaatgctgtatcgaggcaaagctgaggaggatggtagatgggggaggccaggcctaaagagagctactgtgtcttcgtctctaactccacccattttctgtgtcctctttcagaggacctttgtttatacttcacagcatctacagtattttcagagcgtttagggtttcctaggtgttgctttttggaaattctgtggttgtttttctgatacaggatgggctggtgtgaaagttgtgtgtaaagaagttccctcggtggtctcctcagctggaggccaaggttggtcaggggaggtcatcctgggaccttccctgtccccctacctttctctggaaggccaagaaagctggaggagtccctcataactaccatgcccttagagggaacctggggtgaactggatgagaaggattggttcttgggtgagggaagaggggaggaggaagcaggaagtaggaaccagacagagatgtggctgctctggctcctgggatgattcctgggttagaaatacacgtactgccaaagcttttcttccttctttgccaaatgttccattcagttgattgccagcttctggttcctgaccctgcaatcaaaattgccagctctagaggaaggaaagtttttagaggagccacaagctgcctcacctcttccatcctggtctcctcataacacagagcccacagtctacagggtatgtagcaggagctatgatctccaaggattctatgtgtgtgcatgagaccaaatggtttctgagctagaatcggggtctctgagttggagtcagcagtgcatgcagacctgactttatgtagctgtgtcccacaggctccaagcttctgtccctctgattgtctaggacccagaaagacttccactaaactcttgtgtgcactttggcttcaaattaatggagagtccagggtatggtatgcccagagagtagaataatggagagtaagtcctggtaggaaatgccagaccatgtgcggctgctttagtttagctatagaggtcactagagaggggatgtataagtgggaagaaaacacaagctgttattttgtcttctcacatttggaactagatgagaggcacccagagggcacgcacactagagaagagaaagaccttatggatgcatgtgattctgtaatagacctgccatcaaaaaagcttatagagctgtatacaacctgtgggttttccataaggaagcagggatcagatgcacatctgttggaggctgggggagccggcttgcttgaccttaatacacctccctgctgtaggagtcggattcctggcagtgtgttgatgttccctgttagagccgggctgtgggaggggcagttggagccagcggcatgtgtgtggagtgagatgcgaggcagggtccctggctgcaaaggaggtgggattgggggtatgggtgagtgtgggtgctgggggatggacagaagtggaggtcctctctgaagagaaaaacctggacaccaaagggtttaagtcctaatggcctctgactccctgaccctgcctgtccttaggggaagtgctgagggtcccttcctggggaagtcctagagctgagtctcttcccttagtaaaatctactgaaaatcaggatgcccaagactgggggcttgaaaccctgcatattcttcaccgccttgcttgagagctttccattttccctgcccactgaagatggtccaagacatgcagtaccttcttgcttcctgctttacaccccaagaggggattgaattctttatgtatgtgtctgccacctttgctagattgtaagctccctggaattgtgccatagtcatctgaatacttgtagtctttagatatgtatgtgcctggcctggcatgtagctggtactcaacaccctttgggatccaatctgtggctcagggtatggggaagagatgacccagacccctctagattctcccagtcccaaggagaacaattctgttagggtgccttccagcaagacagcaggaaccctcaccacccactggctccagtggtggcccctgggctcctccctctctggcacagggactaaacagagccagctccactggagggagtgccctctcctttctttccaccctttgactctgaaccattgtgtcactctgtcctgaccccatttcctccccggctagccctcagccatctgtgggcagctgtgagactgagtttggtgcctggtgcagctcagaccctggcaccgacctgcttggccataggcatgtcctcttgtttcttcagctgactggtgctttttggggtgcctctacccaggtcttcttgtcttcctgagagttctgaaaccctcttctgtggggtcaaacctggctgcacatttgaatcactttaggggctactgaagcatccagcatccagggactcaccctactgagtcagaacttccagaggagaggtcgggaatgtgtatatttttaaagcttcgcagatgacagttgcggtcactcaaatgtggagtgtgcattagataatattattgttgtcaatgttaagttttgtgggtgtgctcatggcattgtgttttacataggagaatgcccttgctcttagagattcaggctgaagtttttagaggcaaagtgtttcttacaaacactttgcaaagggcatcttacttttaaatggtaaagcagagcaagaaagagagcaaatgtggagaaatgttaacaattattgcaggcaggtggtgaaagaaaactggctgtaacagaccttctggacgatttccatctgttttctaagaggtggacattaggagagaacgcagcctgaaccaccaaggtgtataactccaggaggcaccattcacatggttttcatttttgtggtcgggggtatcattcacatagaatacaatgtgtggggtgccccctagagttgtgtgacatagtggcattggccccagccatctctccctggatgggctgcagagtagcagagacgcaggccctgatctacccttcctctttcaagggaccgacatggctatttgtttttatacagaatccctagtagcccttgaagactaagggaatggagcaatcttaatttaaatttaaatttaatttaatttaatttgagacagggtctctgtcactcagactggagtgcaatggcacgatcacggctcactgtagcctcaaactcccaggtccaaacgatccatccacttaacccttcccagtagctgggactataggtccatgccaccacacccagctaattttttttccccccatagggatggtcttgaaccctgggctcaagcaatccccccgcctcggcttcccaaagtccttgggattacagacatgagccaccacgcctggccctagagcaatttctaatgtagagcctgacagagagagaactgaattggggaagtggggaggcaggaaacatgaaaccctgattcctaaaatactttctgcgtgtcctctagtcctggaaaatgaaatctagggcttgaatttttagaggaagccaggtcgctgtgtttcaaggtcgctgggactggttgctcctgtgtttccatctctggagttccctcgtgtctggctgctgctctctgaaccttcgcttcaccttgggggtggccttcttggtcctgtgggggatgctgtttgtcccatttcctcactgccacctctcagcatcatagtgagctgagtgctgagcctttgggaggagcattgccagtgtggccctgggcgtgagatctgtcagaggggtgggcttccttccctgtgtggctgagacagtctagtggtggcctggcccagagccaggaggatggtggttagagaggggtagctcgcctttcctctgtctgaattccagtctgggaagagcttcaggaacagtgcctgcttggatcaccctgggacctttccttctctttcctgtgactttggagtcctctgagagatttgacctaaggaatcagtaggttggaatcaaggaatcccagagctggaagggactgtgtgtggttttcttgccatccttgcccctgccttacagatgccaatccaacctggttagttccaaaacccagtcctgtgtctgaaggatactaaggagcacaccacctacatcctgaccacccatctccatgtctgaaaattccccacctcccagaaggttctgccctgacattccagttcaagctcagtggaaatgatgggaatttggaacttgaggaacatagtaggggtgatggatccataaacatgtcaattttgaataaaatatcttaagcctgtgtttgagatatacactggttgctattgggagccaatagcaaatagcaaattggaacaatttgaaccaagtcacggaggtatcacatacgtggtcatgaatggttggaggtgagagggagagcagggcaggagagagtcttatagagaaatcagagagcctttgaaatatcttaggcaggaagcgaggtgatcagatttacattttaggaagagccctcaggatgttctgtgaaaaagccttgaagaggccaaggttagtagggggaaggactattaggaggccattgtaatagcccaaatgagagaagataagggcttgaattagggcaaccacagttaggatagaaggaaagattagctttgggaagtattaaggaggaaaaggtggcaggccttggcaattagagagaggggtgaaaggaagggggactctaggatgactgcaggatttttagcttgggggactgggtggtgccattcaccacaatggggaaccaggagcaaggagcagattgtggggaggaaagaagatgatagttgagttttggacatttggattttgagatatgagtgggcatgtaaacttgaaggagagatacatatttggaatcatcaacatgtgagtagtatggataggaaacaagaatagatgagattgcccaagcagagggggtagagttaacagtaagctgagaatagaatcctgagccaacaccaacatttcaggggtggacaaaggaagaggaagacaaagaaggaggagatggagaacaagaaaaaaatatcttcatgaaagccagcgggagagggtttaaggaagaagggaatggtttggagagccaaatacagcagcaatgtccaggcaggtggaaatggctacggaaatgggcagcccaggcattgttgctggagcagttttagtgggatgtggggggcagacaccagattacaatgagttaaagagtaaatgggaagggagaatttggaaacatcaggtgtagtccattctctggaagcttggctgagaatggaaggatgaacagagaggacaaaaagtcaaggggagccgggcacggtggctcacgcctgtaatcccagcactttggggggccgaggcgggcggatcacctgaggtcgggagttcgcgactagcctgaccaacatgatgaaactctgtctctactaaaaatacaaaattagctgcgcgtggtggcgcatgcctgcaatcccaactactcgggaggctgaggcaggagaatcgcttgaacccgggaggcggagcttgcggtgagccgagatcgcgccattgcactccagcttgggcagcaagagcgaaactccatctcaaaaaaaaaaaaaaaaaaaaagtcaaggggaggtgtttagggttcggagtttttcctttcttgttaagattaggtgaagcatgtttatgtgctgaagagaaaaaccatgttaaggagaagagattgaagatacaggagagggaagggaaatccatggagcattatcctagagatgaagtggatggggcaagagcagaagaggattgtgcctcagcaggaggcaggaatctgcttcccctgggccaaaaggaagaaagtgaagctgagtgcaagtatgcataagtgggtgttggaagagaggcttgaagttgaaaaagattatttccaatggcctgaattttccttctcacaatagtgcctgctaaggcaaatcttaatactctgcttgtcctagctcagcgctgaaaatacacagtcattctctggattaacatacttaagcccaatccaactttgagcatttatctggtatctcctatctataaggcactaggccctccttttcctgggactagtctcccagctccaggcagctaggttctggatatctccatctgcttatgctactcctttgaatttcaaatagcaagactccctcatacccactgtggataaaaagtgatctgtaaggagctgtggaaaggcagagaaattaagttaacagtgaactgctttagatactctgaggctgggcttgggccggtctgtccttggtgaactaattcctaagtgcaatagttgtcagattcactgagccagaacccttcagaccagggtcctgtgcctatacctgacagatgtaccagggtcctgggagggcaccccagggtaagggatacctttgacctaacttattttgaatctaagcaacttgccacccaagagtctatctgagcctttttcctattgatgttttcaacattctaatcatgaggtgtaatttcatgtttgttacctgttgggtgaagcagtacaatagaatgaacattttctgataatttttatgaaactgtcaacctcttggctgctgatgctaagagtcagaagtgactacttcacactggtctcccccaacctaatcacaaacacacattcatagatccacagttctgaggttgggctacacattagaatctcctggggagtttttaaaaaataccattaccctaccacagagcaattaaatcagaatctcttgagagtattcaggcttcagtactttgttttttttagacagagttttggtcttgttgcccaagctggagtgaaatgatgcactctcagctcactgcaacctccgcctcccgggttcaagtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccggccgggcttcggtactttttaaaacttcccccagtcgggccgggtgcggtggctcacgcctgtaatcccagaactttgggaggccgagctgggtggatcacgaggtcaggagatcaagaccatcctggctaacacggtgaaaccccatctctactaaaaatacaacaaattagccgggtgtggtggcggctgcctgtagtcccagctactcgggaggctgaggcaggagaatggcatgaacctgggaggtggagcttgcagtgagccgagatcctgccactgcactccagcctgggcgacagagtgagactccgtctcaaaaaaaaaaaaaaaagttcccccagtgttgctaatgttgcagctggggttgagaaccactgggccagactgaccttgtcgttaccaccatttgttgaatgcttctcaactctgttcacgtcatggcttctagagaaaaggataccaccgctgaagtaagtggaagcactggcctggagatccagtgtggcttcctgagggctgggggaaaaaaaaatcaatattttggcacacctgtaagacatcaggtagccgggtctcacctgttggcaagctttgttttattttatatattggtgtattttgggaggatcctagtgcaagctgagtaattacaaggtccgtttcacagggttctcttgtacttttcatttatagttttattgaggtgtaattgacatataataaaatacacagattgaaagtgtgtaatttgataagttttgacatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatgaccacaatcaagataatgaacatattcatcacctccaaaggttcccttgtgtcccgttgtaatccacccctctttccactctgtcccccagataccgctgatctgctttctgtcattatagatcagtttgcattttccagaattttatataaatggaatcatatgtactcatactgttttgtctggcatcttttactcagcaaagctattttaagattagccttgttattgcatttgtcaataattcattcctttttattgccaagtagtattcaattgtatagacatcacatttttaaaaatccattcactgttgatggacattttgggatattacaaataaagctgctgtggatattcatgaacaagtctttgtgtagacatacgcttttattttccttggataagtaggagtgatagttgaatcctgtgttaggtgtatgttgacctttttaagaacctgcctgttttccaaagtggttgtaccattttacattccccaccagtagtgtatgagagctgtcctcttcaaattgactggagaagctttgcttccatctcttcttcttggctaatagaaggtgcctcttggctgggcgtggtagctcacgcctgtaatcccaacactttgggaggcctaggcgggtggatcacctgaggtcaagagttcgaaaccagcctggccaacatgacaaaaccctgtctctactaaaaatacaaaaattagccgggcgcagtggtgggcgcctgtaatcccagctactagggaggctgaggcaggagaatcacttgaacctgggaggtggaggttgcagtgagccgagatcgcaccattgcattccagcctgggtgacacagcgagactccatctcaaaaaaaaaaaaaaaaaggtgcctctctctctttttggggcacaaatgacagaggtgagtatagggattagggcgcagagatgaggcatgtagagatgaatggatggatagttggatataataaataggtaaagttgtcttggtatcccttttttcctccatcttcctgtacattccattagttgtacacaacgaagaagcaggcactggcccagataatatcacctaaattggattattatggatgattagtaaatctctctttgtgactgattgatatttttacccctcacctgcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactatccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccaggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgaggaccttcttgtgtttcttctgccttcctttctccatgtccttcagaaacagggactagtctctgctgttctacatccaactctgccaagtccttacccctttaggcctctcctaccctctttgggaccctggccctggtgggggaggtccaggggaggcttgattaggggtggacaccagtagagggagggctccttctcagggccaggtttcatgtatcttggccaaaacggcccttctggggcaggcatttgggaatcctggttcctagcgtgtgcctgcttcctgatgtaaggactgaattgggagttatgggattcattattgactggctgaatggccctctggaccggagcaagttgcttccgcttgctctgaggccctgctctgccaaaaacgctgcgtggcgatgaagatcattcacaatagtaaccacttgtttagtgcccactgaatgccagaccctggtccagatctccacaacaacccttcctgatagtccaaagccacacagcaagcaatagcagggccagcattcagccctggcctctctcgttcctaagccttctctctcctcctctccttctccctttctctctctctctctccctgctctgttctttattgtgataaaatatacgtaacgtaaaattcgccaccgtaaccatttggaagtgtgcagtcagtggcactgacgacattcacattgtcgtgcaacccttgcattattcatctctactcattctcttctcacaatgaaaatatttagaaaaaatatgcagtatgacaaatagttttatttttatcagtacatagtgtaaaatagcgaactatctaggtcaaagcccccaggcaggtgccagggcagctctgatcttttttctggtttaggggagcttcagcagcatctcctgggtaggaccagaaggcctatttgtgtttcatccttggtccctggaaaccctggctgcaaggagtcaagagacaagtgacacccccatggctgatgccttcttttttttttttttttttttttttttgagacggagtctcgctctgtcaccaggctttagtgcagtggcgctatcttggctcactgcagcctctgcctcccgggttcaagagattctcctgcctcagcctcccaagtagctgggattacaggcacctgccaccatgcccagctaatttttgtatttttagtagagacggggtttcaccacattggccaggctggtcttgaactcctgacctcaggtgatctgtccactttggcctcccaaagttctgggattacaggtgtaagccaatgcccctggctgctgatgccttctgtgacagcttagcattctacttcattccgtcctggtttcctccttagccattgtttaaggggcactggggttttcccaccttgtgtctagcctttgggaaccttcccaactctgaagagctacacagttcttccttcctccgcttctgctaagagagtccccccaaaagcagaatcagctcctgggataagccacatccctagagctcagggatttttaaaggccctgctctgagaggtggggctgttcccgctatttatagggactgggagattcctgttcccagctctgagttcctcacacccagctgggcctgctcactgagtcagggcaccctggtaggtggtcacctctgtcactccttctctctcctgcctcccctactccctcacccttccccatcccctgcatgtcatcagagttctgagacagagctcagcccagaatctccttgaagaagcggacacaaagcaaaaagctcttgccagttctgagtggggaaatgcggccttggtcctccccggctcagcttgttgcaggggctcagcctgctgggaggggggaccccttgggccctcggcctataccaccgccccgctttcgtcgggcttccagccagagggaacctccttatcccaggccagcggagccagctctggaactggctggctccaaatgccagcctgatacccctgctgccagcctctgcccggcagactcccccagccagcatcgggtgatgccaccagggcctgccagctgggcaaacgtaagtggcttttgttttcttatggtgccagtgagtggtacagaaaggacatgagagtggccttcagtgaccactctgttctctccctctcttgccttctcttccctccccccactgtctctctctctttctctttttcttcctctctctctcctttctcttgtgggttaattgctgacagtggtgctattgttttgactgggacacaggcacgaacttggcagagccagggcctcacatgccaactgtccccactgctgccctcccctctgtgcacccccaccccccgccgcccatgcacacccaggggagcaagcctaacaagagagggtcaaccagaggaaacagtctggatattcaaatgaggagctcagttgctgtcatctgccccaagaggcagagaggacttgagagtagccaagaggttgggtgagagatgtgaggcgttgctatgtgcacaggccggagctagactccccccagaaacagctgttggaaccacatgccggccttatctccatctgagctgaagcctcgtccctggtgtggcctcccaggctgccctgagcagacccctcaggcagaaacctgtcatgcaccagctctccctccccctcacttccttctccctagggctgggctacaggccttgctaggggcttctttaggaaccctcctgggtgactgaaagcagctctgggatgggagaccgtttgggaccttgtctgagaatcctaccaccacacacgtattttgagagaggaagtggggccaaggcaggctccctgacattccggccgttcagagccggctgactcggaagccagaggagccaagcttctaccaggtcctcccctgcccagaccactgctttgacgctttcttcctcaaatagcatttacccagaaggcacatgtgtctgagtcatctcctctatctaagggttctgggtctctctctgctttgggtccatggggcttgtggatattgaggctttagaccagggccaagcttccctgggcaccatttgggccgcccacctgctctagcctcagtagaggggctgggaaaaacagctgtctgctctgctccctgtcacgcctctgggagaatcccccggaaagcccgtgttgcaggagaggcccaacagcactggattgccttactggctgcctcacgcttatcagactgtcccctcctgaagtggctttggccacactcttgtccatctcagccagagcttcgcctccttcttcaacttggctcctggtctcctaggacagcagatacatgtattcccggatgtcccatatgttcttgtgcccctttcattggatgtcgagtgactagaaagtcttttcatctagagtttgagtttaggtctggagtacctcatagggaggggacaccacgaggaaaaaggcactgagtcgtctgctcttctcttaaaggtgggctcccggccccacactgttgccaatggccatgagttgtttgaggtctcagaagagagagatgaggaggttgctgcattttgccacatgctggatatgtaagagttaaagaatggggtgggatttgggagggctatgggggatggggaggggggccatccatttccgaactttctttaggagggaagaagcaccataataagtaaatctcagttcatagctatgaaaatgcttcctacaacaagtgtctgcagggtttttgaaatcttagaagtctcacatttttagcaaaattcatgaaacctccattgaatggtcaaagtatcctgatcactctagagtctgaccctcagttgcccttaagagcaaatgcaccccagctggcgataagagtgttatctggaactaaaagagaaaggaaatggattcataaaaaattttccattaaacttagcatggaaagctttgtcattttagaactatttgtactgttcaatggtgggaaacattttgcaattataagagaagtgtcaagaagggggtttctcagagctgctaccccactgcccccatcctggcctgcaaatttggagggctgggctgagtggggacagaggggctcttgagcctcagagcatgaggttcccaacagatgtcttcttgactactctcttctaaaggcacagtgagggttttttttcttcctgtacagccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgtaagttagtgaggggggagaggatgtgagcatcccttgaagtggggtggggatgactgtgttttggactcgatttccacctcatcttgtggcccagatgaagggcagtgaggatgctcctttgggggtgaggggctggctatggggccagcattctagtacagtcactttcctcaactctgaactacttgcctgctttatctggttggtgatggtgctggagaatacttagctggaaagggggatcagggtggggaaactgagacccatctgccttgacatccatcatgattgctccccctaccttacccttcacaggttcctccactgtagacttgcttatctaccagaccctgtgctacacccatgatgacctgaggaatgtggacgtgggtgactttgtgctaaagccctgcgggctggaggagttcctgcagaagtgagtgaatgggtgggaggtagcccctgccttcctggtagtaagagtgtgagggggcttcatgggattggtgctgggaccggcctggcagctccgccccaatcccacagtcaagactcctgctttctgggcacactctcggccacgtagcactttccccaggagctctgtcttccagcagggttggctgacgtcctgagccaagtctgctgtggaaagagcttggagctgggattaggcaaagactaggtcatatctgcttgcagattctgcttatggagagatgtgtgtatttgtggggaggggtgggcttggggagactatatgggtagtgctgtatctcctgctctagattatgtgtggtgtttttatggctggggcaaaatgaggactgggcagaagttcccttgtggagcccaggggagaaattacaattactgtctctccccattctcctgccaacaagtcttttccccagctggcccgtgcagctagttatcctcctcccaaaggcgtgcctccagctcctctccatccagtgccctctctggaaagcagcctccctggaaagtctgatgtggaccagctgaggcaaccccctttccactaccctgggctctggagggctgcagtggaagagaggcaggggcaaggttatcacttctcagatggtacagctgtgtgacagcagacagataagatctgctttcctctcttaggcttcagagccgctcctgcccccagtctctgtccacttggaggaagcacgttttgggaatagagaaaggagagacctgtgtctcacttcttaggagtgccctataagtgccactgcttgctttttctctctcttacattcaggtctagatgcaaggatggttgatctatgtctagagcataagatttggcagtcaggatggaagattcatttctggacttctttctttttttgagacagagtctcactctgtcgtgcaggctggagtgctgtggcgccatctcactcagctcactgcaacctccgtctcccaggctcaagcgattctcatgcctcagcctcctgagtggctgggattacaggcataagcaccaccacgcccggctaatttttgtattttttaatagagactgggtttcaccatgttggccaggctggtctcgaactcctgacctcgggtgatctgcccgccttggcctcccaaagtgctgggattacaggtgtgagccactgtgcccagctatctgggcttatttcaaatttaaggatattgtggggtcctttctggcctctgcctcctcatctcgaagctaagggaaaggaaagaggcagggttctgtatggtacaactccagggtacccttcaaatgtgccccacctttaaactcacttatgtacacacttttcccctagaggaacaggaggggtcctagactcagggttgcctggcagagagagtgccaggtggcctgccactgttagaagggaaaaaggggacatagtggataagttggagctcctgctgacgccattacacaggtttgaattcggacttgccacttactagttgtgaaggctgattgatgctcagggccctctgtaagctgcagtgagggtgaaatgtgagaatgacctgtgagcaatcagtaaataccagcagggaaggagcagcccacggagagaagtcctagggctctgggctgcacagatactgccatttcccttgcagcaccccaaatcctggagcccctgggtccggaggtagtgggagctgtcaagttctaccttcctgctaagactcaggtgaaatattcttagtgaggtgggacagggtcagcggtcctcagatcacacccctcatactctcacttgaatgcacagagaggaaggccttccacagagaagatcaagcaagtccccaggggacctgtgtgcatgactcctggcctaggagccccactcccacccaacagaaaagcacaatgctgtctcctggcccagcccccagacccccaacacatgacaactgcctgggatgggggtggaaaggacgctccgggggttccagaaatctgctagttcccaaggaagccctgagattttctacccctgcctggcaggaggggctgatactgagggggtgagtgggttcaggatgcaggctgctctcagataagaaccttgaggcagtcccgtgggagggttgggtttcctgccacctcccccagccccaccacactcttccttcctcccaggctctcccaccaggcccagccccacagcccagcctcaccacctccaggttttggctgcacttcagtcttagatctgagagggtctagatcggagatttggtcctctcaggatgtggagaacccctcactcgagccctcatgggacctagacgaccctgggccctgcacctccgccagcttttacatatactgccccccttatgctcctgtcctctcctctccatttctggcctagattcccagctctgctgaggaaggaagtccttttccggcttctgttacccagctgctgaggccaggcccaggcctgcagtgctggcctggaggtagttctccctctgcccctcctcttgggtttccttgctgttgaaggtgtgatttgggagagaggaagaggttggatcgccgagggctcctaggccttatctctgaaagggggagtctcacacatgggtgcttgagcaggtgggactggcatgcatttgggacttttcaagaagtcatagaaatttgtaaggttattcacaagcaggcagggccaacagatggaaggcagaaaaagaagttgggtggggacactgatctggaggcttggtaggcttgccccaagtttttttggcctcagcaccctagttggtagcattggaagaggggtctctcgctgagctcccaccctggagcctgagcacaggcggactccaacatgtctcttcctggttgtcccctatacagaggcccagaagatagggcttcagcaactgctccctgtgatgtgcctctgtttccccgctctctccaacagttcccagccctggagtgaaccagtgattaccacacgggtaataaatatctaagagagtcaatatttataccggccaaggattaagtatattaggtggcttttgtttagatagacctctgttccttctcctaagctctaccgtgtcattttctaggagccaaagtagggtacaacacgggtactacccccttacctaaaccttctttctgtatgtctctccccaaggctaaggtatgtatctcccttcccactgagtccccaggatgctaatggtcttgtccctctaccctaccagcaagcatgccttgggcagtcatgagtacatccaatactgccgcaagtttgacattgacattcggctacagctgatggagcagaaggttgtgcgcagtgacctggcccggacggttcgtgtgagggtggtggagggttgcccagggctggggaggtggaatgggaatacaatatagaacacatcaggtgggaggggggtaggagtgctgagctgagataagggcaccgcccctctctgaataggtcacttcttatacaggtgaatgatgaccagagcccctccaccttgaactacctcgtccatctccaagagaggcctgtcaagcagaccatcagcaggtgagtgtgggcaccatcttggatgtgctccaaacaagaactgtgcagggatcccatcagatgtgcctgcttgcctttctgtcagggctaagggattcttgcaggtgtcaggggttggggcccacacatcttatcagagaagatccccactccaggcatgtttcatctcttccctctggaactttgccatcattctctccaggcgagaagtggcagaatagaaagactctccctccttcagtcttcacaggacatatagaaagagtgggaactcctttaaatcagagtgtgagctgaggagagggagggagaaaatgggtttcccagggcactgggtctttcatgacctctcctgtggtttttccctgcccccaactcccaggcaggccctgagtcttctgttcgacacttaccacaatgaggtggatgccttcctgctggctgatgtgagtacgaatccaggggctggccctgctgcccgaaagctcctcctctccccttcctcagtcctcctgggatcacccagcactatgaggggtctgggtggagcctgaaaatctgttggcagagcacttctttttaacccctcgctcatgggcaaactaagactactagatgttgggcaacggcaagtgcgtagtcagggattctgctcctctatagaagaagcaggtcggaaactgcatgctggtcccattctctggaataggatgtctccagagctaaggaacctagagctgtcaccccccagctgctgcacttgatgtacactggagcatgcatcctatgagcaatgtcagaaacctccagtttgagaggttctgttttgctgttatcgcaggtaggaaaccatcaggaggtagaaggtttcacatgtagggagggccagagccctccccacttggattcatgcggagtctcaagcctcaaaaccatgagagtcaacatttgtcttaaatgtcacaacgccaaagaaaatctgacagtgatcttcaaaaacaatcccttgctgagtgtgatggcccacgcctgtaatcctaaccctttgggaaactgaggtgggagaattgcttgaaccccaaagttcaaggccagcctgggcaacacagcaagaccccatctctacaaaaaatacaaaagttagccaggtatggtggcacacacctgtagccccagctactctggaggctgaggtgggaggatcgcttgagcccaggagtttggggctgtagtgagctatgatcacaccattgcactccagcctgcgtgacagagtgagaccctatctcaaaaaacaaaacaaaaaccaatccctgtctcattgatccagttaatagtagtcataaacgcttcctttttgaggggttcagcattatgtctagtcactgccagaatcccttctccagcagcctgtgcttgaacatttccagtgatgcgggggaagctctctgaacacctgtgctgtgctggtctggccctttgctagtggctacgatgggtagagaagtgtaagaattgtcatagccttggccaggtgcggtggctcacgcctgtaatcccagcactttgggaggctgaggtgggcgggtcacctgaggtcaggagttcgagaccagcctggccaacatggtgaagccccatctctactaaaaatacaaaaattaactgggtgtggttgcaggcgcctgtaatcccagctattcaggaggctgaagcaagagaattgcttgaacccgggaggcagaggttgcagtgagccgagatcgcgccattgcactctagcctgggtgacagagcaagactccgtctcaaaaaaaaaaaaaaaaattgtcgtagcctttggggagcttgtgttcttgttagaaaaattgaatagtaacacaaagctattagtagacagaacaggatggtaataaattaattaagggctcctggaggatgctagaggaaggggattggccagggagggctttatgcaggaggtagaattttagctgctctgtgatttaaatgtacataggtaatcagagctggacaggtgagggaattccaggagcataattccagaggggaggttatggctgtggcatgtctgtagaaatgagatgagatctgtctggaaattctacaggtctctgggagagaccctgtatatatgtgtatagtataagtagactaactatagagagaggctagagataggaggagcttcaaggggaacggctgaaagaattggggcatgtgggcatggcccattgaattcagtgggagagattatttgctgatgatgaatatttgaaaataaaatgtattgcacatttacccctgaggatcatgaatctctctactcttcccaaccctttcctttaaagactggggtggggaggggttggagaccaagagcatgagagcagagcctgccagcctcactgtgccacctcccacagggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggtaaaggggcccagggtgctagcaggggaaaggaagagagggatactgtcaggtaactgagttgcctgttgctagagtgtgtaggtgttcactcactaaaaaggggcttctctccacctccatcttttatgtttaaggaattcaaccgcaagagctcttcagaaatggatgccaagtgtgtctcctcttcctgaggttgagggagagctacctgggactgcttgttgagagcccaggccagtaaaggctttattcacagtcaccaaggcattgcctgacagtctgcatatccatcagggtgcaaaaacaaaccaggaggaaaatctctctagagccaggggctccaggactccagcaggggctgtgtgctctgcagacagggccagcaccataggcactgtgatctgcagccgagtagcctgagggttgggatatctcagaagggtggacccgatgattgctatcctccgtcagctcactctgtccatcatacagatctggtacaaaccattactctctcctctctggggattctcagctactcacatttcagcccattctggtccagatgagcgcagctgtgaaaagcccttcttccagctgtgacgaaaaaggctatggccctgaagctcccctccctcttctttttcccaacaggatcccagtgtcttggctgtgagggaaaaccgaggtaagggaactgctctccatcttcatccagtcgggctgccgaaaactgcagtctctgccccgattcctttttctgcctgggccccttgatttatgtgtcggagttcggctgggggtgtgtgtgtgtgtgtgtgtgtgtgtgtgtgtgtgtgtgtgttcctatatgaggtgtggatacagctggagagcacatttctttccacaaagtgttttcttattatttttcctagtcattcctcctggtgtccctgggagatgatgatgagggggtagaagtgtgggagtggggtggtggggcagcactagccctgtgatccagatgggaagcctcccacttgggtagattgtgattattctcccaacagctcacacttgctacctttccgatttagagtgggccttgggagaggatgagaaagaattttccctacgatttttctaggattcccctgttgtgcccttcaagctgaactttgccctaagactgacctatatccctgggattcctttgttttggttttgttttttgttttggcatccctgggattcttatggtgattcccagtcttttggatttcatagaccagtaaaatgtcccccaaagtatttgggggaccaagagagaattggcagccttttacttggccaaacttttttgacttttgcttttttgaagcaactgacaataattattaacgctgtttcctaaaagaaaggacattttaatactaagtagcaatacgtaaaaataaggattatgtttaacattgtataactgtcattttatgaaaagctcatgacatgcttctgcttttttctcattttaccgcagatgggtgaactttgtcacagctattagagactgactagcatttggggaccactgtcttaggccatcccattctagccaatgccatggcaacaaggtagggcttgtggaggcctcatgactttcccttctgaccccttcccttcccagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccaggtgagcccagggctgagtagccgctagggagcaagctgagtttgacctccaccagggctttttcctatctgcatgtaataccactgtcctaagtcttaggatgtgtggcattgtgtgacattgtggtgcaatggggctgcgggggtgagccaagtgcctgaggaggacttgggctggggacatcctagaggagagaggaggtcccttaggagatgaagaagatcctgttattccctcttggtgctggctgcctctgcatccctgccccctccagatccaagaccagtggaaggagacatggcaacagatggccgattcccagatagagtgcacgctccctggccagtgggagggggtggggaggtgggattgaccctttgtctggggttctctaggcctgcaggggtgggtggaggaggatgttcttttggtaaaatcctcagcgcctctgttgggtccccagcatccaaggcctgagggaataggcactgggccctaccccgcccctgccggtcccctttccccaacccccttccccttctctctttgttcctcacttaatgtattcctctgggcgattggcagagaacaaaggaggcagcctgggaaaccggggccttctctgacctcttctgtcaggcacctgtcatgagccacagggacccccgtgtgttggcattcatgtcggcatatgtcgtcttcctcccccacccttctcacttgcgcatgcacgtgcacgcgcacacacgcatgcacacacagacgctccatgggctggagctttctataaagaggctgggtggccagttcccattaaaggaagaaaaacaacaaggctcagaatggagcctaaaaccgagcagaggaatctagattgagttgctttggcctgagcacatttccttacatccagtttggctgtcctatccggagatcctgtgttacagccctcagagactgagagttttaccaggggaaatggattttggccttagagggacgcataggtttgggtgattggttttgggagctgggtgtcctgacctgctccctttcttttatagctatgaagatttctacctctcctgctccctcagccatggcggcaaggagctgtgcagccccctgcagacccgaagagctcacttctccaagtacctcttccacctcatcgtctgggaccagcagtaagcccttcccccaggcttcagtgcccaggccactgtagacctgctcagcctctgaaatatccctggggccagataactagtccaggactaatgataaaaccaggctccttgttaaccctaactggacaagtcattcaacctcttgagtctccacttccctgactctttttttttttttttttttgagaggcagcctcgctttgttgcccaagctggagtgcagtggtgcgatctcggctcactgcaagctctgcctcctgggttcacgccattcttctgtctcagcctcccgagtagctgggactacaggcgcccgccaccacgcccagctaattttttgtctttttagcagagatggggtttccatgtgttagctaggatagtctcgatctcctgacctcgtgatctgcccgcctcggcctcccagagtgctgggattacaggcgtgagccaccacgnnnnnnnnnnnnnnnnnnnncgtgagccaccacgcctggcctccacttccctgactcttaaaggagccaagtataattaccacttctcaagttgtcatgaggatccaatgagaagtatctataaaggctctttgtaaaccataaaaaacatataaattttagttgttgaccaggcgcggtggcttatgcttgtaatcccagcgctttgggaggccgaggcgggcggatcacctgaggcagggagttcaagaccagcctgaccaacatggagaaacctcgtctctactaaaaaaaatacaaaatagccgggcatggtggcgcatgcctgtaatcccagctactagggaggctgaggcaggagaatcgcttgaacccgggaggtggaggttgtagtgagctgagatcgtgccattgcactccagcctgggcaacaagagcgaaattctgtctcaaaaaaaaaaaaaattaaatgttagttgttaattttaataatactttattttttgatcttgtctcccttaaagagtttaactagttggagggcttctcatcctctcccttcttccctcagttcctgtagactatggagaggagactgtgcttttccctttatatatagagaagggagggttgtctagagaaagaatattgagcttggattcccaggagtgagcctctatttctagctctgtctcgaatactactttctctctattctttctgtgcctcattttttcaaactgagaaatggggacattggtttcactcagaggcagttatggcgtcgagatgagataggtgggttataaatataaatatgaaaccaaaagcacaaggtagtattaatcaccacatgtaaacaataatttggtgtcgggaaggtaggcgtcagccaagcaaagcaggaaggaaacggaggagagggtgccttgcttgaatgggggcaccgcaggggttttcctgccctgtgcttcatctgtgctatgctctaccttccttccagtcagtcagaaaatcccctgtttgctgcccccggctttgcttccccacactgactatattagagtcctcatttgcagagcagcactgcaagctaagtatttgtagcacagattaaagagactgaggagggtcctggggaggccgaggatgcaaaataggtagatgaagaatctggagatgctggaagaggtgggtccttttacagatggacaactgggaaaatggaccctttctcatgcccttcacacttaggtaattcttagagcaataaaggtgtatatggctgggcacgatggctcacacctgtagtctcaccgtactttgggaggacaaggcgggataatcacttgagatcaggaatttgagaccagcctgggcaacacaaagaggccttatctctactaaaaaattattttaaatgagctgagtgtggtggcgtgcatctgtagtcctagctacttaagaggctgaggtgggagagtcacttgagcctgggaggtcgaggctgcagtgagccatgatcacaccactgcactctagcctgggcaacagagtgagaccctatcttaaaaaaaaaaaaaaaaaaaaaaggacatggggtgtgcattaaaggtccttaagcaaacaactgccaggacaggagaaactccttgcaggcagaggatagctgcattaaatggcccttgagttccaccattcccttgggattttttggtcacaattactgctgctgtcaagagaaggggtgccagcctgggcaacaagggagacccaatctctacaaaaaatacaaaaaattagccaagtgtggtggcatacacctgtggtcccagctacttaggaggctgaggtgggagaatcacttgagcctgggaggtcaaggctgcagtgagtatccagcctcggcaacagagcgagaccctgtctcaaaaaaaaaaaaaaaaaaaaaaaaaaaagggtgctgcacagtgttctggcccaggaggaactttaaaaaattggccttaaaccctttactcatacagtatcagaggtagagaggcagcccagcctgccccatgagtttcattttgttccctgagatccccaccttgaattttaaaggggcagtcccctgcctagcgccttgtgaagggcactatcttgcactgtccatccagaagccccgaatgagacttcttggcccttcatggtcaagaccaggacatttgggggaaggcgtgccagcgttcagaggacagtctttgggccagtcattctctccttcctactgtagttgcagcctggggcaggtctttcaacctagaatggtagcgataatagggcctaccctacaggattgtttgaggagcagttaggacactgtaaataaagtacttggcacaggcttcttagctggggagccctcttggttttggtttctctgttccaagtgactgacagactggctgatacatggggatacgtgcgcatgaaaatactatctgtataagccagtgccagtgcagtaaccacagcatcacatagcaaaaagtacacagtctgcacacacatcatgcaagtgaagctatgttccccttttccctgatgagaaactgaggcacagagatgggaattaagttgcccaggattgtgagtggcagaaccaggactggagccaaccagcacattccaggaatccttcctggaggaggcagcctgtgtgatatgatgttgttgaatgggctgcaggaaggagaggggtttctcagggaggaaggtaagggctgcagccaacataatggttatcctgaccagccctgggtgaagatctgtgggagaggttgtggaataccagatatacccaaggactgaagggaagagggccttggctggctctggtttcactcataaagtcttctcactccccttttccttaagacacgaagctggaagcttcttccttgggtgaaaagaaagggctcaggaccagctccctctcccctttgctatggggtcagctgattctctgccccactgtagcggtccagggatcagctaactctcaaaataggctcagcagccgtgctttgtcacctccagccaagccctggcctggcatgtctgctggctgctggaggggccctaattatagctgtgggcccccagggtagaggcagctgggacagagcagggctctgccagtctgtggtgggctggagggagtgcctcacttaggtggagattcctctggaggacagcggtggaggcaggctgctttatcatgaaactgccaaccttgggggtggccgccctgcctctgcgctctctggcatagaagttgctgggccctgggctggccaggagggtgtgacagtatggactttggcccagggacagcttccccgaaaggtaacgtgggtcctccctgcctttccacagctcccctcccctgtgtacttcaccccacccagcagttccttatcctgagcttagagggagtggctaggtgtgattcagactgagggacctggagagaacttatgggcttgaatagtggtggggcttatgtgtctcagttctcttggccctgccattggctttctcaccactggggtacttggagaaacccctcctctttgtccctttggctttgaagctgtttgggggtgggggtgagaaaaacccagtgtgtgtccctggggctaggtgaaggggactcctatgaggacaagtgagagggctgtgggggagggtgaaccgagggcagagaacatggtgcttcttcctggtggctctcagcagcaagaagtgggggagggatggagactgtcaaatggaaaaggaggacaaaaggagtagctttgcggaccctctgcggaaatcctaaaacaaggaaaggagcaaggctgacaacatgggacgtgtcatcacctgaactccgaggtggctctgctaagcaagttctgtccaggcaccacgggtagcttcaaaatcgggatgttcgcctcactctactgcaaagctccaaggacaccacattgtgcttctgggaacatccagtgggggttttgcctagtttgggacctctcctggttctgcaggaggagggcttcctcagggagtatgtctgaaccctgagagggaggctgtatcctcagcctcagcctcagcctgacttcctgggccacctgttgcttgaagccacaggagtggcccctcctaatttgacttcctgtcctccataggatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcagtatgtgagccccagggtacagcttcttggccttggaaagggaggagggggacagagaaaggggcctggctgctgcactggccagtgcaccttgggagagttggccatgtggggctcactggtgaagtccagaggatccccaagcacagaactggtgaccaggactattgatgtaaccaagagccactgagcggttctggtggcacaggaccatgttaaggatacatggaaaagcaatgcttgggtaatagatcatctggtcttgtcattggaagaaccttagaggtcatctagcccagcctccccacctcatgaaggcatccctgccaccaagtcatccagaccagggtgtggttagctcacaagtcctcttggagggcgtaagcttttacaggacttgggagaaggaagaggctatggtccacggtgagaatgagaggggagttggatgatggcttcaaacagaaaaggcagatttttggattgggggagcagtagaaatattctctgcttagccactttagcagctcttcccactctccctccttcttagggtcctgacctgtggccggaagcttctgggtttgtggccagcaacacaggaaaatcccagcgcccgttggagtgcacctaatttccaccagccagacagtgtcatcctgcaggtgaggctttagcccttccctcccagtcaccagcaagaccattccagtcaactctacatttttctcctggagatttgggctgggacagcaggagagagtgctagaacttcaagcgtgggaggatgatgtgactgaagcaactgagggaatatggttagatgtggattgtgaggtgagctctggggtatccatctcccatctcctggaggttaaattgatttcgtggagcctgaagatggggtctgagaccctctgcattcagggctcagcttctgagtcccttgtattgaatcttcatacgtctaagtctgatcaaacctgacctgtgtcctcttggggcttgaggggacacctttgcccctgccagtgactcagtgctttggcaggatggacctattctccagggagaagaggaggagctggtcacgcccaaggtgcacttctcagttcccagcttccccttcttgtggttatgagatactttggtatggagtatgaatgttgacatagaatgaaagctccctgaggcaggtttttttttttttttttgagacaggatctctgtcacccaggctggaatgcaatggcacaatcttggctcactgcaacctctgcctcccaggcacaaatcatcctcccacttcagcctcccgagtagatgagactacaggcgcacaccaccacgcccggctaatttttgtctgtcttatttgctgctttatgcccagactctagaaaatgcctggcacatgttaggattcaatagatatttgttgaatgaggctgggtgtggtggctcatgcctgcaatcccagcactttgggaggctgaggcagggggatcacttgaggtcaggagtggccaacatggtgataccctgtctctactagaaatacaaaaattagctgggtgtggtggcgggtgcctgtaaatcccaggtactcaggaagctgaggcatgagaaccacttgaaccggggaggcagaggttgcagtgagccgagatcacacccctgcactccagcctgggtgacagagcaagactctgtctcaaaataaataaataaatgaataaataaataagttttttgaatgaaagaaagtagacctcctttggagacttggctcactcagctctgatactttagtaggatgaacatctggtggcatagagtagggaccgagtgtcccagggccttctcccagtgtgtggtcttgcctcccctctggcagcagtgtcctctggcaccccatggaagtcaccccggactcagcctggatgcaccctgtgtttcagctgggtgacacctctgttcagagttctggctggggcttgtcccctcacccctcaccaaggtgcatctccaccgaacctcttcctcacatgtccattctttttctctttttgtttccctctcattttttgctgagagttatagctggaaaggactttagagatcaccaagtctaacagggctattttacaaagaacctgagggaaagtgagggagggacaaggccggaatgctggggtgagagaaagaagctgggagtccacacacgctgcctgttttctctcctcacatccctgatctcatcccccagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggtgagacccgggcccccactgaatctgtcatgtttcatctgacctcccagcactgagtctccgtcctcctgctttgggagtggaggtgggaaggggtgggcattgccatctcagcaggaagtggaggcagcccccaggcctttctccatcagctgacactaggaaaagtggagaggtcaaggtcaggaaattagatctgagaatacccaagtccccaccccagggacttggtccagactcagctacccaggaggaccagagctctgccccacatcccagatgtgctatctactaccttctgtccactggggcagctggccccaccaccctgcccccacctcttgctctcacctcctgccccttccacaccaacagcctttgaatttttctggccctgtcactttccaaaaaggatcaggtgtcaaggcaagctggcagctctcaggggtacgcgagtccaggctgatctcatccttggggctgctgctttcacaggattggagaaggaggggtgagaacagaactggaggagctggagggacctggttctgctgtctgctctctgtttacctctctggctcctgcgcagccctgtgcgtgtgttgtgtgtgtgggggcatgagagagatggggctcatctctgtccctgatgtccaccccaagtagctggagtagctgagcgaccgcagacctcccttcccccactctgccgactacacttcattagaccctcagctcccttctcccattagacacctgatctcaggcaaggcccaattagctgcaggtccttgaaagccgacagctggtccctggaggccccaggaggcctctcagcagcacagaccctggtgttgggggaccactgccctctggtggttctattgagcgtggtgccctcagggcatccgcaggaggggtagcagattcggtgcccttggcccatgcattctccatccaagatgtccctgagttgggatcaaagataggatttgggctctggttcccaaactttgattcatattggaatcacctggtgatctgtggcatagactgatgcctggcttccccagccatttggacttaactggtatcaggtgtgacccaggcatggcgagggggttcactcagcccctcaagtgggtgtcatatgcagcaaagcttgggaaccgctgaattgcagtgtgtgcagcactcccttgagggtaagggctgcaccccctggctgatgctgttctctctcactgccccctaccctcccaccaccttctcctttccgtgtgcccaccaggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccacgtgagttgtaacatctgccttttctgactatgtgttcttgtagaagccagggcacgacactgcccatcagtgatctgagccagccctggggaaaatggtaaagtgggtgtggatattcagggattttccatttctcctttttgctttttctttctcattttcccttcaatgttatattgtcatttttcaaacatacaacaaaattgaaaattgtacagtgaatacccatgtgcctaccacctagattctattgttagcatttgctctgtgtgctggattgtgtacatttcatttatccatcgctgtatccatccatctatccatcttattttttatgctttttttttttttttttgagacagggtcttgctctgtcacccaggctggagtgcagtggcatgcatatggctcactgcagcctcgacctcctgggctcaagcactcctcctgccccagcctccaagtagctggaacaacaagtgcacagtgcacaccaccacacctgactaatttttaaaatttttttgtagagataaagtctcactatgttgcccaggctggtttcaaactcctgggttcaagcaatgctccctccttggcctcccaaaaatgctgggattataggtgtgagctaccatgcccagcctttttatacattttgaagtaaattacagacaccattaaactccctgctttggcatgcacatcattaactagagctcgatgtttgttctgtttttttttttttttcttttggggcaacatttatacataagcaaatacccaaagtttacctgtacattggctgagttttgacaaatgcatacgcctgtgtaactgaaatccttattacttagttttattttaatcattgcccattccctctttctcttgaagggttctcttgggacccaaggcttccagtcttagatctgttagggctgccttttctagatggtacccaggatttcctgcttatttctcgccactctcagtaatcaaaatgtacctatccatgtgacctgccttaaggagtttttgagccaatggttttgttaatctctgctaaactaattctgccaaggtttattggcttatataaaatactgtgattttctgttatttgcgtggtacattttgcattaaaggatgttaacaagacaaaataatgcttttacccacatcagggccctccaatggcaggaatttctggcacagtgggagtcaagggagaaatctttggagtaaggttgaggactttgtcccattttctttaaatcctccaaggagtgagagtggctacctagttgttcccccatggctcaaggcagactctaaccgtgaagaaggctcattcccaagggttgctatccagggaagttgctaaggattcttctagtgactttagcagaatctagggccattgcattttctttctccatgcctctgaagcccaggtgtgagggtgctgggctcacagctgtgcctcaacttgcagctaggttgtcagggcactgggctctgttttgcagcttcccggaccaggaggtgcgtcgtatggctgtgcagtggattggctcactctcagatgctgagctgctagactacctgccccagctggtacaggtgggtggattggtcctccctccagttttgctggtcccatccccagtatcccaagtgagtctgcattctgccccttagaaaccagagatcccagtgcaataataataagtgtaggttacaggcagttaatgaagcttcatattctctttctccctttcttcaaaacaggccctgaagtatgaatgctacctggacagcccgttggtgcgcttcctcctgaaacgagctgtgtctgacttgagagtgactcactacttcttctggtaaaactgcatgtagaaaagtgggaggtagacacgtgtctttcacgtaggagtatttcactcttaggcacgcaagggcaaggaactgagttgtccgggcttcagtatgtgctgacttaccctgtggccttggaccagcatcttttcctcaggggtctcagctcaccccatgtaacatagtgaggattatgttatcctgtctctcctctacccacacatggcagaaatagaaaggagaaacaagatgcagaggggctgtgaactctacttaaagacagagtgagggcacagactggggtatgggcacaggtgagcatctccatatgagccgtacatacagaatgtattttccctcccaagttcggggtgggttttgcagtgagttggagctgggcctgactctgtctccccctgtacccttgcctttgatccctggagtgccctgactcctgactccctctgccttgcaggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcaggttagtggggtgaggctgcccctacccatttctcatccagggctttggcagccagtttcttcttaggaatcctgaacaacaagattccacgtgacgatttttgattttggagcggggagcagctgactctggaaactaggccgtaaacaggcagtccacaagctggatacagcccgtggatgtgttttgtttgtcctgtaaaatattgaaatttatttagctgtttgttttaaaggctaagcacagttgtgtaagttgttcattgcacaagagcactcagccagaaggggcaagtgagggctgaaatccagccatattttgttcaccatgctgtgacccatggctcaggcctgatgccacccagagaggacacctttatctgtttgtacgaagacattgtaaccagccagcagtgttcctggttaacgacatttaaaaactgagagattttgtatcaacgtccagattgttagcttttcttggcagaagcctaaatagctcttcccccttgagagacagcctgccctctctgtgcactgtggcctgcttcatgctgttctgccatctgctcccctctagagctatttggtcttgctgttagcgtacagtcccaggctggggtgtagggggtcctcctccttaaggatcttctggagggtgtccacacttctcagggggtggttttcataccgactactacggagaacccacccctgggagaggtctggttctcagtatggaccctccatttcacccctgctgtactcctccccttctttccagggaatcctccgcacgggcctggaggaggtgaagcagttctttgccctcaatggctcgtgccgcttgccactcagccccagtctgctggttaagggaattgtgcccagggtgagtgactggtaggtttggggctctcagagtgggagggctcagtggaggtgaggtcttcactaaccaggcatgcaaggtcgaggagctgagttgtctgggcgtcagtatgttgctaacttaccatgtggtcttggcctagcatcttttcctcaggggtctcagctcacccccatgcaacatggtgaggattatgttatcctgtctctcctctacccacacatggcagaaatagaaaggagaaacgaggcagaggggctgtgaactctgcttaaagacagaatgagggcacagactggggtatgggcacaggtgagcatctccatataagccataaaataagagagagattaggaagaaaggcatatctgtggcctcttcccattcctaatgtgtatggacttttagaagcctgacagcttgcagggtagaggaattgggttggaggttgggcggctaggcaggtgtctttctctgatgatgttggggatgaagtcggaggtggtggtggtgatagcagctgtcatctgtcatttattgagcactctctgtgcccggccctgttctgagtgcttaatgttggttatggcatttcatcttcacaactcttaggatgttggtactattgggagtccccttttacagaggagtaaactgaggtgtagatgggacatgtgacttaccagaggtcacacaactagtaagttgtgcgcagaatgaactaacaggatgggaggttaagtgctggagctgaggtcataacaaactgaattgggatgatgactatttaacgagagaaggaaggaaattgggtttctgggaaatccggaagaaacaatgagcaggtcttgggtggaccggcagcagcggggaggcagcatcttggtctgaagtggagaggtcgttttcctttcctggcatgggccactctgaccctcgtcactatcttttcaccatggcaggactgttcctacttcaactccaatgctgtccccctcaaactctccttccaaaatgtggatcccctgggtgagaacatccgtgtcatcttcaaggtgagaatactttactcaagcctggtggaccagggtgggagagagaaggaggcagcctagagtggcattaagtagcccctgggtggttctcttcccactgttccatgctgtcttaatgtaggaaagatgatcaggtgaaaaaggatttagacgaattctgcatggccccagaggcctaacaacagagtgttaggtatagggaggcaactggcagctcagtatcccgaagtgctttctaggaggcagagctccctcaacaatgggttgggtaaggtggtgatccgcttgtcccttgggtattcaggcagaggctgaatgccatgtggcagggctgctgaagaggaaattaatatatcaggtgcaggtccaactagatgaaccctaaggtcccttctaactctgatgtatccacaattctgagaagtaaatgatagtctcagagcatataatctaatgggggagacaaaatacatgcatgtgacttagtaacttatatatttgctatgcgcaagttccaaatccaaagtctaaacgttcaagtttaaaaaaggcctgatggcctgggtgtggtgcctcatgcctataatcccagcactttgggaggctgaggcatgcagatcatttgaggtcaggagtttgagaccagcctggccaagatggtgagaccccatctctactaaaaatatatatatatatatatataaattagctgggcgtggtggcaggcacctgtaattccagctacttgggaggctgaggcatgagaatcacttgaacctgggaggcggaggttgcggtgagctgagatcgtgccactgcactccagcctgggtgacaaagtgagacactgtctcaaaaaaaaaaaaaaaaaaggcctgatggtcagaggggctgcatgcagaagcagaccgtgaatttaattcagatggggccatgggattgcaggacaagctggaacaacacatgggcaaactgggaagcttcctgggccatctttgacctggtgtgagctgagtgagcaggtcaggggtgtgaggctggggaactccctgtcactgttagtttagggccaaggttgagcacttgggagacctgagagctggggaggtagtggagattagatctggtcactttctccctccatccagtgtggggacgaccttcgccaggacatgctaacgctgcagatgattcgcatcatgagcaagatctgggtccaggaggggctggacatgcgcatggtcatcttccgctgcttctccaccggccggggcagaggtcagttgggagtaggggtgagggtggaggaggggacccctttgcttattgtccttctgcccattgccaacacaaactgtgtcctcctccaggaaagtgaaaagggcaagattatttcatgagaagctgtgggatagccttaaaagggaggcatgggagagagactgttataaagtaaaacagacttggtgccgtgacagccaagcatattgtgtagactttggatcctgattaaaacaaaccaattgtaaggaaatattttttgggccagacatgctagctcatgcctgtaatcccagcactttgtgaagctgagatgggagaattgcttgagctcaggaatgtttgggaccaacctagacacctcatctctaataaaaattataaaaaattagccaggcctaatggcatgtgcctgcagtcccacctcctcgggaggctgaggcagatggatcgcttgagtccaggaatttgaggctgcagtaagccatgatggtgccactgtacttcagaccaggcgacagaatgagaccctgtgtgaaaatatatatagagagagagagagagaaggagagagacagttgggggaagtttgaatatagattgagttagattaaagagtgattgttaattttttggatgtgacaatggcatggtgtctttgttaattacacttgaaatatttatgagtgaaataaagtatctgggatttgctttaaaatactccaaccaaggtggcagggagtggagaaatagggttgtgtgattagcaaacaagattagcaaaatgttgacaatttttgaagctgggtgatagttacatgtgaagtcatgataccattctttttattcttatatatattttcaaattcccatagtaaaagctaaaaacaaagggagcagcagctatgaactggagagaccaaaaagtcacagtatggaataggaaatgtgggaatgaccttcctttctatggttattctcttcctgttattatcagacttagtccaaatgccttacagcttaatttatagggaagcatgagcacagtccttgtagtcctctccctgcagtccccttcattctggtctggaacgtgacccccatttctcccctcacagggatggtggagatgatccctaatgctgagaccctgcgtaagatccaggtggagcatggggtgaccggctcgttcaaggaccggcccctggcagactggctgcagaaacacaaccctggggaggacgagtatgagaaggtagggttgtgggtggggagtgcgtctggtgtgtgtgtgtgcctgatgccggcacacagctctttaaccacaagacctgcacttgctcagagaggacagctcagctttgttggcagaaggacctaccctttcttggttgactggtgcctccaaatatctgggggtgactcactcaaatgcctcttgtaagctggctgagaaaatcccctgatgctggactgagaaactttcactgagttctcctggcagattaagtcttggaggaggcgccagcttttgagagcctatctgtatccctcccagttgtggatcctcttcaggttcccttatgttctcagagggttcagtggtactttctagaaaaagagttggttggaagagactttagagatcattttatgccagccccttcttttcatagctgtgaattaagattcactcattcattcctagttatggagctgatatgtggcaaggctgtaactcaaagctaggattgaggttagatatgagacagagacgagtgaaaacagggctggctggttcctgatgaaagaagattagattagaagtggagctttcctgggtggtagggccctggtagcctgctagggtccgtggcctgttcccagcatcacaactctagtctctgggttaattaggttgaggaaagtagggacactgggaaggaacaaatcacaataaccaaactcacaagagactggctataggccagaatgctaattcgtataattttaacttcaagggacccaaatactgatttatattgatcaatgtactttatcctggagggaaaaccagcatgggcagccaaggtataatcagaacattgtttagtgaatgtgtaattagatgatcttaaatggctttcagtgtttgtgttccccggggcttaattcctggcctgctgggccctctttgcactcttcttgtgccagctcatcctcttattacttcaactaccacctgtatcttgatgacctccgaagccattcctctagccctcttcccttcctccaggtggttctatagccaccttcttgctggacttttccacctacgtttcacccacgtctcaaactcggtgtaggcaaaactgagcctgctgtctctcctttgcctcttgaaacctgctttttgtgtttgctatcagtcaatggtgtgactctttctgtgcatttacccaagccaaagccacggtcttcctgatgcttccctctatctcacttctgtaccatgctctgtttattcttcttcccagctatctctcaaatctgtcctcttcttcctattttgttaccattgattttgttcagctctttgctgtcggtcccctgaaccactggaatgcctctcctccatctagagccagcctctgcttgatttcagaggtgttttgttgttgttgttgttgttgttttgagacagagttttgctcttgttgcccaggccggagtgcaatggcacgagcttggctcactgcaacctccacctcctggattcaagcgattctcctgcctcagcctcccaagtagctgggattataggcgtgcaccaccatgcccagcgaattttcatatttttagtagagaaggggtttcaccatgttggccaggctggtcgcgaactcctgacctcaggtgatccacccacctcagcctcccatagtgctgggattacaggcatgagccacagtgcccagctgttgtttttttttttaagtgtggataagttcttcaaagcctctgtgtatcctaacagatagcattgcacacagagccttttataatccagccctgctgactcctgtaatcccatccactgcaacctaccatcttatgctaacctatgctccagctaggttactagctagatcatgcggtgggggcagagggggctactactttcatttctgcagtactgtaggcagtaatatttcctttgcctggaaagtcatttcttcccttctcattcctcaaaactctgccactctatgctatacatttcaagaccctctacccttggagaggagtaatgatttttttcctttctactaccaacctcccatatacttactctttatgctaatatgcatttttcaggtattaaacacccatatgcagaggcactgtactaggtgctggagttgtgattactccctgccaatgtaatagtcatatatgtgtaaatgtatggaaataatactaaataataataaatgtacagatgaatgtataagaatataataaaaataaatgtacagaagaatgtacgagaatacacacagagagaaactaactctgcatgttcatgtttaatctcagtctttcaaagatagcttctctgcccttctagcctttctccaagaataatgctggtagtttctttttttttgaggcagggtctcactctgtcacccaggctggaatacagtggcacaatcactgcaacctccacctcctgggttcatgtgatcctcctgactcagccttccaagtagctgggactacaggcatgtgccaccatgcccagctaatttttctatttttcgtggagatggggttttgccatgttgcccaggctggacttgaacccctgggttcaagagattcacccacctcagcctcccaaagtgctgggattacaggcatgagccaccacccccagcaatgctggtagtttcatttgatgacttccagaagaaagaaactagaggtattttctcttggccacctactcagcaagagagtatcccacaccctacacatgaaacccctgaaatcagaggcagagtgtccctttatagagtgagacttcttgccagtaagtggctaacaccctgcataacttagggaggtgaaaagagtttagtcatttacccacaggcacacagctattttctcagccaaaataggattcatttaaggtagaaagagcatctgtgacagggagaggatttgatagagatccaggtcacgactgggagttacgcgttatgctccttattaagtgcttttattcatttattttactttctaagaaatagtctttttcttccagaagatgaatgctgtgatttctttataacctttccattcttagtttctggtggatccatcatcaggttgtaattcgacaagtagctgggtgggtgcattctgtgtggagctagttttgcaataggcattgtgaaataggcaagaagctgttaggagaacagatctgtaaaccccatgggactgaaagggcaaagtcagtgctgtatgaatggaggtgacagtgcatctgtaggggttcagaggaggagaagtcagtatgagcttggaaggtctggaaagttatgggactcaaggtcattgaaggatgatgggtggaaatttatggaaggaggcaaggagggcgggcattccatatctagtaagctttccctcattcctaatttcatgcattcctacctggctatgacgatcattgctctctgctgatgtctttcctgagttcttaggaattctataaacctcacgaagaggattttgaaggcaggagtggtctatttcctcattccatgtagtttttctttctggaaagacagataaggggatggatgttgaccagacaaaataagatggagtcaacccctcaccactcctctcctgctttaaactcagaaatatctctaacatattttaccaactaaagatgtcccattttcaagtgtaaaacactctctagacgtgttaagctgcctcagctcttctttggagtgcagtgactttaattagattagcatttagctgttaccaagaactctggaaatgggaattttatttggggcaggaagaaggatgatagaattctgagcagggtcaggaagagattcttaagttggcttcctcagtggctgtacttaagatcatcacggccagttggggaagttgtaaatgtcagtcttcccatctcttaaggtcccctcagtctgggctgatcaagactgggctcttggatcagtccactgtctttccaaccgatctccctaggagaaagaaaggagaagatggtattcagatgaagtggtgaagatatacatataaatctccatcttttccataagacatgggagatgtttctgtgtgtgtaagtgtgtaagttagtacatgatgaaggatgaacaggcagatgtgagacactattggggttcacagaagagagagaggccagggctggctgagttctgtctggctgtggcccctggagtccttccaagccagctttatgtcctctcctcccatctgccttgacccctcccaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcggtaagtgatctcctgaagccagattgtgagtgaagggcaaggaggtgagcaacagtggttcagagctgggacacaagcccatgatggaagcagctgggcctcagatcatggtcccagggctgagcagcattggaggagagaagacggataaagaggtcaagtccttgcagggccttgcagaagaatgcggggaccagctgttcttccctaccaaggactgaacaaagggaaatgaaccaaactgtagcaaaaaggaatgcaatcagatatccagaaaaaaatattgccagctcacagataaggaaccaatgaaggatatagagatcttttaagattaaggtaggaaaggaacaaagaaaaaagttagagccccttctatccagtgtgtccacgtgatgagggatgagggaaactgacccctgatgcagcccatatggtgggcttcctcctccatgttgaccttctacctgtatgttccccttggctcagggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctggtgaggagctccatccctttccgaataccttcttcttattatctggcatcatctttaagacttccctgtcttgccgcagaggatttctagagatttacctctctgagccccaactgaatacctgcctgccctagataaaggcagggacccagactacctgaggacaatgatgtctgtgtaggtgcctgactccctgctccagcccttcagttcctgtggccctccagccactgcccacagcatctgtctaccaccctctagaagggttagggagcctagctgtagaaaaccttgcctaagggtagagaagcagcaagaattctctgttgttacaggcaccctctcttcttctttctgctccttctagatgttgtcctgtgggatccctgaactctcagacctggaggacctcaagtatgtgtacgatgccctgaggcctcaggatacagaggccaatgccactacctacttcactaggtaaaatgattccctgagcgaatcagcactgcccaccctgagtaattcccagcctgccggattggcaggaggaggactggggaaaggtgaaaagcttagctcagatgctagagcctagagctgaccacgtggatacattgtcccaactttgcccgtgatttaggtaaatcattttgcttctctcagccttggtttcccatctgtgttttggtgctaacctttgcacacaagggtattgccatcactcttatctacattctcactaggtcccatcaaatactttgtctatggggcaatgtataatgtggcttttgtaataacttttaactttcttggtcagacgcttcccccttgccagaacatggagttccatgattcagtctcctcatatttgacaatgtttttaggtacactgtgtgtgaaagcaaggatgtgtttatctatgaatgcctgcaaaatgtggtccctgtagataatgttctccactctttttggaattcagagaattaaactttctctgttaggtctcctaacacaggacctctcccgctgaattgaaatctgagattgaacagtgcttggtgaggttctattgtaatgaaccttgaaattttttgatatttagacatttacacagagagagtgagttcctagttcctttctaccttggtttgatggtttttggctcaggtgggcagccaggggaggagataagaccctggggttcacatgagcaaattgcatgagattattgtgtgccagtcatttgctttatgaggatatgacacaggaaaatggtttgatctgagctgattgttagtctcaggagtcaggaatattccttggaacacccctgtcgaggcagcaggaatttgggttcatggttatatcctcttttcttatcctcctgccaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatgtaagtgttttctccaatctgaccccctttcctgctctctgctgaccctggcttgctgggatcctgactttttccacacttgcacagtgggcacaggagttgaccgagcgtcctgtgctgggagcagtcctggaccacttccctctcctttgctcacgtgatctgcctagaattgggtagctgaattggatggttattccctctgagtcaaggatcctggcaacatatgtgggaagtctgcttttagattcctgtgtatgtgctatcatctgtctccactcttgctctcttccttctggaatgtgcccctcccctcagcacatacatacacttccggacctttcctacacccttcactgggtgcagagggctcggcaggtacaccctaagatctggacctttgcagatatatgtggtaaaggtgatgcgagagaacactcacgaggccacctacatccagcggacctttgaggagttccaggaattacacaataagttgcggctgctcttcccttcttcccacttgcccaggtagctgccccctttactatctgcacagagggatgtcggggagggggaaaggatacgggatgggaggtggtcagggctgcaggggcagaaaatacccttttggactaaacatctgcctgctttgcttggcctggtatggagtttgatgacaagtgctccccctgctggccaagctctccttgcacgcaagagctctcactccaggcccactggccagaaaggaaggcatggttgaatctgatgtttcaaaatttctaattttttaaagagttacaccatttttcaaatggataagcaaaatgtcatatgtacatacagtgggatattattcagcatttaaaatggagggagatttcgacacgggtaacaacgtggatggaccttgaggacattctgctaagtgaaataagccagtcacaaaaaaacaaaaacggcacgattccacttatctgagttacctggagtagtcagactcctagaggcagaaagtagaaagctagttgcccaggtctgaggggaggtaggtgtggttgtttaatgggtacagagcttcagttttgcaagatgaaaagagctatgaagttggatagtggcgatggttgcatgacagtgtgaatatggttaattccacagaactgtacacttaaaaatggttaagatggcaaattttatgttacacatattttactgcaatttttttaaaaactacttttcaggccgggcgcagtggttcacgcctgtaatcccagcactttgggaggcctaggtgggcagattgcctgaggtcaggagttcgagagcagcctggccaacatggtgaaaccccatctctactaaaaatacaaaaattagtgtggtggcatgcttttataatcccagctactcaggaggctgaggcaggagaatcgcttgaacccgggaggcagaggttgcagtgagctgagatcacgtgactgcgctccagcctgggcggcaaagcgagactcagtctcaaaacaaacaaacaactttttaaatgaattttttggccgggtgcggtggctcatgcctgtaatcccagcactttggcaggctgaggcaggcagatcatgagctaaggagtttgagaccagcctggccaacatggtgaaacccccctctactaaaaatacaaaaattagctgggtgcggtggtgtgtgcctgtaatcccagctactggggaggctgaggcaggagaatcgcttgaacccgggtggtggaggttgcagtgagccgagattgcgccactgtactcccgcctgggtgacagagcgagactccatctcaaaaaaaaaaaaaggatttttacatcgatgggagaaactgagggctcccgagccatttctggggagccacaggactctggcctgctgtttggttttcttgtctggggcccttggaaatgtagtcatgagatgctgagcaggtgtcagacctgggcacagatgtgcagcacaggaggaattgtgagggtccctagaaatggaggctgctgggaaatgggtgctaggggactggaaacgcaaatgaaatgtgaaaaaagcccattgtgtccattttctttccccatcttcacctcctgcatccccgctgcctacgctgccacgccagcttccctagtcgcttcgtgatcggccgctcccggggagaggcggtggccgagcggcggagggaggagctaaacggttacatctggcacttgatccacgcaccccctgaggtggccgaggtgggtgggcttgcctctcctcctggctgtccaggctggtggggatggttggggaggcagaggtggaagcatccggaggcactaggagtcaggaacaggacttggcacttcggggtctgtgggctgaatgaccaatgctccagtctgcagaagacaggaggagggtgggtccagcctcacagggttatacacagaaatgcaattaaacagaaaggtgaatgcatcgaggcacatgggctgagaatgatgagaatgagcggagcctcagaaaggaaggctcctctttgaggaaaaagttttttgagcaggttgagtatgtattatcaacctagatttttttttaaacaaatagtagtataatggccctaacaaagtcatgaggaatcctattattaaatactttaacaaatcatctgcccctattgtccatgttcccttcctatttgtccatatgcaagcatgatttttacagttttatagtggttatagcttaagtataactctggattctgagcttttttcccttagcatttatagtatacatatgctataactttaaatatctgttccttcagacaccaacttgcagtaccataatcttaaccattttatttttgaaagatatttagagtatgtgttttttttccccattaatgttcaagtgagtattttcacacagtttgtttgttttttgagacaggatcttgccctgtcattcagtctggagtgcagtggcacaatcacagctcactgcagcctccacttcccaggctcaagcgatcctcccacctcagtctcctgagtagctgggactgtaggcatgggccaccacacccggctaatttttgtatttttttttttgtaaagacagggttttactatgtcaccaggctggtctcagactcctgagctcaagcgatcctctggcctcagcctcccaaagtgctggaattataggcatgaaccactgcgctcggcctgttttttctttttaaactttttagggttaaaactttcaagcatgcagaaaagtagagaaacaatataattagcacctatatatccatcacctaaacacttaacattttgctatatttgcttcttctattttttatgaagtattttaaaataaataacatgccaggtgcagtggctcatgcctgtaatcttagcactttgggaggccgaggcaggtggatcacctgaggttaggaatttgagaccagcctggccaacatgtctctaccaaaaatacaaaaattagctgggcgtggtggcgcaggcctgtaatctcatctacttgggagcctgaggttgcagtgagctgagatcgccccactgcactccagcctaggtgtcagagcgagactccatctcaaacaaacaaacaaagtaaattacagacatcataatactgtaccccctaaatactcactatgcatctctaaacaataaagtcttgtttttaaagtaactacagtattattatattatccagtccatagtccatattcaaaatttccctatcatcccccaaattccttttactgttggcttgttagagctataatccacataagaactgcatgttgttggttgttatatttcctaagtctttttacatctggaacagtccccttcctttttgtattgggccattgtcttattgaagaatggccctgtttctgattctgttccagtgtgatttggtgtacaccttcttccacccactgccccgggatgagaaggctatgggcaccagcccagctcctaagtcctcaggtacagtatcttctctgagaccttactgccaactcctctgaactaccccaagggtaactgcttctgccccaacctcttctcagttctctctccttgacttgcctcctgttccttttcttactctctgggaaatctagtttcccactcaggccgtggggtccatagttccttacctgggttccccacagggtggatattcagtcgattatatccttagacccatcccaacccaattaactctaatcacattcagactacacttatgtagatgcctcatgagtatcagaaatctgacatggagaggctggggcaagggggttcaggaagaaaacagaaacacctgcctggcctcttgacccttcatggtttcatttgtccctacagatggcacatgggcccggcccgtcggaaaggtgggaggggaggtgaagctgtccatctcctacaaaaacaataaactcttcatcatggtgatgcatattcggggcttggtaagtgcctgcacagccgtgattttttttcttttttaatgtttctttagctacttttttgggcagaccttctctgccgcgtgtcatatgggtaaccaccacagtctactgagcatccaccatggacctataaccatagcaagcctatggtatgactaggcaatacatgagacagctttttgtagctgtggtctttgacaagtaacctaatcattctgagcctcattagaatgaggaaaatgttagcacctacctcatagagtcattatggggattaaatgagataatgcttgtggaatacttaacaccatgcctggttttattagaataatgatttttatagtaattataagggagaggcccaaggggctcattacctggctataatgattgagcagccacgtgacatcctttgaatatgatcaaggcagtagtagataattactaaatttttggtacgagttctaagaacattgtgactagaagaggaagggaacttttttttttttttgaaatggagttttgctctgtcacccaggctggagtgcagtggcgcaatcttggcttactgcaacctccgcctcctgggttcaagcgattttcctgcctcagcctgagtagctgggactacaggcacatgccaccacacctggctaatttttgtattttttaaaattagagaccgggtttcactatgttggctagactggtcttgaatgcctgacttcaggtgatccgtctgtctcagcctcccaaagtgctgggattataggtgtgagccaccacgcccagccaggaagggaacttgaatacttgcattgtgctgcatcctatgttaggcattttatgtaggttggggcagtgggatatggcaggaggaacataaacattcatccatttactcttcattcaataaatgtttgagtgcctgctatatactgatacattagctctgggtatgggggaaaacaaaacaaaatccctgccctcagggggcttacattctagttgggaacggcacacaggcagataagtaaaatatatggcatagaagatggtagtaagagctatggcaagaaataaagcagagaaggaatgctaggatggaatgaagggagtggactttgcaaagagtgctcagggaaggcctcattgttgaggaggtgtcttagcaagatggagaaggtgagggagggagccatgtttatgcatctgagggcagactttcccaggcaaagggagcagttagatctgacagcccagagccaggagcctgccaggggtgcgtcagaaacagcaaggggccagcggctgaagccgatggagcaaagtcgagaggagtggatgatgaggttggagagggtatgatggaccagcacctcaccctgatagtaagaaccgtggctttttccctgaatgagatgggttttaagcagaggcatgacatgatctgacttaggttttaaaaggatcaggctgggtgaatcactagttggctgcccttgagcaagcagctcaatctctgtgactcatgtctctacctcttaggggttaagtggaccaaatgacaaaatagataaggatagtagatatggcaggaagatacctgggaacatgatggttcactcaaaacagagcacattatgggatgtcctgaggatttggataaaagtatagacttgatatcataggcaaaccaattgatgttttaataggacacaatgttatcatggtagatatttttatcagaatagagtgagcttggaagcagacaaataaattagttgtgcattgcaagatgccagatggcagatgagagtctggatcagagtgtgatcacaggaatggtggtgaagagacagatgttaaaaatcttaacatttttttggttctcattctattgtagcaactgctccaggatggaaatgaccctgacccctatgtgaaaatttacctccttcctgaccctcagaaaaccactaagaggaaaaccaaagtggcccggaaaacctgcaatcctacctacaatgagatggtgggtggggaaaatggtggggtagggcaggggttggcaacctgcgcctgttctcctagataaagtcgtattgaagaacgtattaagatgttgtattaagaacatggctgtacttgctgatttaggtgttacctgtagctgctttcatgttgcaatggcaggatcgagtagttgtaacatagaccatatggcttatcaagcctaaaaatatttactatctgtccctttacataaaaagtttgccagcccttttgggctgggatttcatggctggggtctggccctatcctgtgggaaggagaagcctgctggtcctgtgctgaaaatgagcagtggccccaatacaaagccctcacctgcttgaactctgagcaaagaacagagttcattaatgcttcccttggagtctgtgtaccttgtgtgccttctgtattacctgggactctgcagggtgagtgctagcctcagctggatcagcccccaacagactttaccatctccctctcgggttccctctggattcttcttgttccttctctcaccacttccctcacccatctctatgtttgcagttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaatgaaactataattttatttatttttttgacacagggtctctctcagtcgcccaggcttggagtgcagtggtgagatctaggctcactgcaacctccacctcccggactccatccatcctcccacctcagccttcccagtagctgggaccacaggtgcacaccaccatgtctggctaatttttttttattctttgtagagacagggttttgctatgtttcccaggctggtcttgaactcctgggctcaagtgatctacccgcctcagcctcccataatttttaaaagtaatttttagtagagccaaggtcttgctacattgcgcaggctggtcttgaattcctgagtccaagcaaccctctcaccttgtcctcccaaagtgttgggattacaggtgtgagccactgcacccagctgaaactatcattttaaagattggttgatgtttggctgggcagagtggctcatccctgtaatctcagcactttgggaggccaaggtgggtgaatcacccgaggtcaggagttcgagactaacctgaccaacatagtgaaaccccgtctctactaaaaatacaaaaattagccaggcatggtggcatgcgcctgtaacctcagctactcaggaggctgaggcaggagaatcacttgaaccagggaggtggaggttgcagtgagtcgagatcgtgccattgcactccaacctgggcaacaagagtgaaactccgtctcaaaaaaaaaaaaaaaaaaaaaaaaaaaattggttgatgttcacatgtttacattgaaacatctgatgtatgagatgaaaataataatagtggttttttataccaccacatggtaacttttatatgcactagtgcactgcactgaccatttttacatttgtcagctaaatctatcctcacaacaacttgatcaggtgtgtaccattacccattttacagatgaagaaactgaagctcagagggatgaagtaacttgcctaagggcacacagccaataagtcttggagtttgaacccaggtttgttgcactccaaaccttgtgcaacccctcctaggcaatgtttaatacaatcccttaagttggtctaattggtatttcgggtgctttttatacatgatatatatcatcttccattaccactgccctggacagtaagtatggctcattcatgaattctgcaacaaacatttacagttcttaccagtgctacctagtggcatgcctccattcataaaaaaatacattgtattgaatgcatcctgggccctgtactctaggtactggattggggcttaccaaggtaaattaagacagttctctgcatttaagaagttcactaccagggccaggcacggtggctcacgcctgtaatcccagcactttgggaggccgaggcaggcagatcacgaagtcaggagatcgagaccatcctggctaacacagtgaaaccccatctctactaaaaatacaaaaaattagctgggtgtggtggcgggcacctgtaatcccacctacttgggaggctgaggcaggagaatcgcttgaacccgggaggcggaggttgcagtgagctgagattgcgccattgcactccatcctgggcaaaaagagcgaaactgtcttaaaaaaaaaaaaaaaagaagtttactacctagaaatatttgaccaactccattttataggagaaaaaactgaaacttgagatgcctcaaaactatcaagccactacagcataaccatagcccagaagggaatcccccaagtgcaggatggaagtgaagtgacccttgttcaagcattgtacccagaagtcttcagaactctccagtggggagtcatgtttcatactggggaattctgtgggggcttccagggatttttcagtagtaaacagtaggaagtgttactgctttatttctaagtggtcttgaggtgtcactgcagttctgggcaagtccctatggactttttaaaggttagtact

SEQ ID NO: 12127 - DNA, 19227 bp, Human
ctcattcactgggctcctttcaccaatcccctgccatactcactctccctcctttacctcccaccttggctctgagctacttcagttcttcaattttcctcaagtatctttgctcacttcctggccttcgtactggctgattcctcagcctgtgaatgcctcagaagcaaggaccctgtgtgattccttttcttaatcccagcatggcacctgttcattcatttcacaaatatgattgagaggccacaatgtgccagactctgtgctaggtgctgggatacaggaatgaacaagaaggacaaggcctctgcccctaaggcactcacagttcactgcagagacactaaacatgtaaacaaatacatgaaaaatgttgataattgccagaaagagatgaaaaaagtttggtgatagggtaatgaggagattacttgggtagaggtcagtgaaatcctttctggtgacatttaggctgagatctaaaggatgggaaacagctggtcaggcagaaatggaggagaggattccaggcatagggaccgccacctgcagcagtgcagactggaagacctgagcatgtgtgaggaacgcaaaggagttaagtgtggctgcagctggaggatcagcagagaagggagttgtggagatggccagtggaggccacatcattcagggccctgaaagtcatggtcaggagtctggaagccactgggggccttaagatcatccacttccacaatgatgatccaccatacccatttcaactgtgcacctggcatggtctttagattctcccctaccctgctctctttattttcccttagtattcatcatcctctatgaaactatgtatttattgttttatgtttacccctttttgggtttgcttgtttcgagacagggtctcactctgtcacccaggctggcagtgcggtggcacgatcagagctcactgcagcctcgaattcctcggctcaagagatcctcccacctcagcctcccaagtagccgcccagataactcccaagggactacaagcacacgataccacgctctgcttttttttttttttttttttttgagattggattttcactatgttgcctaggctgatctcgagctcctggcttcaagtgatcctgcctcggtctctcaaagtggtgggattacagaagtgagccaccgcgcctggcctacttattctcaattgtttgtcttccccaactaaaatgaaggctctacaaggacacggagtttatcttattcactgcggtattcccagtacagagaacagggcccggcacagaataggtgccccataaatatttgctgaatcaatgaaaaatcaccaggagccagcgtgggtcagtgacatcaagtcctgccccactaactccatttactggaccctggactggcttagacctcaagcaagtcacgtaacctctcccagcctcagttttctcatctgtcaaatggaaagttggacacgttggcccctctgtgcccttgcaactaaggcagagaggagaagagcatgccccgtcccgctctgaggttctctcctggacctgtgaaggtgtctctgggcgcatctgaggagtggcttttcctctcccggcctcagtttctccatctgagcagagggcttgggaggccttacccatgcaggggcagtagagcaggtaaccggccgggtcccaggagcccgcgggcatccccgggagcggcagaagcagcagcaggaaagacacgctcagcggccgtgcccacgcggcggcgcccatgtcggcccgggaacccgagccagccgcggcgcacagtcggggagggaaggagggacgcgagcgcccgccccgctcccagcggtccctgcgcgccgcccgcgcaccgccccggccgctctagcccgcgggcgggcgggaccatagagatcccgcggcaccgccccctccacgacccgagcgcccgctcgcgcggctcccacaatgcaccgcacaatggcccgaccgccgccactaccggggcctgagggggcctggcggagcccgagcgcggcccggcccgcagcgtggggccccgagcgcggtgagtgccggcgagggccccaggggacggcggggagaggggcgggaggccgtctcgctgcgtccgcgcgccctgtacccggagcggcggcgcgcctcatctcgggcccctcagcgcggtcgcccacacccccgacccggggcccggtctgcgccaacccggccccagataggccctggggtgacgaaaactctccctggaccccatacctgtgtctgggggacccgaggaagccaccggtcccctcccttccgagacctggagacgcagtcctgagggtcccccattcccgacccctaggctccctggagacccagataaggcgctgctgaccttaccagggacccgggtctgggggacgcagataagctgcacctgctccctccctccgacacgcctacccagacccacataaccccctttcctgctccagatagcccgctctgtaccctgtttcattttccagacttacataactccctttgaggcttccctcaaatatctgggtctggagaagtcgaataagccccacctgtagttccctcctcagtggccatactcccaggctttcgacatcttccatcccgttacccattttgagaccctcttgaaattcagaggatacacttctgactatccccatccccccagccttccaacccttataatcccccatttcattcttgtggggatcccttagagacccaggaaagttgctcatgattccttcccatcctcgctcttccttcccatcccagagactccctccagacttctccctggatttcctttgcttctccagccctcatccactcccatctctcccaggctcggggaattgaacctttcccacaccacagtggggtgatctaaaagttggcctgggaccaggctgtggcccaccttggtggggagaaaggggcctgttaggtggaggatatggggacacctgtgtgggggaatcggtgctttcacctgcaagcttagcctgtctcctggcttgtgtgtttttccacctgtcagccatgggactgtgtgtagagtctggtcttgggtttctaacctttctctcctaaggtgaggccaccagattgggagcgggggtgtcgaatcacgttttctccccatgaaaatggggttgtgatgagttgcagccatttgttcaaggcctccccaggagtgggaggcagcaggaatctgaggaaatagtgaatcaaagagactccaaagagggcccatctacactgacagaagaattagcagcctgagagtaaatccaacccctgttaatcctgtttgatgtttcttggaatggtgcaagtcattgagactctccagcctccctgtaatttaattctcccaccactctggagtgggcgggggggaagggggcgacagcattcccatttcccctcttctcactgttttccagccaaccagtgtgttttaggatttgtttctggttctgagatcaggatctgttttttgttttgttttgttttgttttttctttcctctaagtctatttataatttcccagttgctattttgggttctgcttaagggaagattctatcccaaggaacgttctgggtctatttcctccggcaggtgttgaattgagttcttcagatccccaagtaactcttgggcaggaggataaaagctattttagggtagtcactgaagtggagctgttaatcctctgtgggtctctttagttaagaacactcaaagattaaccctttccttgtgcaggggtgttatctctcaactgttttttaggggggagtgaggagaatttgagtgtggcagcagaaggtggaaacatgcaactcaatacaaagacaaagataatagctctcttttgttgggtacttctagcaggccaagctctgtgctgagccctttgcatacctcactaaaataatccttacagcaagcctgtgaggtaagtatttttagctttacagatgaggaaacaggctaataatggagaaagaacgcagtttctatagagatgatgtaacaccataaaaactatagtttcatcagagagcagcaggcatcatggcccataacaggggacggacagactggggagaaatatgtctcagtttcagctttcaaagaggaccatacagagtttttagcaagcattcctgtttgggatatggagccctaataatacaagagagtataggaaagtggctctctgcttaagagagaactctggcccaggagatggtgcctggagggaggtaaagtaaggggctctttaaaggggatgtgccgagggttagttgtgagggaaaaggggaagactgcattctgggggagatgttgggaaaggaaggaaactcactctgaggcctgagaagtaacattaaagaggaaaaaaagaagtactattcaggcctcatgcggaaaaagaggcagacacagccgagacctcagagaaggcactgcatgtattcagagcacacattttgtatcagccactttcaagagtattatttcatttaatcctctatacgaatcttacaggtaaggaaaataaatccgtattttagaaattgaggaaactgaggttcagagaaataaagtaacctgcctatggtttcccagccagtaagtggcagctcttctgatagcaagtccaaggttctttcccctttcagatcaggcactagaaagaatcttaggctgaaaatatactgagttgtgccagtaactgggaaggattgtgtttgttttatggaaacaggttctgtcagcttctctatagtctatagttgttaagattaaaatgtgagaccagaagagcagctttgaaagagaagtagaattctttcacagttttgctgaggaaggacaagtctgaaggaacaggccttctgcttatgtaagacaaacccaggaatctttctggatcagaggagttttcagacaaagggcagagagagactagatccccaaaagggttcctaggtaacactagcagctttggttatccaagaggctgctggtgactgtaggtagggacttcctgtgccttttgaaaagtgtaggagagtaggatcagggtgttggctcttttctttgtgaagacatagccccattaaaagcagatcaaggtgagcacatggctgctgctttcctcctttggttctatcagtacaagctccttagccaccaccagcctctttcctagaagcccattactcactctttcagtagcagcctactaaactattgtgtcttgtttgtgcttgttcaggagaacagatgaggtggacgtgtgggaggtggggacgtaatgttctctttctgagtttgtgtggagtttccagggctaggctcctctctcacatcagccaaattgatgtgacttgtttccttctggctgccattcccaactttccagaggctgaggtgcatgatttcaaattgaagggggagtagaatttgactttgaaggtaggggtaattccctccaatctaaacatgcacactcgagcacactctctgctcaattccaaggtgcatagtaattgctggtattacaaacaggtaattccacccttgcaaaggaggaggggacttaaacaatgaaagccagacgtcacaggcctttgaggtttatagtgaagcaggcacatatgccataatgacttgaaggctcaagtgggactagtttttagtgctacctacccctccccagcatgtgattcatgcaaaatgcagccaccttaatgcagatctttctagacaaatctacactcgtgatggggacgtgtttatcatattacatcgcagtgtttcttcaacaagaggaatggttcctgaacaggacgtagctcatgttaatgatgagcaaagctctctggggcatgaacccgctgatcccatcatcttgttcacggccagtctgttggatgaatggtcactgtaagcagcaggtgctaatgagctgagcaagcattctgtggcccacagctagtttgtgcagttggagccctccccagattctcgtggataatccccagacacccccttttctctcttcacatggaaaagcctcatgatcaaattttggcaccatctcttcaaagggaatccccctgttgtagcaggttgcatcgtggttggtaatctgtggtaagcttgggagtatgaatgtgggtctcttgtccccttttgagagtcagtgtggtaactcccatcctcttcctctggattagtatctggaatggagttgtgtcgttcttgcacatctccccttctattcaacaagagaaagaatcagactttaagatttcggctccccacttgggaatggctgcgaacccagtttaaaccagaactacctgggcctaggttggtccctgagaatcaacctgcattcagtgactagtttacctatctgaaataaagttagggttccttttctagatattaggtatatagagatgaaagagagatgatgcaagccctcagacaatcaggctggtggagaggagtaaattccaatgcgagctcgctaccgtcttctaaaggagatgtgcatatgtactctgaggccctgtaggaggggcctctcagcacctaggggtgttggacaggctttgctaaagagggatggtctgggccctgagacacagtgacccagagaagtggtggtggtcaggatgggaccagttctagtcctggtttagggaaaatgctaagaatctgctgttgccttcccatatagaccctcctgatgttgatgcactgctaagaaacacatctggtaccaggactgactaggatgtaaatttcctaagtagaggcttccccttcctcctctcttgccttttgggcattttattgctccttagcacctccatgaggaggacaattgtggaaagtagtggacgaggaggtgccagggtaataagaaggaggaaccgctatctctaggttcaatggaaaggatataaaagtgaggtccagaagaaaaagtttgaagttttggggcttttggttcctcagtttatcttgtttcttattagcctagatggtactagtaatagtagctaccactaagcacttaatggatgcccagccttctgctgaatgctttatattcatgatctcatttaatcctcaaaacatttttataatttaggagattattatgcccattttataaatgaggaaacagctcagggaagtaagtaattggctgaaagtcacacagcttctaagtggaagggctgggattggaacgggatctgtctgcttccagagcccatgttctcatggtattgggctccctaacaccaggtgttctgatgtttcaggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggtaggtgacactctcatatctcttcctgccctgaggttcccagagggaaaaagcagagagactctgcctagtgtgggtttttaatctgtggcagaagagtggaggttaatttgtcctacaagtataccctgaatgccaaacagttgaagtcactcactaaaaaatgattcagattgcttgattcagacactagaatctgatgggttgcctccccaaagtattgggattgctggcgtgagccactgcacctggccttcttacaccttcttagtgacgatctgggtgccaatgtcaggcagccttgagttttgtttgtttgtttgtttgtttttttaagaaatgggagtcttgctctgtcatccaggctagagtacagtggtgcaatcagctcactgcagcctccaattcctgggctcaagtgattctcttgactcattctcccaggtaactaggattacaggcttgaaccaccgcacctggttgtttttaattttttgtagatatgggggtgtggctgtgttccccaggctggtctcaaactcctgggctcaagtgatcctcctgccttggcttcccaaagcagtgagattacaggcatgagccaccgcacttagccctgaacatttttttttaaatattgctttcctcacctttgtcagttgatggtcagaattttagctagaagttaggaatcagtattcgaactttagaaggaaaagtagaccttctggcccagtctgtaaattttaaagtagaggttcagagtagggacataacttacccaaggtcacacagcttcagaggtcctgcagtgcctcttctactgaatcagcctgctacttactcatttaactatgtctgtctccctgttgcccactggggcagctgcttttctgaaacttgtaagcccaagaacccctacttaaagtgaaattaaacgtaaaagccctgacataaggcagatagagaagagcagctttggttgctttggtgaggatggggaggcatggtcaaaagcaattttgggccaggcgtggtggctcgcacttgtaatcccagcactttgggaggctgaggcgggcggatcacttgaggccaggagtttgaggcaagcctggccaacatggtgaaaccccatctctactaaaaattttttaaaaattagctgggtgtggtggcacatgcctgtagtcccagctacttgggactctgtggcaggagaatcacttgaacccaggagaaggaggttgcagtgaactgagattgtgccactgtactccagcctgggtgacagagcaagactgtctcaaaaaaaacaaaaaagagcaattttgattttatccttttcgcattagaggaaccatgaacttgccctttagaaatgagatagatcagccgggtgcggtggctcacgcctgtaatcccagcactttgggaggccaaggcaggcggatcacgaggtcaggagatcgagaccacggtgaaaccccgtctctactaaaaatacaaaaaaaattagctgggcgcggtggcaggcgcctgtagtcccagctaccgggaggctgaggcaggagaatggtgtgaacccaggaggcagagcttgcagtgagccgagatcacaccactgcactccagcctgggcgacagagcgagactccgtctcaaaaaaaaagaaatgagatagattggcctgatgcacagtcatccaaccatccattcatctatccaacattattgagctcttgctctgtaccaggcacagtgctcggtgcaaggggcggagtagtgagccagacagatgggggtgctggtcctccttgggtttatggtcttaatagtgggtacagacagtaaacaagtaaatacatgaacaagatgaccacaaagcctcagttcctcatctggaaaacagttaataggaagggactaaaataggcaacagggtagcatggtagtcaggattgccctcttgacaattctgtggtcctcaggagtgcttagattctctgtgtgctcctataagttaagggaactccagtcaaggccatactcttaggctttcttttttttcttttttttttgagacagggtctcacttttgcccaagctggagtatagtggcgtgattataactaactgcagcctcaaactcctgggctcaagtgatcctcctgcctcagcctcctgagtagctaggatcacaggcatgtaccaccaccacacccgctaatttttgcatgtttcctagagacaggatctcttccctgtgttgtgcagggtgatctcaaattcctggcctcaagcagtccctccaccttagcctcccaaagtattgggattactggcatgagccactgcacccggccttcttagactttcttaatgatgatctggttgccagtgggcggctgcaggaaaggtcctgggtcaggaggcaggagccctgactcatcacatataatttactgtgtgatcttaggtgagttgctagacctctttgggcctcagtttcctcacctgcaaaatgagggaaatgaaaagtggatcactcagcacctccctctctacattaccacgtcagttccatcacaggaggttgacagtaacccacataggcacgagcactcttgagcatgcatatgtgggatgtgggcagggggtgtgtttgataccctccaggtagaaaggatcacagagtgctgtacgagagagagacagctgttgcatacctgactgaacataggtcttccgaaggcctgtttaaattcagcctctgctagggtgagggggctgccttttttttagactcctttccttgtctggagatcaaggttaatgacacagcttatgcagagcctggcaaacagtgggtgctgagttgattctgaatatgctctggagctgtgaattgcagttcctggattctgagccacttttcaaccatataggatcaggtaaaccaagggacactgaagtgccataccattaaaacatttcttaaagtgttactggtttatatgacaagcaattcaagtggtacatactggcatgcagtgaagaatgaatgatcctcacactcgaagtcactattcctctccccaaaggcagctggtgggttggtttttgtgtatccttcctaagacattcaaacatgtatattctctttcttttttattttcaaaacagattgtatcacatgtactgtattgaacttccttttttgacttagccctgtatatcttggaaatttgttctagataaggaagtttatttatttatttagagacggagtcttgctctgtcacccaggatggagtgcagtggtgcgatcacagctcactgcaacttcaaattcctgggctcaagtaatcctgccttagcctcttgagtagctaggactacaggtgcatgctgccatgcccatctaatggttaagattttgtagagacaaggtctcgctatgttgttcaggttggtctgaaactcctgggctcaaatgatcctcctgcctcaccctcccatagtgctgtgattacaggcatgcaccactgtgcccagactgcacgtttaggtatattttattttctctttattgtatcatttaaaattatttaaatgtaatgtttaaaaaatgaaatactttcacgtaattcaaaattcaaaaagtaccaaaacttatacgatgaaaattctccatgacacccatctataagctgttcggttctttttcgcataggcagccactggtatcagtttcttgtatgtccttccagaaatattttagccatatacaagcaaacatacatatatttttccccttttcacatagagtcctagtctacatccactattctgcctccttgctttttttctacttcctgtctcttaggagcatgttccctgtaagtacacaaaaagcctcatttttgaaaagttgagtcattttatggacttatcataatttatgtaaccagttccctattgatagattggacgttcagattgtttctgattttttttgctactacaagcaatgctgcaaagaatgtcggtacacattattttgcagataggcaaggatatctgtagaatataactggtttggtattgcattgcaagcctttaccatggtttttatatctagtttcctgttaatggacacctttggttgtccagtcatcccttgtgatctcccctctttctgctttctcccctatcccctgtctctacccccaggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagcagctcaagatcaagacagagcccgtggggacatgttaggcctacttagctgcagctccacagtcagtgtgaaggaagagctgagccctgtgctgtgcatggcctctcgggaagtaatgggaaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccactagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggcgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgtttgggagttgtgaacctgtctgattgggaaacggttggagagagcctcgaattgggaagaattggagtctccagacatctttagcatccaggatgatggtgagcgtagggcagacagtaaaaacccctcccatcagcacctataagctttgtacttttaagttaaatatcatatttgcatgtctttgaggtaagtggcataattctatcagttaatcatcttggatgcaagagtcagacagccaaaatcaaactggctttaaacactgaaattgcatgtaactggaaaatgccagatgtagagcagtctttgggttaggcttgatccagtggctccaacatggctggcctcagcattcctatttctctctgctctgtcttgtgtagttgtgacttcatccacaggccctacaaagtagatttcccctttgtgtgggagtgagcagaatgctgcctggattccagacctgccattctcacacattgccagccagaaggaagcaaccctttctgggctctcaggagaggactcaccacagaagccccaataagcatcctgtttcattggccttgatgggattctgtgccatccccaaaccagttaccatatgccagtgacaacaagactgaaacaggagtggtttctcaaaggaaatttggggcactcttaagatgaagaattgatgctggttgtccaagaaaggacaaatgttcaccctagtcactgcccaaggtgtacagctggtgacagctaggacctgaccttacctatacttgtgcccaaccaccgggttcaggcagactgctgagaggcttacatagcttcacctgactttggtggtctctaatgaaggtcgttaccaccatcctgggtgccagcccttgtgctgagatcctcccatcaggggctcagactgaactggcttttctgtggtctggagccagtgtctatggccaagcagtgcaagtcacttgcagtccagccaagagcctatggggccgttaacaagtgcaggtgttttatgtacaaaggaagtgggctgacccttcatttttgaccttccacttgacaaatgttcactgtccaccccagtaggttaaaaccctagctaggaccctaaggaaatccaccttgctccctagggagtgtataccacagtataggtctgagggctcaggtgagggagctgttgtatccatttgtcaggaaaaggctgaaagctttctggaagaggtggcaaggacttccacgcagaggtggagggggattggaggtactgacctccataggccacagtttgggagctgagaccacaggaacacagatttgcaggatcgaggactaagagggctggccaatccagctcttagcctgccaggtacagttcctgcacttcaagctagagtccacctttggaagggtagcctttgggcctagcacaaagtgaagcaaggtccacctcgcttctgccaaccagcccaggaggaaccaactcctgttggggaaaccaggcagatgcccactcgctccctggtttgtagcatttaagaccctctctcaccccagatccttccactctgaccttgcttattttccccacatgaatatttcaagcacctgctttccctacatgaacgtgttgatcacctttgtgtgtcagaaaattaccattatctgccgctcccagtttcagtctggtcagtctttgcaggagatacctcttaagccctctgcatgtgcctgagtaatttatcccctgtaaggccgagagtgtcctacaactgccccaaagcgccactcgagtgtggaagccgggcgactcctgcctgcccaccgcagatggggaacactgagcaatcgcctggcgtggtggttgtgatgggaaagttttacttgtccaggaccagcgactgggcctgtcccctggtgtttgctccgagctgactcttgcttggtacacacttctccccacctccaccgccagcgccaacgaatgtgggg

SEQ ID NO: 12128 - DNA, 36156 bp, Human
  misc_feature (1)...(36156): n = A,T,C or G
tagccagagttgttatctgttgattgcagtgaaagaacactgacgggtgtaatgaggaaaatctagtcctacgattgctttcatcatctctgttgaacttatcattgaaaaggatcagctctaggataacggagatttgccttgaagatgaagaacaactaatatttatggatactagttatgtttcagacactcttctaaatacttccatgtctatctcatttaatcttcagaatgacctcattggataggtgttattatccccgtattacagatgagaaaactgaggcacaaagtaataacaaacttgctcattttcacatggtcagattaacgggtctctaagtttattctatggaatattcgtttttcaggattatattggtttcctggggctgccataacaaagtaccacaaactggtggcttaaaacaatggaaatttattgtcttacagttctggaggccgtaagtctgaaatcaaggtgtcgtcagcaccatgttctctatagcaactctaggagagaattgttgcgtgcctcttccagcttctgggggttgctggccatccttggcgttccttggcttgtaaatgcatcactctgttgtcacatggctgttttctgtgtgcccttttcttataaggacaccagtcacattggattaagggcccacttgtttcagtatgacctcatcttaactaattatatctacaatgaccctatttccaaataaggatgcattctgaagtgctaagggttaggacttcttttttgggagatctaattcaatttatgacaaaaaaagttaacataaattgttcaaaaaagaatgctatggcgaagtaagtttggaaaacaccattataggattctttactgtagtactttggcggggcgaaggtctttaatttgttcatcatttagaggagttgccaacctgggattattttgtaaagtttctcaaaaacctgtttgatgatggacttctttttacaggctgactgtgagatcagcagtcaacgtggaacacctgttctcatgcctgatgtgaggcagtggcaccctagcacatccctccctggttcttctgctttcccctgtgacctgcagcgtcaacttgagacaacttttcttctctgagcctgagtttccttactctaagataaggaaaataatatactttccctatgggtttgatgtgtggactcatttttgttgttgtttgttttgagatgaagtctttctctgtcgcccaggctggagtgcagtggaccaatctcggctcactgcaacctccgcctcccaggttcaagtgattctcctgcctcagcctcccgagtagctgggactacaggcacacgccaccatgcccggctaatttttgtatttttagtagagacaaggtttcaccatgttggccaggctggtcttgaactcctgaccccaggtgatccatctgccttggcctcccaaagtgctgggagtacaggcgtgagctaccatgcctggccgatgtgcagactaatttagtttaaaataagtaggctgagaaacacttgatacagggcttggcatagagagaagtaggcattcatttagtagttaactttgttatgctaaccagatggttctgaatttcttggcatttttattgggcatttccaggatctcaagaataatccttactcaggacaattttcaccaacaagtttttcttgttcatcttcctcttcctttcatcacttctttttctctttaaaagagggattttctgtatggtagtaagaatttcccttaggtaaatattcaacccaactgtggttttaataagtctccagcattagcaaggaatgggtggtttactctgcagttccttattctgatcttccaccccagtgaggggaagaggatgtgatcatgcgaccgccagcagaagggaaattgtgaaagcgacctgctgtagaaaaggcggcccacagccacctcagcatgcagaggaggcccagctgctgagaggagttgcctgagagtgacctttgcatctgcctgtccagccagcatggaaccaaagcggatcagagagggctaccttgtgaagaaggtgagcgaaggtgccacttaccagggtgtcagtggacatgggctggggagacttgggtccagctccaccggctacctgctcatcttaggaatgtttcctgttcaaccagttgggttgaaataggggagcgtggtagcacatagaatgttggagtggggttaggggagtggggatactcatccagccccggcttccttacagtttgatattacgggtctgagaattccagatggcagggcctggaaggtggggatctaagctaactccctccagatttagaatatcctttttaagaggcacacagatgtgttctgtcagaagatatactcctcttctatggaggtttcttggagggactattcattttttatttaaattccacttcccctcagttctttttttgggaggcaaggggaaaaaagtgattaaagagttgatataatgatagagtaattacggcttatttcttgggccatcttcttggaattgacacgtttaaaaaaaaccttatctttttttaattgggctgaaatctcttcactcacaattcttagtaaatttgcataatgtggcatcgaggtggtagatgcaccattttaaagattagggtactgaaaaaggcttagcctccctggtgtgcatcatgaaaattgaattttcttagtgctgtttgtctttcttcggatgctgagtgtgtgctgtgtggttgtgaaagctccccgggatgtgaattcacacataggacttggtgtcctgtgggcaacacctatatacacagatatgctcacactaaccttagtgagtggattgtttcagaaatgagctgaacgtagtgccttccttcaggtgcttagctttttagttgaatgaacagtgaatgtgagtctgttttaggctactcatttgtttcacgttttaacctacaatgttctacctgtaaggggggttaaatagcacacattgctgcctgcttccattttgacttcaggctggagggaccctaggtcatctggcctaattccttcatttgcagaagaggagacagacccagaaggctcggtgattgccccaagtcacatggctatgacagttgtgaccagccactccttctctgatgcttaggtttctgattcatggcactgaactttgttcattactccagcattttcttaaagcagatttattccaagttaggatttgtagtgtatttgtgatggtgagagctatgagttggtactggagaataagtgggccctcagctgctaatctctgtagccagctgtgcttcgaaacatcctttggaaaagacacacttatacatagaagtgtaaaagattacttgcaataggcaccaataataattggcgagacctggtaataattaatattgacttattcctttcctgatcacttgtgctagtatcctgagaagagcaagtgaataggaacatttctgcaagtttttgtttgtttttttaaacaattaaaaacatcttgcaatgaaaattgctgttataaagtttgtatgctcatattttaatctccctaaattacaaaaatatgaagactaaatttctaataagtgaagctgtctcactaaaaattggggatgatagagtcagggttgtcaagcatgtggatttaaattaataaatagtttttaattagtgagagtagttctctcagattgtaaaagccaatctagaaaatgtgcctggaattaaatagtgaaattttgtattgatagttttacaatttatatcttccataattttcatgtttacaagttacatcttccataattactgcatttttctctgggaccttttgaacactctgatataatgcattaagattctcttttttttttttattcttctaaaactttaattttaggttcaggagtataggtacaggcttgttatataggtaaactcctgtgacaggcgtttgttgtacagatcattttgttacctaagtactatgcctagtatccaatagttattttttctgatcctctcccttctccaaccctccactctcacatagcttccagcgtctcatttgatattttaaagaaatgtttggtccagaaatattccctttttcagctgcagaactaaacctaaagacagagtttcctgagaaggtattaaagttcttaactactttagacattaagtttccttcagttacctcacgtgtgggttaaaaactgtatatgtcaagaatctgacatataattggtgtacataagctgcataagacactgattatttgtatcagcatcaatatatgcttcagtagatagtggggcctcccctagatgttaatggggctatgtactggttcctgggttggttgccaaattaattatgaaggaagggccataaaaatctttgaaaaggctcttagaagccttggctatggtttttgatattaaagcatgaaaaataatatagtgaatcttcctccattcacctttttctcttatgcagttcaagatacctgggtagtaacagagaacatctttgtcctgtgtcttgttttatgaaataattttattgcagataagttgttttgggtggaaaaaatatagcattagaaaatgctggtgcaggaattttgtcaggtcagaaatcttggggtcaatagtgttaactgtaaaacgtttctgcttttcttctgtgcaagatgactgttgacatttcacaatccaggtttcctcttttgcctcctgaataagatctccaaatgaagacagtggttaagagggggagggaaaatacaagattctgtcattttccagctttttcattccaagtaacacccatgtctctttgcctcagagtctttcaccttacttttttgttttaaaaaagagcacttctagccaaccatggagcagcaagctgctatacgaacatgacttcatttaatcctaaccaccctatgtgatcctcatcttacagataagaaaactgaggttcacagagaataagtgattcgtccacagtgaaacatgtggcaagaggatgacctgggattcaaatcccggcctgcctaacagcaaagcctaccatctcattgatcccaggcagcattctgaaaggcaggcttgccctggcctgcaaaagaactcactagagccagagcaaggcacgaacaaattgttttgtgggcaagattaagtttaaaaacctcagcctcctttcctctctgtttagggggtttctttctggccaataaacatgtttggaaggtactcgaatacctactactgaattagatatgttcatcatcataactggaaaaaatgagagaagagcaaattatatgctctgcataacctagactcctccaagtcatgtctcaaaccagcctaattcctagaggtttatggagcaagctgttgtttccaggacaaccaacctcacaagcacttggcgcagcagcgctgactcagaaagtggctgagggatttggatgtcctttgaggctgggagaaagcataggaatcagggtgatgggaaagggaagggcaagcagcagggacaggaaaggaaagggctgcagaaagctgtggtagaagtggaagagagcccgagagtcagggtcctggcccaggagttctttcctggatctaccttgtcttctaggcagcatgaaataatctgaagcgatttgtgcctactgattcatcatcactgtaacagctaacgcatgtggtgtttaccctgaagcaggaacagttccaagcatttcatgccttaatgcatttatacagcatacttaagacaactcaacaaaatggggacaattattatccttacttaacagataaggagattgaagtacagagaggcaaatggccttgtccaaagtcacacagttaataagtggcagagctggtttgcaacccagcagtgtggccccagtatcacgcagagcctaaccactttctatgtggccctcgtgggctcgtactgcagtgacattcttttccaaagcactgtcaccatgatgaggggtacccaggggaacattatgccagagcgactccacagtgttgcctacaaaaccgtactcttttttttttttttttttgagatggagttttgctcttgttgcccaggctggagtgcaatggtacgatctcggctcactgcaacctccgcccccaaaaccgtacttttacctgtttctatggtcgccatttttcaaatgtatactacatgctggccactgtggtgaatgctttatgtatattatctcatttaatcttcaccacaatgtgaaacaggtgctttgttaccttcattttacaggtgaggagactcatgcttggaaaaattaaataagttacctaaggttacagagcctggaagaggcaaaattgagatctgaatttaaatctaaggctccagaagtcatgctgttaagcactctctgtgccatttctgtattacttatttaatatgttttcactgataaattttccaacctggaagagttcacttatgtaaaaaatatgctactgaatagactagttcctttgccttcagtgagtttgtataggcacaacacaaccatttgtttgggatgttatgtcagtgatttgatggatcagattggaaaactagatgatgtgatttatgttgtagccaacataagggcttaattgaatgcagcatcaacttaaaataacatgtcccatgggtgtgcaagaatagataatagtaactgacagttctgctttagatatgcagttttgatcacagtgtaattttcctttgaattccagccatacattgtatgtgaaaagagaaatttgagggaaaggggaagttaaaagagatgccttcactttgtagggagtgtctgagaggggttctaaacacaaatatccgattgccccaaccctcagccattggttgtagcttctttctgtgatgctgggtgtacacaagaaggcacacctcaatttgtgcattcatcacactgacctggaggtcactctctcccatgtgagattgtgaactattcgagagcagagatagggtcttgtttatttttgtttttatttttattttatttatttatgtattttgagacagagtattgctctgtagtcttggctggagtggaatggtacaatcttggctcactgtaacctccacctccagggttcaagtgattctcttacatcagcctcccaagtaactgggactacaggcatgtgccaccaagcccagctaatttttatatttttagaagagatggggtttcaccatgttggccaggcttgtcttgaactcttaacctcaagtgatccacccgccttggcctcccaaagtgctaggattacaggtgtgagtactgcgctcagagttgcttaattttacatcccaacaaccaggccagtgttgaaagcataggagccattctatcattatttgttgaatgaacgtgtcccaaataaagaaacttgcctaaaatagacttcatagagaccaaagtaacttcttaagtcttaagaaaaagtaatttcaacgggggtagtcatttttagatgatcatgtagaatatatttcaaagatttattattattttttggctttcaagcaagcccaagggttagcagggacacctggaaatagaagactaaagggggaaaagagggacagcaggcaccttggaatagatgtgtaggatctcagggtagaaagagatgttacagatttaatacagcttctcatctgcagcttgcatttcttttattcatctgttaacaagcatgcttgaatacttctcttgttagggaactcactaattacattttctcccttaagttatgcagaaaactgttttcctgaaacctccaccggctgggacctcaaaacaatccaggcattcacacctgctctacctgttcctttatgggctaaaacctagttagttcctccaacagttagagagatgataccatcttggtgttctgctttgaacaggctctggtttacctgcagctttgaggtcacttgaacttagtatagttctccaggagcacctgataagcatagaactgtaaggaataggtactatttaatgagtgattactatatgccaattactgatttaagcaatttacatggattgttttcatctcccaacaaagctgagaagtagatatcatcatatctgcttgccagaaggagagaatgaagtttaaaaactttctcaaggccacattactagaaagtggcagagttgggatttgagcctgagccatccagctccagagcccatggtcacctgcaggctatgcttcgtttaaagacagaattatcattttccttgctttcgatcttacacttctctgtatacaaccacaacgagtttagtttttttttgacagcccacatcaaattgctgactcatagagctccttttttcccacatgctcatttcccacaccttataagtctttacaaaatattattaaagagaaaggctgtatcttatttaatttcaatttgcatttctttgattgcagttgaagcaatcaattatgttttattggacccagcttttattcgtttgagaattgcttatttatattatttgctcatttaaaaaattgggagtgttgatatatttcttattggttctaaagtgtttaaagaattaaggatattaatttttaatcatatgatgatacaaatatctatgcattttcatttgcttttcagttgttgcagttttttaaatatagagaagttcatttttttttttcttgagatgaagtcttgctctgttgcccaggctggagtgcagtggtgtgatctaggctcactgcaatctccacctcttgggttcaagtgattctcctgcctcagcctcccaagtagctgggaccgtaggtgtgcatcaccacacccagctaatttttgtatatttttagtagagactggctttcatcatgttggccaggctggtctcaaactcctggcctcaagtgatccacccacctcagcctcttaaagtgctgggattacaggcatgagccactgcgcccagccgagaagtttatttttaatatggtcaaatctgccgttctttatgatttcttcttttgatgtcatgcaatgtcagactcttaggtgctaaattataccagtcccatgatgatgaacaggtatttaccagaaaacttcaaatctgactcagcatcccattgtggacatgtacaggttttggcatataatgggtgaaaacacatatatgctacacacacacatgcacacacacacacagacacacatacacacagcatatggatatatatgtgtgtgtgtgtatatatatctccattgaagtgaaatagctagctaagtggtctaaagaaatcgatacagattccagaatgactcagtgttatacaagaaccaaaatgaaaatgacatctgaggggaagggaaaaaacataaaattgagaatcaggagacatggattctacattaactggtcagatgtactaggccaatcacttaacattaattgttcagatgtggtaggccaatcacttaactgggcctccacttttttttatcaatatggtgacagtgttggtagatgatcctaaatttctctgtcatttggacattccataatcacacttccaggtttgctcttgggtgagcatcaagtgggttggggccagaaaaggaaaaatttaggaatggtcaaggagaggtgctgccaggttacccgagtgagaaactggtagctgcagtagtggtgaagaggagagaaaaacctcctcaaattccatcatcctgacctaactcagcactatcaggcctggaaggatgtttaagctttgtaagtggtcagatttctcttgtttcataaagtatcagcctcttcattgtgcataatgaccctgaatcccaaatgacacatcctcctcagagtcagaccccggaggctgcacttgatttagaaaagcacaacgtgaaggttagttacatatgtatacatgtgccatgttgttgtgctgcacccattaactcgtcatttaacattaggtatatctcctaatgctatcccaacatggcacgtgtatacataggtaactaaccttcacgttgtgcacatgtaccctaaaacttaaagtataataaagaaaataaaaaaaaaaaaagaaaagcacaaactcatattggacagttggctccagaggctttgtctactgaaggcatgcaatgccagcttatcgctactgatgcatcccaatttcaaagtcaaaagccctgagtgatgatggcagttaataatctcagctattcctgaggttgaatattaaatgttaggtttaaaagggattctggcaatcatctagtgcaacttttcatttctagctctgagaacatgtctttcttttcttatttccaggtatttttaaaattttttattaaatagatttgtctatgtatttcactaaaagtatattctaaattttaatacatagcagagtcatatgttactcattcatttaataattttcccaagttattttaaaagttaagcccacagaaaaatgaggaaactagtaccattattcatatagcctttacctagattaatcaattgataatggatgggcacatttgctttgtctctccctatctctgaatttctgtataaataaacacacatatcatattaggttgagatagttgagagtaatttgcagacatcacgctacctcactccaaaatacttcaacatacatcttccaagaaaaaggacattttcctatataatcacaatgccattatcacatctaagaaatttattactaataaaatgaccttatctaatacaccttttacattcaaatgatgccagatcactcaataatattctgcatagcggctttgaaaagaatccatgattcaatcgaggacaattcattgcatgaatatgctgtttttccagtgattaagtgagagaagtaactaatgtggaatagtttccttctatagaagcaacttgaagggtggtgttactataatcactgtatacccctccatggagttaactaacaggacctggagttaacaactttgttttttaattgaaggataacttacaataaggtacatgaagggtgtcataattttttacatacctatacctcatgtaatcaacacacagataaagacagagacatttctagtatgctataaagttccattgttcccttcctagtctatactcccatcgtcggtaaccattattgtaatattttctcataagctatgcctgttgttgaacgtcatatgaatgtaatcatactctaagcacatgttttgcctgtttgcttttcactcaacatctatgagatttatttataatgttccaggtactagcggttcattttttaaaaattgctaggttgttttccatagtatacatttactgtgttaataatggatttatatattatattatacagtttacttattccttctcctgttgatgggcatttgggttagtctttgtttctggctatgatgaataaaggtgtcatgaacattcttgatgaaacctttatgacaatatgcattcatttctctcagatctttgcccaggagtgaaattgctggtgcaaaggacatatatgtgtttagctttagcataaaaccaccagatattttttctgcactggatgtgatattctgcactcctgccagctatgtttggtacttccagttattctacctccttgtcaagtcttattcttctctgactttgaaaatgctaggtactctagcaggtgtgtagaggtatctcattgtgatttgaatctgcattttcctgataaataatgatgttgaacactttttcataagcatttggatgttttctttactaaagtgcctgctcgatactttttgctcatttaaaaataggattatttgtacttttcttattgatttgcaggagttctttgtattctagatatgtttcagttgtaaaacagaaaggcattttactggaattatttcatgtgttggcacagtgtctgatcttgctcatttttaaaaggggaaataatccagtgttcgtctggaatagttattctgcccatgcagaaaagagatagggtattttaatttagaaaattattttagtaactagaacaaaggaaatgtttggacaagcaaagtgatagtcccacaagtatttatctttgcataaatagtcttccttttggtcaactggacctttatatagaggccctttgtattttgagataagcagcagggtctcttgggaactggatgataattctattttgtggtagtcatgacagggtgatatcatgggttaaagaatagacctttgccaaattcttccaaaatatagaccagaaatagagacttccctgttttaatcagaatggtcaacttattgctaaaggggcagctggcatgaacccaaactgaaaacattttaagtaaggatttttttaagggctacattaatgtggatagcctcattctggcattatagaccttttgcaagtgattttcatacaacttagccatgcctgcacacaaggctgctgtctgagtttctttttgacattcatattcagataaaatctgattagcccaagagatggaagcaactgcagggtgcatgccaccacttatgactgctttgtctatgggagacacggctgttggatcacaacacttttccactgagtccagcctcaagcatccactactactcagtctgaattgacacttgagatagattctacttgccattcttgagttgaactgaactcaatgggcaggtttgggagcagaaaacaaaccacataaagtcagcctgaaatgtaccaggggagcttatgggttgactgtcactgtatatacattttatcttaattaaaaaaaattccagtagaatgacagtcctcctttcccctgaaggcatccttcctgcgcagccttgtgcaaatgtggaccacctgcctccacactggccaaagctgagttacatattgtcctgcagaggtctataggatcattttaggaaatattgtcacacttattgtgtctattcttatgttaatcatttcattatgtcttatttattcagtcttatctattaataatgtgatcttatttttaatttttaatttttaaaatttaaatttttgtgggtgcatagtaggtatatgtatttatagggtacatgagatgttttgatacaggcatgcaatgagtaataataacaccatggagaatggggtatccatccccactaagcatttatcctttgtgttacaaacaatccaattacgctcttttagttattttaaaatatacaattaagttggcaatagtcacactgttgtgctatgaaatcataggtctcatttattctttctgttttcttgtttttggtacccattaaccatccccacctccctgcagtcccccacttcccttcctggcctctggtaaccatccttctactctctgtgtccatgagttcagttgttttgatttttagatctcacagatatgtgagaacatgtgatgtctgtctttctgtgcctggctcatttcactcaacataatgatcttcgggtccatccatgttgttgcaaatgacaggaccttcttttttatggcaaagtagccctccattgtgtatatgtactacactttctttatccactcatctgttgagggacacttaggttgcttccaaatcttgtctattgtgaacagtgctgcaaccaacatgggagtgcagatatctcatccatataccgatttcctttctttacagtatataccccccagtgagattgctgggtcaaatcgtagttctgtttttagttttttgaggaacctccaaactgttcttcatagtgtttgtactaatttacattcccaccaacagtgtacaagtattgccttttctccacatcctcaaaaacatttcttattgcctgttttttggttaaaagccattttgactgagatgagctgttatctcattgtagttttgatttgcatttctctgatgatcagtgatgttgagcaccttttcatatgcacacttgccatttgtatgtctgcctttgagacatgtctattcaaatattttgaccattttttgaatggtttattagatttttttcctctagagttgtctgagctcctgatatattctggctatcaatcctttgtcagatgggtagtttgcaaatattttctgtcattctgtgggttgtctcttcacttcgttgcctgtttcctttgctgtgcaaaagctttttaccttgatgtgatcacatttgcttatttttgctttggttgtctgtgcttatagggtattgctcaagaaatttttggccagaccaatgtcttgtagattttccccaatattttcttacagtcataatgtgattttaattaccaccgttcattccacaaattattgattgaacacctgacaatatgatggtgaagtaagttcttgcccccctggaacatatagttgggtggcaatagttgacagagtgattttacacactttatatataaaacatgtgtatacatatgtatttaaagatatatacactgtataatgtatatgtacattattcacatataagcatatggcatgcattatacacttatatatacatattttatacatgatctaaatctaaactatgctttaagatggaattattatctctctcttagcaaacaaaaagccatggctcagaaatattaaacattttacccaaagacatgtacaactaataagtggttgacatgaggctcaaatgtaggttcgagttttgaccccaaatcatagcatacactgaagtatcctaaatacttcaagcatcattggatgacatgtcatacaataatggaggaggcctgcaagtctgaggcaggccggattcttcacaatcccaaaccttattccaccagaagagaaaccaaagggaagtgtgtttcctcacaaatacattcatgcagatcctcagggccttcagctttcccattcattactccacatggcaactggctaaatatttttgactcttcctcattgggatgatactgataccagttcattgtcatttttccaagaatagagaggatgaaaactcaaagcatggaagacattcatacatggccatctgtcaagatacttaataatacaacctctcatttgtagagcacattcgaacttataaaatcttatccaaattatttcatttcatatgttctagaaatctctgaggtagtcattcttatcattttagtgctgggaactgagccttagagagggcaagtggcttacacaagtgtgggcagtaagaaagtcatagaaccagctgggcgcgatggctcacacctgtaatcccagcactctgggaggctgaggcagaaggaacacgagatcaggagttcaagaccagcctggccaacacggtgaaaccccgtctttactgaaaaaaataacataaatattagctgggtgtggttgtgcacacctgtaatcccagctacctgggaggctgaggtgggagaattgcttgaacctgagaggcggagcttgcagtgagctgagatcatgcaattgcactccagcctgggtgacagagggagaacctgtctcaaaaaaataaaaataaaaataaaatttaaaaaaagagacagagagagagtgcttgagctagatcatctaagattcagccaaccatctcagcagtgttaccagagcttgtaagtgaaggcagatttggggtaaaaccagcttttatttatatgtgtcttcagtgagtcagattagttggtttgcaggccatattttgaaaaccactaggctttagaatatttaattctttctccaattctgactaaccctcccaagaattgaaatgttctaaaaccctgaaaaatgaaaacccttccaaccgaacaccaataattatcatttttgtatttttctcctcaaaataggcaattaaacatgtaaaaataaataaagacttcaaaaaaagaaagaactatactctaagatcatgtgtcagatgtagtttcagaagcaagatctgccggcagttcttacacatagcgggggtgagaatgtttctgtgaggtgggtcctttgtggttcttaatggtgtgaacccgacatgaaaagggaggtgcaggggaaatcatagcaggaaagggtttgggtggggatgaagtagataataagaaggattggttgctcttttcaatgaagtgtgatagctgctagcatttggcagtttgggaaatgatcttcttttgtattattttaatgaacatcccctgtgtgctcagtatcatgaaccaaggaaagtacctgataatgtaattgccatggagaaggaaagataaccatactgaagacaattaaagaactacatgaggaaatatataacaaagttccaggttgtatggcacaatcagtgagaaaagcaggaggcacccctgagatcacggtgggtctgtgcagttcgggaagcctcatcaatgaggtggctaagctgagccttgaaggatatggagaggttaggcaaggtgagaaagaggagagggcagagttggggaggagtattccagagaatggggttggcttgagcaaagagccgggagtagaaatgagaatggctccccaagtagccactgatttgagaggatttgtgttgaaggaacagagatgatgtcaccaaacattttaaaaaccaactgtaagtaaatatagaatctttcctgttaggaggaaaatacagtttgcaaagagccctgtccatctcagctcttttggttgtcattacaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatggtaagttgacatcatgagctgccgtgaacccctggtcaggcactcaacttttggtgcaagcattgcctacaatgtgggtggtgctccttgggctggtccctctcaccaccacccacaccccaccctggcatttgggtttctcttggctagaagaggtttaggccaatggcctctgcttcatgaggggccccaagcccttgaaataagccatttctaatgggatgtgttttgattttcagtttgtgtttaagatcactacgaccaaacagcaggaccacttcttccaggcagccttcctggaggagagagatgcctgggttcgggatatcaagaaggccattaaatgcattgaaggaggccagaaatttgccaggaaatctaccaggaggtccattcgactgccagaaaccattgacttagggtgattttctgtgtttacttctctttacccattccttctgaaagacacaaacatagcagatcctgctccaaggcttgctttgaccacctctgatgttgtatccactctgccaggtcaatactggcacttggtgtactaaaatgtttacctgggtctgaaggagtgatccaaggcctactagctgaggagaggaggcgaatggagtacaaattccctcatactgggtaccagagagagagagagagagagagaaagaaacatcatcattgcatttataacatagccataataagtcagtcttgaaataaagctttaggatctttaggtagaaaggaaaaagcaggggctatgcatccaagcaagcaaggtttcaagttcaagttcattcatttacacactcaggaagggccagccagggtaaacacccatcctggtggaagccatttatgtcctgacccagtttaatggccgctgatgttggttggcttggaattgcaggtgatagttgtagactaaaggtggtcagaggccaacaggaagatctagctcctgacagaggttgggaatgggatttcttccttcctgagtatctcacatctttggtcacatgagcccctttctctaggagtcactttcttcttggtagttttgcttttttgttgagcattccctgaagcaggagccctgttgagaagaatcccatgccagctgcttaaaatgtccaacaagaattttgtttttatggagggtggggtggggagaagcactgagaggagcctaaagacatcccttctgcacttctgcatgacgacacaagacttggcatggcacaggagtttgacaaagtttgtgaactgagctgagtgagactcagcagcctccttcaccacaaaagctttttggcaaagagctccaacgaggcacctagtgcagctgcagctgctgatgggggccatcgagtgaccacagtcctggccagtgctgtcagaactaagtgggaaaaatgctcgggctatagggagccacaggctacatggaaggggccttctgttttgttgcttagagcttctctcgtaaggctatctttgatgtattacttcaaggacaaaaatgagaacttctcaccattttgccttatatctcatcattttaaagataagacatatgcttagtggaagcattcactttcttaaaggccaatgtctaccacagatggtcccttgaagagcattaaagaattgggatatgaggattgagggacattaaagatgtagaatgtgtagaaaatggaccctaggaacctttcatctttgacctctaaattggggcaaatttccatcccaggaaccaataattaaatcaacaaacagctgaatgaatttaagagaatttaggagacgttaagtaccttccagcattgctaaacgctgtgcaggctacagagttatgcagatatgaatgttgcccctccactacttatgatctgatggagggagattaagctcaggggatacctggggtgggggagcttgtgctcacctcccagagagaacttaccattctgaaatgttccccactcatccaactgggtttttttttgtttgtttgtttgtttgcttttttatctctgtgcagtgccttatatttgtccatgaaagacactgaaaaaggaataaaagaactgaatctagagaaggacaagaagatttttaatcactgcttcacaggtaaaagcacttgcaggcctgaaatagggcgactgggaaggcgatatggagtcctccttcggcctcgtctgtgaggtgggggtatgaagtatgggggttggaaggggtcccagaatgcagcctggtgagcctgaggatgaagctcctacagagtgaaaatagaaagaagtttgttgttcaagctaacgattttgttcaagctttatttgttcaagttaacatttgttcaagctaacgttccaatcaaaggattttttttctcaataaatggcattatgttgagacttgctagaaatagacacagaattggataagatgcaacccttactacaataaacagggattaaggcatacaatgtaagttttaaatgacaatattagggctatcagaggctgcacagggtcaggtattaagtgttatgagtttaggtagtatggtgtagtggttaaaaacatgtcctttagagccagaccaccttggttcaaattctggctctgcaacttactagttataaaaccttggctcaataacttagcctctctgtgcttcactttctctgtctatttagtggggataatcacagtgcacctacctcataggcttgccattatgtgtgtagagtagtgcctggcacacactcagtgctatatggtgcaagctcaagtggttattgtgttttaagtggtcacatgtctgtacaaccaattccaggggttcaaaaaaagagaaagaactcaggggttgatgggatgaataggaggtggtacccaaatttgaccctgaaagatgggtagaatttcattaaatatttacaggaggatttttaatgaggagccagggcagaggatgagcagaggatgggccagggcagaggatgagcagaggatgggccagggcagaggatgagcagaggatgggcaaaggatggtgaggacaaagttatgaggcagacatgtgcagaatatgcatctagaaaaagaaactgaccagcctagtagggctgacggttcatcagggggagcaaaatgggatgtacaatttggtactaagtttgtcagataccaggcctggctttcttatggtgacaggagagatcaaaggaagaaaactctgagctgatacagcaaatgtggaatctaagaggatgtgccatcaacagataatccatgaaattggtccaggtcaggatcagcaaggctaaggggaaaaggctttgatcactgacgatgagatagtcccccgtgggaataagcctcagagtcaaggcagcagcccagcatcagacaaggcagggctgagatttgggatcaagacaccaagctgtgggtggtggtatgagaaagtgacaagaacaagggaagttcccaactctatcaggaccgaggtcactgcaacagccttgggcaaagggaacaggagggcatttcaatgtagacttgggcacccaatccaggtcagactgatttccactgtaatgtgttactgagtcccagactattgggctggtttttttcttcttgttctccttctccttctccttctccttctccttctccttctccttctcctccttcttcctcttgttcttattcttcttttctcctttttcctcttcctcttctttttatttgagacggagtttcacttttgttgttcaggctcactgcaacctctgccgcccgggttcaagcgtgattctcgtgcctcagcctcctgaggagctgggattacagatgtgcaccaccatgcctggctaatttttgtatttttagtagattcggggtttcaccatgttggccagactggtctcaaacttccaacctcaggtgatctgcctgccttggcctctcaaagtggcctgtaatccctaagattacaggtgggctagtacttcttaaatccttcttgttgaaggccagggtgggttttggacatttctatgggtagagccttcatgggggagtcaggtggcctcggctgggagatgaaggctgtagcagagactgggacccagcagtactgacacatgatggaagaccttaaatgtccgatgacaggcagactagaccaaacttgtctttcaagcttcagcatgcctcactgagtgagcgtggatgcaagggttagaacacttaaaagtgacagcccagagcagttgtaactttggcctaagatcactcagattccctgagccttaattttcttatccttaaaatgaggactgcaattaccaccctgcctctttcacaggctgctatgaagataaaaagaagaaatgcagtgtcacttagtttatctttgtagagaaagaaaagtgagcaaaagcctttcatacatgaaattcatggaaggctcgctatccaactgctgtcactcctgttttgagggtggcatccctactgcttttgcccggatgacaggacaggcaggctgtcatgttgactcccttgttggctacatttgtaaggaacacactgctttttatttttatcttttttaattgacacataatagtacgtatttatggggcacaattaatgttctgatacacatatacattgtgcagtgatcaaatcgtggtaactagtgtatccatcacctcaaatatctatctttttttgttgtaagaacaaacatgctgtttttaatacaaagcttcattgtaacctgctaataatccaatgtatgggtcaatttcattttcttctctttgcaatcatctcttgaccagaagattgcttaaatgacttctcaaggtccctgctagactctgcaaagtcatgacaatcagtgcaggtgatgtcatcaaattttaatttaggacatatatccatcacattatttcctatttaaaaacttaaaatgatttcccattagccaaatttcttactgtgccatcaaagctctccccacccacccttcacctccctcctcctcttatttccttttgccttctttccaccaactcctcccctgccccatggggctgctttatgcctgagtgcatctgttcacactgctgccccctcagcttgtgctggttcctctgcatcctgcttcatatgcttggcaaacgcctactcatattttaagcctctgcccagtgtcacttcctctatgaatcttttcctgatggtgatgcacagccctcttctctcacctccttcacctctttcacaccttcagatttgacccagtagtctcgcaactgacttatagcagagcacttgttacaagacttatttattacacccatcatgcccttttacactccttgagggaatttctccaacacccagtagagtacctagcatcgagtaggtgctcagtaaatgtttgttcatcaatgggataagtgagtgggttagtaaaacctatttctttgatgcatgtgttgcttttttttaagacaaagactttatttttttatttttaaagttattatttttttattttatttttgtttttatttatttattttttattatactttaagttttagggtacatattttttgagatggagtcttgttatgttgcctgggctggtcttgaactcctgggctcaactatcctactgcctcagcttccagagtagctgggacaacaggtgtgccaccatacctggtcatgtgtttcttcttaagcagcatgtagatgttcttaaaaaccctttacatagttttttgtttgtttgtttgtttctagtgggtatctatcccacttattttgttttctctttcttgaaataacaggggagacgagacaagtcagacctgtgggtgagctggagtcagttcaggggtgattgtcaggggcttgttcttcggtaaggagagttaaccttccctgtgctggtcccatctaggtaactgcgtcattgattggctggtatccaaccagtctgttaggaatcgccaggaaggcctcatgattgcttcatcgctgctcaatgaggggtatctgcagcctgctggagacatgtccaagagtgcagtggatggaactgctgaaaaccctttcctggacaaccctgatgccttctactactttgtaagaaaagctccccatctcttcttcctgtaagggaggctgccctgagcagattctagattgatttcagttcatagacatctatagagcgctgttaggcagcgggtagggaggtcagccaggaagaacaagggaatacctgaagctcccaggcccatttagagcttctgttataccagcatttcccaactcaacagctgccctctctacaacactcgccctgtccaagtgaatttgttattataaaaggatactactgtttacttgaaaaaaaatttttaaaggacattttaaagtttattgtttcctatttacttattattattttttatttatttagatgtagtcttgctctgtcacccaggctggagtgcagtggtgtcatctcggctcactgcaacctccgcctcccgggttcaagcgattttcctgtctcagcttcccgagtagctaggattacaggcatgcgccaccacactcagctaattttcgtatttttagtaaagacagcgtttcaccatgttggccaggctggtctcgaactcctgacctcaagtgatccacctgcctctgcctcccaactatctattcttattctaagcaataattcatttataaaactgtcttagaccctagtccatggcaagcattctctaagacaagaagatacagccacgtagacaagcgtactggagggacaggcaaaaatcctgccctactgcagcttcctttccagacaggagtctataaatcacaggtttgatgtattaagtgcattattccaaatgtatgttaaaacacatgactcttaatacaaaatgtgtccacagatgtcacttcctgcagtcatcttgtgtacctcccacagtatgcttacccacgattgggaaacactatattatacaatgtgaacctgttcttaggccatgtgagcaatggtggatttcttgggggattttggcagttttgtttctatcttggatcagagcacagaatttaggaagttacctaagagaaccattcttcttataaacatgaagtgaacaccctagagggtttcatttcactttaggggaagttccacagtctgttttttttgttcttcagtcctttgatctggtcgtttatagccatttcaatgcaggattctaaaaatacccatcacagtggctcctcttcctcggtctgattcatcatctacttttgctgagcaagtcccacttccctcataacctcaggggaagaggctggacacatgctgtcacttttctccaagagggggctcagtggcaaatgttgagctggtgatagtattgccaatgagaaattagcctgccctgctttcaaggatgtgaccatgatatcccaagagaaggaaggctttgaaggcagacatgtgcctggttaggaagatggagctaaagttaggatacagcttgggagaccctccagaataaaaggatattgacaagatcacacctgagtggagacaagaaaggaacagccccggaagcaagtaaaaggaggaggagaaactcgctcatcaaggacctttgaagttcagattgggatgtatacaggaatggaggaaaaaggaggaggctgccctcatggctggaggggagggggaatggagatggcacaagttgcaatgtgcctaagactggtgatgttagcttgctgtttgattttccaacagccagacagtgggttcttctgtgaagagaattccagtgatgatgatgtgattctgaaagaagaattcagaggggtcattatcaagcagggatgtttactgaagcaggtgagtggccacaactgctcccatctagccttttccctttacaaggtcctttttgtttctaagttacccagtgacttttggtttgtttggttaatagtcaagcagaaaatgaaacccacaaagtgaaagatagatgagtagctctttagatatcaaagtggctttagatcaggaagattgagtttgacagggcagaagatgtccctaaaagtaggaaaatgcctcttttatcaatatcataggaaaaaaaaaggtgtttcaagaaaaatatggccggaggagataaattgtctaagagatgccatccaaaagacaaagctgtctcatggtaaaagtacttccattttacctgtccctcctcccttcaaagcaaccaggaaaacaggaacaggctacacccagaagaggaacagagtacaccactgagagcaaagaagagtcattccagtctgtgcttagggcatgacaagaccaaaacctgggcatgcagaggccagttcacaggaacagcaggcaaaagtcaaatgcagattgagggcatggacagagtcctggggggatgtccaggtgtccacaggtacaggccaccatcagtcttggaggcaagggctggagagtgctgaggagctctagtcggttaccaggtgccaaggcatatgatgccaagaggtaagagatggacaggggccaagatgactgaggaagccaggaccagtacctggtggaggaagtcgcaggaagacatgagaatattcagggggaagctagttgatacttgcacaaggcatcttagaggccaaggctgctttgcaggaccaaggtcttgccttcctggctgcactgtgagctgccttaaaagtgctgctcagtatataatggagagaatctgttgccatcaggagatttccatgtactgtctataggctccacgggactgggggatctgatttatttcatgttaggaccctgaatgtccatcttagtgattaatggaatgggcaaggagggaagaaccagagaagagcccatatttacatttataaagagggactctgggctgggatagctgaaaggaggtataggtatggattttgagtttcacagggggaagtgggacattcgaatggaaaaattaccttcatatcaggttttaagagaacagtgtcctaagaaatatatggcaagaatttataaagaattcatggactattatagtatttttttatgacagggtgaccagctggctagattaaaagaaaggcatggggcagagccagccttatgccgggaaggctcgggcagttgcctacggacagtttgcccgctgctgctttctcgttggttttgccaaatattcctatgttcctggctctttgattgcaggtgctggaatgtggctgttaagacaagaagagtaacttgggaggaaatttctttattttgttgatttcttccataattctatattgttatcagttatttcttgaattagttgattgggcaaaccctaatctagaatggggctcttggaaagccaaggatgaaggctaacagtagataaagttgggactggactggagccacgtctcagtgaagcagcccagtaggagacctgggatggtcaaaaattgtgtgtgggtaatgagtgtctggatgtattttgaagacaatagggacaaggattgaacttatgtgttttcctttgccttcctttgtctggcctttgataggtacaatttagccttagctagctcggttggtgcacatttggatctcccagggaactgttaaaactgcatgccaggccaatttaatcagagcctctggatttttacagctcccaagtgattctgatgtgcagccaaagctgagaaccactgagccagcctttttcttaaaagctaatttattctattatcagtatacaagttaaatagtctttcttagaagcttcctttttatgtgaagaaaacagaaatctacgtgcattcaggaattttgttcttttacaatattctttcctctgaattttttttcagaggttggggagcaaaaacctcttcgatttgaattgacacttccccttaatgtttctaatctcttagctcagtggttagtaaccatagtttacatcaaaatcacccaagggattttcagaattttaaaaactttttcttaaaattccaaaagtaagcctcccttgtgtttactgctgggagttagccaggattaacttcatagaaggcttgttataatgggaagcctcacagatgggaagtagctgtggctaactggaggccattatccctgccccattattttctcatcccaggataaataatcctacttggcagcaagtttgaggatgaatgatcttagattatattcagtataatccctttttacataattgtttctgttatgacaatgaataaagcatctgcttgtttaattctcaaccacatttagattccttgagggagaggaacaatgtgttatatatgcttctcttgtatctgctgcagagttcagcatccttcttgatttatcataggcaatgaacacttggggagctaattaagtcaaatataagtagatggctttgacagttcagtaacaattcttggaaacctgaggcatacatgcatttcttaatactccttagaaaatgctcattaagtgaaagatgaccagaaatgtacctgctaacttccaactcttcaacacgtcacattgtgatgtcagtgagggcttaaagggaatatggtggttggctgatttcacatcctcctgttaccttcctcttccattggctcataataagttggtgattgtccagcaattgcataatacagcatgacatgtgtgtctgtcagtgaagaggaaatggtatggggtggcaactttagtgtcgttattctgaagggcaacattagttaaggcaaagagcagcaatgtatacttttggaagtctatgctttgcaaaagccattttggacatgatatagcaggtaggaatattttctgtccttgcatatgactctgcaggggttccagctccatccttcaggaagtagaaagttctttggaagtgagttccttcaccaaatgttttgccaaaaaacttaggcccatttctgaaagcttccttgaagcacctctggatttatgaaggaggcactgtttgctaagaccacacatgttttattgctttcagcacaagtaaaatgaaaaatgttggaaaatttgtatacatgcttgccaatatgtggtgctttagaaattacaaataatatttcttgtattggcaagatagaaactccgtatcttttaatataatactatttttggcttctggagttaagtcatttgaatttcctgtgggaaatcatagagtcaggtttaccatgacagtttaaaatctgctacacactaatggaaataacttggtaactcacggcaagtacaaacagatatgaagcagctgctatatgccaggcactgtggccctggggaacaaagataagcaagacacaaatcctgcccttaaaactcagtctagacaatgtcagtgtttaattctgttgggaaaggccaagtcgtcaccttctttcttcttcttctttctttcttccttcctctttccttcctcctaccttcctcccccttttctcctcctcctccttcttcttcttcttctttctcctcctcctcctcttccgcctcttcttcttccttcatcatgtctgttacagcaacaggcatttccattcctactgcagctacctaaggtttagttcctaatgattttatgcctggattattgtgatccttccctaatgaattcttttttacttaccatcttttcctgggctttcctttaatctagccagctggtccatcctgcactttgtcaccatattaatcttcttaaaatgtaattgtaattctttcacttcctactcaaaagccatcaacaacaaaccctgccttttatttccactaaatctctgtccacttttcccaccttgcctctgctactcttcatgaaccctacattctagccagactggtcttattcatcaacacctgagtatgtctcttgcattcccacttctgctcttgtgttgtcagttgtcctcctacccacctttgtcttgcccatctaaatcctgtgtcccacatggataagtgcaggtctttatgaggctttctttgatatccaaagcccacaattacatattccctacttaatgcctttggaatccattatctataccaattatttgatttgggcatttgctactttatatttcaacataggtcataaactctttaaagatcagggcatcttaaacctctttattccccctacattacctaacacagcacattgtacctagtactgccttatatcatactaaaactggaagacaataattagaaataatttaatccacctcttcgatctaataacatccatattatttattggctgtagcactatctccctgacaaagacctaggccgggatattgttatcctggagttagtatttcattttctctttcttttctcaattcagcaaataattattctgtaggtattgtttgtacagagtgatgctgggaattcaccatcccttcttttaatgttgatcctggatacaggggcatagaaggaaaaactggaaagtgaggaagttcatcttgagagaagaccctgcctacctgcactactatgaccctgctggggtaaggtcctgtggttcataaatccattcaaataaataaatccactgcatttataatctgggcttcctattcccctctctactctgttgatatcccctttttctctttactggcccacttttttttctcccattctcctctacctttttctatcccctttcaatgcaaagatctgagatcttgggcctctgaggtcagtataagcttagggatggaacaaaatatcactatattataatttatttggtcaactcaacatatttttccccaatctgatattttcaggggaattaaatcagtccatggtttaatatgcataaaggtgataattcctcatccaggtcaacttggatgagggtattgtttaagtccagcaatttgggctgttgattgtcgaagaggactttttccaccataaaatgaaccacttttaaagcatgaagacaactctgggtagggtgctcaccctccgcttgcagcactgggctatttgacttcccctgggtggttatattgctgcatcaggtgcatgggaccaaagagctctggaaacatgtagctcttttttagtgggatacagtgacctcagtgtctccacctctcctgtcacttttctccagattgaagtccagatcgtcttgcattttctcattgagcctcctggccccactgaagcagggtgtggaggatctggaaggaccttagatctgtcagcagtttttctttaatctccttctgctcttacttattttggggggccctgatctatattagagtgagtctggctttttcaccaagaggatgaggtctatctatactctgcattttggaaacataatgaacaactcctttcttctttaggcagaagatcccctgggagcaattcacttgagaggctgtgtggtgacttcagtggagagcaactcaaatggtaagatgaatttctgtgtgagagaggtgggtctgctcagactcccctcccacacctggacatcctgggccaacattaatcaatcaatcaattaatcaggataagcaggaatggggcaggcatggtggctcccacctgtaatcccggcactttgggaggccgaggagggcagatcacttgtgatcaggatttcgagaccagcctggctaacgtggtgaaaccccatctctactaaaaatacaaaaattagctgggcatggtggcacatgcctgtgaattgtttgagcttggcaagttgcaatgagctgagattgtgctactgcactccagcctgggtgacagagcaatactctgtctcaaaaaaaaaagcaggaatgaatttactgtctgaaaaccttggagaaaccagagttattttttgtctcccaactgctgtccaggctctccaggccttggggagttggatggctttgtggatgcctcaagcaagtccctgagcaatgctgggaaaactccatcacttcacaatggcttagaagaagagcagtgagggggttgcactagaggaccccagaccacaaggctatgatttggtgcatggaataaccacgtgggtgtagtttgacttctcaggtgctgaggacaaattgtatctctggggtgatgtggttttgacatcccaaaccctggttttgtcctgacattttggtttgtagtatgataaaggctgacaggaaaacatcataactgcaaatgcctagagttttactgtgcctgaatttgcccacctccactcccaccacctagaattatactttggttttagggcagggagcatgctggttctttatttgatttgtgatgttttaaatcttgtcacagtattggccaggttattgccttttagtcttcagcagaactctgacttagtgcttgatgaaaaacagttcaggctataacttgtggtactgttggtaggtctggctttgtgtatgtatataaacatatatatatatacacacacacatctgtattataaatataaatatataaatatatattataaatacaaatctatattaacagaaagacagatagataggtagatatcaggagcaacccttgatttatattatgagcagagggaaggtacccattagaaactattagaggttactcattaaacgctgttgctatacaaaggtgagaaatttagtttgcctgtaaactatgaaagaaaatgtttctccttaagtgttttacctatttcttaaaaatatatatatacacacagtcatactatgtatctactctatcaatactatgtatataactgtgcaatgaattatcctataatcataccttgtttgtatgtttgaaagccacatagtcaatttccttagaacacgaagaaaacagagatttcatggcttgcagaggagggtggagcaagtggtctttctgatgcctgtgcgtgctgccatttgccttctctttccccaggcaggaagagtgaggaagagaacctttttgagatcatcacagcagatgaagtgcactatttcttgcaagcagccacccccaaggagcgcacagagtggatcagagccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaactagtagattcctgaggtccccctagcttaaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacctggggaggccaggagtagctgagggtcctttctgtgcccttaaaccgcccagaggagccctattccactctggttttaggctgatctgagagggtctccctttgttcctttctggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctatgattaaccagagtgatctaacctagactaaaattgggaacttatttgcaatttttgaccctgaccactaactagtgattcttctccaaaattgagaaagacagcacccattgaagcagatatgtgtgtgaaagtatatttttcaattccagatttttaattttaaggctccaggaaagaaaggagagtagaacatttttcctcattttatcaaatcctctcttgccctccctcaattcccctgtaacattcctgaagctgttcccactcccagatggttttatcaatagcctagaggtaaagaactgtctttttctctgattctttaataaattatctttatagaatatgcacaagtttttctacactcagtgttaaagtatttattaatgggaagtcaacttaatgttttgaaataaatatatgactctgtttaatgcatttttggtgtgatgactctgttttgcctcctattgataactctcccctctggccgggcacggtggctcatgcctgtaatcccaatatttgagaggccaaggcgggtggatcacttgaggtcaggagttcgagatcagcctggccaacatggtgaaacactgtctctactaaaaaaaaacaaaacaaacaaacaaacaaataactctcctttcttacaactcagttttatttactaagggtaacactatcttttatttttcatcatctcaatagctttatgatttttaaaatttattttatgttaagttctggggtacatgtgcacaacatgcaggtttgttacataggtacacatgtgaattgttggtttgctgcacccatcaacttgtcatttacattaggtatttctcctgatgctatccctcccccagtccgccaccccctaacaggctccagtgtgtgattttctcctccccgtgtccatgtgttctcattgtttaactcccacttatgagtgagaacatgaggcgtttggttttctcttcttgtgttagtttgctgagaatgatggtttgcagcttaatccatgttcctgcaaaggacatgaactcatccttttttatggctgcatagtattctatggtgtatatgtgccacattttctttatccagtctatcattgatggggatttgggttggttccaacactttgctattgtgaagagtgctgcaataaacatatgtgtgcatgtgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatggtatttctagttctacatccatgaggaatcgccacactgtcttccacagtggttgaactaatttacactcccgccaacagtgtaaaagcattcctatttctccacatcctctccagcatctgttgtttcctgactttttaatgatcaacattctaactggggtgagatggtatcacattgtggttttgatttgtgtttctctaataaccagtgatgatgtgcattttttcataagtttgttggctgcataaatgtcttcttttgagaagtgtctgttcatatccttcacccattttttgatggggttgttggtttttttcttgtaaatttgtttacgttctttgtagattttggatattagccctttgtcagatagatagattgcaaaaattttctccccatctgtaggttgcctgttcactctgatgatagtttcttttgctgtgcagaagctccttagtttaattagatcccatttgtctattttggcttctgttgccattgcttttggtgttttagtcatgaagtcttagcccatgcctatgtcctgaatggtattgcctaggttttcttctagggtttctatggttttatgtcttatgtttaagtgtttaatccatcttgagttaatttttgtataagatgtaaggaagggatccagtttcagctttttgcctatggctagtcagtttgcccagcaccatttataaaatagggaatccttttcccattgcttgtttttgtcaggtttgtcaaagatcagatggttgtagatgtgtggcattatttctgaggcctctattctgttccgttggtctatatatctgcttcagtaacagtaccatgctgttttggttactgtagccttgtagcacagtttgaagtcaggtagtgtgatgcctccagctttgttctttttgcttaggattgtcttggctatgcaggctcttttttggttccatatgaaatttaaagtagtttttccaattctgtgaagaaagtcggtggtagcttgatggggatagcattgaatctataaattactttgggcagtatggccattttcatgatatcaattcttcctatccatgagcatggaatg

SEQ ID NO: 12129 - DNA, 19210 bp, Human
  misc_feature (1)...(19210): n = A,T,C or G
gacctctgaaatgaactcatctagactgctgccatggagatggtgctctacagtagccctgtcaatcgctggctggcttctgcctaggtaagtctgccttgaattcatggtggtatgttatgttacagtggtatccatcttggtacttttgtcctctgcaatggtgagtggtggggagtttgggaaatactacctcttctaagaggtttgtgtaaaccttaatggtgtcctggtaccaccctgtgaatccttctttgtaactaatgttttccaccccagagcctccacattcatgagggatgccaaaaatcgaagaagttcttcgtagatgtacagcccagcacattcacaactgagcattgttgcctgacaattcatttattcaacaatgaatgtttgagtgccatgcatggttttgggtatccacttgtgagcaagatgacctaggtccctgctctcacttggtggaggggtagggaaagcaggtaggtacggagaaggaaagaagatagaactctatgccctgcaagctactgctagaaaactaacacttctgtcttccctcgggactctcctaggccctttcaccacttctcacctctcacccacattctgcactcccagctaaagcagccaaaggactatttgatttggcagagctttcaggcacaaagccctatgttccctctggcccaaagccactactctgaaggctgaaaactgccctttggctcaggttgctgtccagtcacagcctcacagataatttgtgctgaaccttgaggtgagggcagaggccacttctttaaatactttgtcttctctactgccttacatttgaaaagcacaggttggatcaataagtattaaacgtatagcgtattactcctttgaagcctccctgcttgactcctccctttcctgccttctcattccctactttattgcatcacagatacgtaatttattaccaaggatctttcataattccccacccctgcctctttcttctcttgcccacactgtgtgacttaacagagtcaacaatacatataattccaccagcaacaaagaaaataagttttgttttcctattgtctgttttcatgaagaggcccttcttagttaatctgaaagctatggcttataccatagtcctccatcatatctaaagccaggaactagaacttgggcttgtgcttgagtcctgggtaaagaagggttgagtggtgctaattcttggctgtctgggtgctcttgattagtgatagaatcctagtcaacactgtcgcttatccagacccaggagaataaaaatctacttggctctcctactcttcattctggtagcatcttaggccaggtaaagttcaataaatttttttgaattctaagaagtgggaattcctccctcaactcaaaggctatattgtcaaaaactcaactcccggctctgtcgcttcttcactgagggcaatttatctccataatcaaagatgaatacattcagatgaactcttctgtgtgggtttaaattttactgttcagcattcagtcttgctagtaaataagaaaagatgagagaaatggattgaaaactcccacaagaccctctatggaaaaggagccaaaagattgcagaggtatatagaactttagagcttttgagtttaatgatgtctatccctataccttctttctggaaagcagatttttgtgaattgagggcaggaacattacagaactgatgcttcatggctctggaatactaagtcctctgagcctggatctccttcagctctgccacctacctccttgtttgctaaatgtccttagagaagttaggatatgcctggggaaccctgggtcatataaccatgacaactggctgaccctgttgtctctccctctctgccctcctctagctgggaggtggaagcagcattgcccaagcctcccaggagtgacaggaattgtttctgcctgaggagacactctgcagcctgggctctgtgagactgaggtggcggtcagccggagtgagtgttggggtcctggggcacctgccttacatggcttgtttatgaacattaaagggaagaagttgaaggtaagggcctcttggggattttgctggggatgaaaaactctgcagggaaactactgagggagagattctggtatagataccagaatctagaaatagaggaattggataggcacagtggatcatgcctttaatcccagcactgcaggtggccaaggcaggtggatcacttgagcccaggagttcaagaacaacctgggcaacacagtgggatcctgtctctataaaaaaagagaaaaaattagccctgcattgtggtgcatgcctgtagtcccagctacatgagaggctgaggtgggagggtaccttgatcccaggaggtcaaggctgcattgagccatgatcgtgccaccacattccatcctgggcaacagattgagaccctgtctcaaaaaacagatagggagagggggagagggacagacagagagaaagagagaaatagaggaattaacccagagccttttcaaagatgaaacctttaacttgtttatttatttttttagagatgggcatctcactgtattgcccaggctgatctcaaactcctgggctcaagcaattctcccatgtcagcctcagtagctgggattacaggtgcttgccagtgcacccagcttgaaacttcttgttttagtctcttttggaccctcatttaagagccttaagattttatctaaaactttttatctcttatggctacctgcattttttatttcctaacctgaactcctttttttttttgagacagagtctccctctgtcacccaggctggagtgcagtggcaggatctcagctcactgcaacctccacctctcaggctcaagcgatcctcctgcctcagcctcccaagtagctgggattacagctgcccaccaccacgtctggctaatttttgtatttttagtagagacggagtttcaccatgttgcccaggctggtcttgaactcctgaactcaggtgatctgcctgccttggactcccaaagtgccgggattacaggcctgagccaccgcgcctggcctcttaacctgaactcttataggaaacattattcttggccgggcatggtggctcttgcctgtaatcacagcactttgggaggccaaggtgggcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccaacatgatgaaaccccatctctactaaaaatacaaaaattagccagtgtggtggttcatgcctgtaatcccagcactttgggaggtctaggcaggtggatcacttgaggtcaggagttcgacaccagcctagccaacatggtgaaaccccatttctactaaacagaaaaaaaaaaaaaaactagccgggtcgtggtggtgggcgcctgtaatcccagctacttgggaggctgaggcaggagaatcccttgaacccgggaggcggaggttgtagtgagccgagattgtgcaactacactccagcctgggcaacagagcaagactccatctcaaaaaaaaaaaaaaagaaagaaagaaaagaaaaagaaagaaacatcagtcttgacaagtaagctatggagcaactcattgctatgggaccctaaggagtggggctattgtgtgtgatattcaccctccaacctaatgccttctgttcagggcaaatgggcccccaggcagcctgggcctagttggtggccatgagaggtagggaagtgacccagtggagctcaagcctgagggcttctgatgggacctgggactctgttttgcagcttgaggagcgaggatggcagtcaacaaaggcctcaccttgctggatggagacctccctgtaagtaacttgggctcatctgtgacaggggatggacaactgagggaggaggaagaagcagggaggggagatgcaggggacttagagcaagatattcccagattataatcctagttcattgactaccatggcttagttattcttgccctcaccaccttttgtagggggcagttggaggatctgggaggggaaaaaaagatgcctattaaaaattaagcaccttgaaaaaaagggacagaaatcctggcttagggacggggggagtggagaggaaggaaactactgtttaaaccctgacgcagaagcccatgctctgtccaccacccagctggatgtgcattcagtgcagagccactgtattctgtgtctccagcatcattcataacggcaaatgtcacctgtcggagttagacggtgcacagcctgtgctgctgtgtggggggaagggtgggatattccatgtgtctggtgttctatctctgacctggttttcactgtgacttgaagtgatttgatacttttagggatgcttgatggctcctggcaaggcatctcagatttgggcacagttcggatagtgaaacttaaaaattatgaacctgtgcaatatccaccttgcccaagttacgcttttactaactcctgcactaggaatcactttgttttgtattgaatcatagaacagagagaggcgtaaaatggtcaagtacatggttaagccattctaactgacggtggtttattcccttcccaggatctctttcctccttcggttttgtgtaaaacaacctctgaagcctcgtccaaaatgttaaaaagaatgttttcttgtttatagtcatagtctatttctagttcaaatttcaaattcacctgcaggataaaaaactaagatattggccaggtgcagtggctcacgcctgtaatcccagcactttgggaggccaaggcgggcggttcacaaggtcaggagatcaagaccatcctggctaacacagtgaaaccccgtctctactaaaaatacaaaaaatcagcggggtatggtggcgggcgcctgtagtcccagctacttgggagactgaggcaggagaatggcatgaacccaggaggcagagcttgcagtgagctgagatcgcgccactgcactccagcctgggagacagcgagattccatctcaaaaaaacaaacaaacaaacaacaaaaaaaaactaagatattgtgggctgctctgtcttagtgtacatgtaggtgtcattgatgggggtctttgaactctgcctcctactaacagaacaggtcaggtcttcactttgcgagcaaaaccatgccacagtgtcatattcaaagctacagagagcctgagcatcggaatctgacctgggttttttttttctttttacttttgatatggagaattctcaacattcataagaatagacagaaaagaacataggaagccccacgtaccctttattagccccgaagaccatgaattcgtggccaatcccgcctcgtcctcacttccattaattcccccacttcatgttattttgaaggtaatcccaggtaggccatttccaacttgtgttggaatcctggctctgccacttatcagctgtgggatcttgggtaaatcacttcctgtttctgattgtcaatctcctcatcgactcagtgttggtgacagtgctgaccccagaggatggctgttagaattaagtgagctcatgtcaccaaggcacccagaccagtgcctgcagcataatggcacctggcaaatgttctttccctctgcatgcctagaatttgttcttttaattttatttatttattttttagatatagagtcttgctctgtcaccccggctggagtgcagtggcattgtcatagttcactgcagcctcggactcctggtctcagacagtcctctcacctcagcctccccagcagctgggactgtgtagtccacatgccatcaaatattagcatggccagcttttttttttttttttttttttttgtggctcagagtggtctcaaactcctggcttcaaatgatcctcccgcctcagcctcccaaagtgttgggattacaggcatgagcttctacacttagccctagaattcattcttttactcaaagaccagtgttttttcactaaggttcctaggtgacctaaaacttaattatgtgactgctgccaaaggtgcattactaacagcacagcaccccggaaatgataaacgattgttccactacacccagcacgtgcagatcgcacccagagtgctgtctttgagtgttgtttgtttgttttttgttttttgagacaaggtgtcattctgtcatcgaggctgtggtacagtggcgtgattatggctcactacagcctccaactcccggactcatgcgatcttcccgcctcaggttcccgagtagccgggaccacaggcacacagcaccatgccctgctaattatattattattatttattatttttttttgtagagacggggtctccctgtgttgcccaggctggccttaaactcctgggctcaagcgagggtagtatatttttaagaaagataatgtaaaactgtagcatgtccaggagagggggtcaccagaccacagtgtgaaccatttgtaaacgaagttaggaactggagccatttaacatgatggcggcacttctaaagggagacatatttgacttcaaatatgtgaagggccaacccatggatgaggaaataggtttgctcagttttgttccagagggcagagtgtggaacaggggggtggaggcaaatttcagctcagcaaagctgtccaacaagggacacaggccactttgtgagggggagagctctcattcagggagacattcaaatataagtcttggctgggcgcaatggctcaggcctataatctcagtgatttgggaggctgaggcagaaggatcacttgagtccaggagttcaagaccggcaagacccctcctctacaaaataaaaatattagcaaggcatggtgtcacaggcctgtagtcccagctacccaggaggcacaagtgtggggactgtttgagcccacgagttggaggttacagtgaactatgatggcactaatgcacttcagtttgagcaacagagtgaaaccctgtctctataaaaaataataaataaataaaaacaaatacaagtcgaccagaggaaggatggaaaggattcttactacaaagtcccctaagattctgtgattctgtgcagttgggcagatctaaacctacacattctactaggcacagccctgactgtggttcacgtattcagctaatattactgtgccatgtttggcctacactctggggatgcagagatgacagtctacggggagtgagatgaacacacataaccacagcacggtgtgacgaatgtggagagagccagggagggagtggtttccgacgtgatggaggagagtctggaagcttcacagggggagtgctggtcaagcagagtcttgaaggaatggcattctgccaggcagcaagggctgtgggagggaaggtgagcattctaggcagtggggtcgggatacacaggcagggaggcagtaccccagaaagaccagaaaaatgtttggagaagccaccaatcaaaggtggactaaaactctagacattaacaacacttgctctctaccagtaggtatcaggggagtgagctgaggtgggggtgggagtgatgggatctgacttggtccctggagaacagagattgccttggcagctctccagcaccccggatggtgaccaggaggacatggccggctgactcttgttttccccatgggctctcccacgctcccatgattggggcatctagagacctctttggccttggttcctcccaggtcgcttggactcaggctagttgcaccattggtccccatgaccccggggtcagcttcccgggaggctggagagggaggtgggacaacttgaatgtgttccttccgcaccaggagcaggagaatgtgctgcagcgggtcctgcagctgccggtggtgagtggcacctgcgaatgcttccagaagacctacaccagcactaaggaagcccaccccctggtggcctctgtgtgcaatgcctatgagaagggcgtgcagagcgccagtagcttggctgcctggagcatggagccggtggtccgcaggctgtccacccagtgtgagtccttgcggcgctcagcagctgcctgcttgttcactgcctaccttccagtctgtctgtccgcctctcagtctgtctgactgtctgataacttgcttgtctgtctgcttaactgcccacatcccattgcatggtcttcttatctatggctataaaggtatacatacagatctcttttcttctatagatgcctatctatggcccagctggcattttcctaggataacaatgatggccagagaatctgcaggggaagggaaggcagagctgtgcaggcagtggtgagggtagggcccatggcagaccagacactcactgtcgcagcacaggcagcagcagcagcaagaaccagcagagtctggcagaggcagaggcagccggcactagggggcctggcagggccggagggcacggagggaggggaaagctggctgagcccagcagctgatggtagcggctcatgacgggtgggggtggcagagagcctccagccagggccctagaggcagaagatggctctcctactggccttaccagatgtgcaccactcaaattgttctgccccatctgaaaatgtggtctccaaggcatacacagggctgagggaaatcgcagcaatgccaaaaagtctggtaccttccaccatcctaattacagaattatgggtagctgaggactccacacagcaaacaggagaggaccgatgtgaagtaggcccaggccctgtccctggctacaatctccttaaatagtttccttgagtctcattctgcccaactggaagacagccaagtcatctgggctctctgctgcttgagaattttgtgaagaaaaataaggtatctggcaaaagaatatatgaaagagtatgaagaactctccttgaaagctgtggcccccattggccatggctgcagagccgatgtcccggccaatccaggcgggatccccttgaagcaggtgcatctctgatgcatgcccactctccgggggcaactcttttcccttccctgtgaccctcttcggacagttgaccatctcaacacctagtggttaaaaagaagagcatggacggcctggggcctgcactggctgtgctgggagtttgtcatgttgatagctaagcaggcccagccccaaggcctcactgccatctgcttccctctcacacctctcttctccctcctcatgctcactcagagcccccttgcaggtcaggaaggaagagaaggagggaaagaacggtacttgttggtgattcatatagctcccatcattcttcttcacaaaaatcctgccaggcaggcaccattaattcaccttttacaaggtaggaagcagaggctcagacaggctgtgactagctgaggccacaggcttcttagatgtggtcacttggccttttgagtgcaggtctgagcgactccagagttcccacacagacagaagaaactggcccgggtcttgaggagtccctgcagacaagggctaaagagggcaaagggcctggggcccagagatgctggggaggcagcaggccttgggatttgagggctccaagtcacttccttggcacagaagccactgctagattctcatggggaggggcagggctcacccaaacttggccctttccttccagtcacagctgccaatgagctggcctgccgaggcttggaccacctggaggaaaagatccccgccctccagtacccccctgaaaaggtgagcccttcccacctctcgaagcctccctgcactctgtcgtcaccgcctctcagggaggagagggcaggggctgctgatgccgtgactggaagtctgtgtcccatggtgagcaccctccaaggctggcggagagtgcctgctcccaaggccacacaacaggctcctcttctccctgtgaagctaaacggaggtggggtttctgggaccagcaggcacgagcccagaggcaaacccaaacaggagcttgaggcgggtcccactgcctcccgataccgcaccctgggatctgaggttccatagtctgccctggaccacttggcaactacagctgcctaagatcatgagtcacactcattcagatcccaggagtgtcatcccatatcctcaagatccaaccttttatggaccatgagattgaaggtcactttacctggctacatatttattgggtagttgctatgataaggactcatttttggtgcttctggggaataagcttcagtctctgacctcatctatctcactgaccaactatctacccttcccacaaacaggtactgagccctaccctatgcccggggccatcacctatgctttatcaagcgctcttctttaatccacttgtcaaccctctgggataggggttgttatctccattttacagagaggaaaccagtgtctcccccacggccacacagccttaagtggggacaatgagagcaggtctattcagctgtgagacctgtgctctttgctccccatttttccagataaaaggcaacatttttgtcacaaaagagctcccagaataatgaagaaaaagacaaattatttcagtgcagaacttgtaggaagatcaagcacacctataaatcaacagaaatgctgtgttctgaggaaaggatggaggagattccttgtgagcccaagggtatcaggacaggtggcaccaaggacgagcctttggggtcatcctcacaggatgggagggatcttgacaggctgtgatgcggggtgaagaagccaggagatccaaacagttggcacagggaaggttggagccctctcctctaaagcccagcttaattccaggtacctaaatatcagtaccagttccctgggcctttaggtgatgccttcctgggagctgggctcaggccaccagaccccggaagggcagcccttgtagggcctgcaagaccacatgcctaacacccccaccaacttcccccagattgcttctgagctgaaggacaccatctccacccgcctccgcagtgccagaaacagcatcagcgttcccatcgcgagcacttcagacaaggtcctgggggccgctttggccgggtgcgagcttgcctggggggtggccagagacactgcggaatttgctgccaacactcgagctggccgactggcttctggaggggccgacttggccttgggcagcattgagaaggtggtggagtacctcctccctgcagacaaggaagagtcaggtacctgccattcggaggctcggcctgggagtgagttgtcacacacactgcctgggaatcagcaggaggtggctcatccagccactgctctggaatagggaaggccagtgggattttcagatggattcataatcatttaccccccccacccccaccccatctgtaaagagggaaagtgagttgtggaactcaccagtgagtttgtggtggacctagaacacctactttccagtcctagacatgacccagatctctccggcccctctctgacctgttttctcttctttccccccaaatccctacccagcccctgctcctggacaccagcaagcccagaagtctcccaaggccaagccaagcctcttgagcagggttggggctctgaccaacaccctctctcgatacaccgtgcagaccatggcccgggccctggagcagggccacaccgtggccatgtggatcccaggcgtggtgcccctggtaagtatctgccgtgagctctgactgacccggtgcctgggagccctgtgggcctcctagtccctcccatcccccacccatcaccccttcctgtcctgagaacattctctcttccaacctgggctggggcttcagttctaagaggacttgagaggggtagagggatggccttccagaccacagggaaagagaagggagaggatgttaagcaagggcaggcctgccttgctagagtgctccttccccaccactcacttctatctcccccatttccctctgagtctcccacaagccccagccttcatacccccaagtggacctctttctatgggtcttcccacctataagacagcaggacctccatctgctatgcaagcactagggactgtcatccttaaataaacaaagtatacaacccattttgtcagggagagtgtacccagcaccaatgcacccaaggtgaagttgccctttctaggcccagggagagttaactccccaccactccccaccactccccacctccacctctctgtatcttagcagaaataggctggatgtttttcataaggaattttagtaagaagctaaggccagaaaagaaaataaaacaatattaaagcataaaggccagcaaacaagatgactacttttcagccatcttttgagcagtacttttaaaagcatcatcaggcgtggatcattcattcaagcaagtgttgcccctgcaggaatacaggagtagtagctcccctctgtcccctgcatcaataacagctgagactgagtcacatgcctggaccccgcctgcagtgggcagaacctcacgtgccaccattcgcatggaatagagtggcatccccaaaagctgtgtaataaggagtctctgtttgtggggctccctagaggtttagaatgtgcctcaggagataccagcccccttgctcagtcaatttcttcccatgggacactctggttcattgaatttttcacgcttaaaagatctgggaggagtatctaccaaagctaacatacatatatcctatggcccagcagttccactcttaagtgtatacccaacagaaatgagcacttaagtctcccaagacaagtgaaaaatgctcagatcagcaatatccttagctaagaactggaagcgatgataatgtccatcaacggtagaatgggtaaattacaggaaattcgtatgatggaatattacacagaaatgaaaaagaaggaactacttccatttgcagcaacatgggtgaagcttacaccatcatatttaactaaaggagctattaatagatgaatacacatggtgtgactccacttacatgaagttcgaaaataggcaaaactaaggcatggtgacagagagcaggactgtggtcactcttgggggaatgtggactgagtggggacacagggagtctttgggtgttgaaaatggtctatgtcttgatctgtggtggttacacaggtgtgttcttataaaaattcatagagcttacactaaagatgtgtgcactttagtgtatgtagattaccactccataaaaagtttccagaaaagtctgctggggctgagccctgctcaccacctggcccggaccctgggggcgaggggcttgggctgctggggctccctggccttcagcaggggcagttgagccagcaatctgctgccatcctccctcagagcagcctggcccagtggggtgcctcagtggccatgcaggcggtgtcccggcggaggagcgaagtgcgggtaccctggctgcacagcctcgcagccgcccaggaggaggatcatgaggaccagacagacacggagggagaggacacggaggaggaggaagaattggagactgaggagaacaagttcagtgaggtgagggggagagtgggagcctcaaggtcccccagcccacagaaggggtgagaagcagaggcatagggtgaactcagggcctctgccccagatgcaggggcacggcatgtgcgtgcaacacccttcaccccacccccaaatgcccagctggcgagggacttccatgtcattctctcagctgacccttgcaacactctgtaaataggcagggcagagattattgtcccattttgcaggagaagaaacagaggttcagagagggaatgtgacctgtccaaggccacactgctagtggcagaataggcctgaagttttgtaaatttggtattctcatgctttcccctctagccctggggctggtggggagggaagggtcaggggagttaccacaggaggcactgaccctgctttggcccccaggtagcagccctgccaggccctcgaggcctcctgggtggtgtggcacataccctgcagaagaccctccagaccaccatctcggctgtgacatgggcacctgcagctgtgctgggcatggcagggagggtgctgcacctcacaccagcccccgctgtctcctcaaccaaggggagggccatgtccctatcagatgccctgaagggcgttactgacaacgtggtggacacagtggtgcattacgtgccggtgagtaccacccctggcaaactgttagtgtcccaagggggcctggacatggcagataaagtagatttgactgaaggggctgcagtccccctcctttcccctactcctctggagaccgccccccactccagtcctcagtgccctggcaacattttaacatactgggcctctcccagccccaggagtatagaggcccatggctctggcctgaggcctctccccacggcccctcccacctgctggtagaggagtctccagccatcagtcccaggatcccagtggctcaccttcacccctttgctctcaactgaagggctgggcgggtttgcatgctgctgcctgggaaggggttggagaggcttccagggcaccctgaggggtgggccatgagttccaggggacagcagcaggctccacccaattctatcacctgtcaccaataggaaaaacccaggggataccaatgccatccctttgggagcccctttccaaagcaggttacagattatgcaggcctggggggcggggctggtcagggcagaaagcacccttagagctggtaagggggtgggttactcagtcactctaccaagcagcatgccagggatcttagcagcccgcctgttcatcctgcgctcgggccagccccaggaaggtgtaccggtccctggccaggtcactgtgtgggctgcaaggaagagttaggaaagctgatgacctcccattgagggttcccctcaggaaggcctaggggatcctgaaactttgggaggcttggcttgcctgagcagcctggtccatggagaagctcagagtgggcaggacctcagggctttccccggtgccccccaaactactgaaccgctccccagcctgtgtcctcctgacggccgctcccgggggaacaatcgaggggcccgggaaggggcggtgggtcagaggcgcagggcccagggccaagccaggactctaaggcggctgccgggccctcagctccccaggctgtcgctgatggagcccgagagcgaattccgggacatcgacaacccaccagccgaggtcgagcgccgggaggcggagcgcagagcgtctggggcgccgtccgccggcccggagcccgccccgcgtctcgcacagccccgccgcagcctgcgcagcgcgcagagccccggcgcgccccccggcccgggcctggaggacgaagtcgccacgcccgcagcgccgcgcccgggcttcccggccgtgccccgcgagaagccaaagcgcagggtcagcgacagcttcttccggcccagcgtcatggagcccatcctgggccgcacgcattacagccagctgcgcaagaagagctgagtcgccgcaccagccgccgcgccccgggccggcgggtttctctaacaaataaacagaacccgcactgcccaggcgagcgttgccactttcaaagtggtcccctggggagctcagcctcatcctgatgatgctgccaaggcgcactttttatttttattttatttttattttttttttagcatccttttggggcttcactctcagagccagtttttaagggacaccagagccgcagcctgctctgattctatggcttggttgttactataagagtaattgcctaacttgatttttcatctctttaaccaaacttgtggccaaaagatatttgaccgtttccaaaattcagattctgcctctgcggataaatatttgccacgaatgagtaactcctgtcaccactctgaaggtccagacagaaggttttgacacattcttagcactgaactcctctgtgatctaggatgatctgttccccctctgatgaacatcctctgatgatctaggctcccagcaggctactttgaagggaacaatcagatgcaaaagctcttgggtgtttatttaaaatactagtgtcactttctgagtacccgccgcttcacaggctgagtccaggcctgtgtgctttgtagagccagctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataataactactgcataatatggatacgccttatttgatttaactagttccctaatgatggacttttaagttgtttcctttttttttcttttttgctactgcaaacgatgctataataaatgtccttatcaaaaatgtctagtgtacatgtgtggctatgtgtatatatatatatatatatatatatatgagatagacgcatgacttgtaaccatgacatactgggtgaaagaatatgtgcattttaagcattactagataataccaagtagcctgccaaaccaaaccctatttttctagttattttcacctgcagcttcagaaatatgcacagaaaattatgagtcttcagtcagtccttttacacatccatatatttatactcatcttccacaggtccccctcagacacataagcacccactctattagctcccactctattgcacacctggaagccccgctccctgaaactgactctgtggccctggaactgactctgtggccctggaactgactctgtggccctggcactgactctgtggccctggcactgactctgtggccctggcactgactctgtggccctggaactgactctgtggccctggcactgactctgtggccctggaactgactctgtggccctggcgctgactctgtggccctggaactgactctgtggccctggcgctgactctgtggccctggaactgactctgtggccctggcgctgactctgtggccctggcgctgactctgtggccctggcgctgactctgtggccctggagctgactctgtggccctggagctgactctgtggccctggcgctgactctgtggccctggcactgactctgtggccctggcactgactctgtggccctggcactgactctgtggccctggcagatctttggtgtaatgagtcatgggcctttatctgtggttttggagtctgaggatgccaagaatggtgacaggagagaagctggtagatatacacataaagacgtggccaggcccctgaaccagccatggaccctgaccaccccacttgcacgatataaactacacccagcagttccctggggggtggggagggaagatggggggtgaagttggcaagaggggttcttagaagctgatagaacagggctgagcagacagagcccagcacagccttggcagagctcccatggacagatgctggagaaatgacctcaggcctagatgtgcagaaagaaacgcctgcctgtcctgggcctcacccacccatgcagctttcttcctggtgctccggaaaccacattcctagctctttactcctccccggtcctgcggctcctcctgctaggctatactccggaaggcaggaaagctgcctcctcagccgcctgagggctgtggccgccaacatgcctgctggtcaggcccagttccttcacccagccctgggcctgagcacgggtgctggaggccgcatatggaataggacagcccaggaagcaaacagtgtaagttataagtttctttttgctcttagaaacctcttgattaggcagcaaggtacactaaacctgcttctcagtattttgaacacatcttggccagtaacaagggcaaagtagctcctctaaatggcagacatttgcttccttggctctaggctcaatgggggactttcctctgttctgcggggcatcactttggcaaggtccacccatactcagtatcttcagtgtagctcaggacctagcaaagacctccacttcacatcgggttgcccagggtccttcagagaaatacccaatgccttccatcctagcttacaaaacccgcttctaactcagccacagcttttggagatgcaaacaattacagacaataacatacatttatccaggcaattatttaccccttttccctcccataattttattttgagaccgtatcactctgtcacccaggctggagtgcagtggcaggatctcagctcactgcaacctccatgcccccaggcttaagcgattgtcttgcctcagcctcctgaatagctgagattacaggtgtgcgccaccatgcccagctaattctcacatttttagtagagacggggtttcaccatg

SEQ ID NO: 12130 - DNA, 52789 bp, Human
  misc_feature (1)...(52789): n = A,T,C or G
tgggatgcctgcctgtggtcccagccacttgggaggctgaggcgggaggatctcttgagtccaggagtttgaggctgcagtgagctatgatcgtgccactgcactgcagtcggagcgagagagcaagatctcatcagggtttacaggaagccaatcttctccaggatcaaggacatgctatatcagccttctcagcactctttctctcacactggaggcaggacatgccatatctggactttgggtttctctgggacatagtctgcaaattattcctctttgtgaacccacagcccagcaagcagggactggcatagggcaggtctcaatacttatttgttaagtaatggcctggccaggtcaccgtgatcaaggtggagtaggaaggcctgaactttggcacaaaaagaaagaagtttcacatgcagacttcggggagcatgggagtgtaaggaagaaggggatagcacagagctacatgagggcaggggccccagagcaccacagaggtgaggccctcagtcctgcaggtccagaaagagcatgccccttgatccaggtacctggaattaacttgcctctccagggcttgagaaaacctgaatgcaactcgtgaatttcctttgagaagtgttaacttccaacaggactttggggtagtctgggagcaggctatcttccaaagcaagcaaagaaatgaataaagcttccccagctctgcctcctcagccaatcgcctctggcctccgaagccccatcctgccatagcccacttccaggtcccttgtgcagatggctgcccaccatatttggctttcatggactgattctctaaaggcctgggagtactgaccaggctggagggaagggcaggctcctgaggccttacagtccctaggaagttgcgtatctgcccaacccctgctctccaccctgcagactgtaaggtttacaagagccaggccctatcatcatcctttctagtctgtttctaagttggaacagagtacggaatgggtacacaggagccagcacagtggttgcgatggtttaagtttgaagccggggcgctgacccagtgaggtcacctggaactgtgcccctttccccttaccagctgggagtctgacatgcttttccattggcgaagacctagctggctctcccctcaccctcttcatacccgctctccagctctccccctccctcctgcccccaccacctcagatccaccagcctttccagctgtcactcaaggcatcatcctgctccctcacctccagtcactggcttcccaggatctctgaatcaagtccctcctctgcatcccacagccactgtcctagaccagggcacctgctcctaggttgtcagagtgactgtcccatcatgcacagctgatcgtgttgttccctggttccaaatccttcagcaacttcccatcactcacagaactggttcaatctcctcagctaggatcttgtcctagcacactccttgggtatcatttctcatgaattccctcttaaatctgaaaatggccaaaattagttcccaaacaggcttttgcaagagctatcttttctgtttcaagtgtcccccgtaccccaccacctacaaccctaaatccctggtgaatttccactgcttttgcaggtcccagctgtgggctctcctttccagaatgtctccgtttgcaggcttgctcttccattacatctacggctcttagaaagcaggggctgcgtgtggctcatctttgtacgcccagctcccggcaggacgtggcacgaagcagtgccagtgtgaacggatgaatggatcaaagccgggagcagggctgcccccctgcagctctgccctacctctcccgctttaccgtaagtcagcggtaggtctgcagctctccgcctctacctcctccccgctctgggcgtgtctttaaaacccacagtcggcctctctgccccctagaaccgcccccagcttctgtctcacttcctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtatctttgccaaggcctcccagctcatgtggtttctgcttaaggaagcctccccaacgaacccttctcttgccacacctttcctgcccacctcccacctcccccgacaaaggaactacttgggtttcttgctctgctgcctttcaggcccttttactccccttcatgaaagtacagaggacaccgtattacagtaacttttataaacattattacaactaagaataacattacttaacaatactaggtaacatttatgagcacttcaaatgtgccaggtactgtattaagcactttgtttttttgttgttgttgtttgtttgttttgctttgttttttgtttgtttgtttatctgtttgtttttgagacggagtctcacactgtcgcccaggctggagtgcaatggtgcgatctcggctcactgcaacctcctccttccgggttcacgccattctcctgcctcagcctcccgagtagctgggattacaggccacgccaccatacctggctattttttatatttttagtagagatggggtttcactatgttggccagattggtctctaactcctgacctcgtgatccacccacctcggcctcccaaagtgctgggattacaggcatgagccaccatgcccggcctgtttttgtattttacaaaatgtggtaaaatatacctaatggataagttcctatgttaaccatttataagtgtaccattcagtggcattaagtagattcacaatattgtgtaaccatcaccaccatctatttccagaactttttcattactccagaaactctgtactctttaaaccataggggagggaaagatggcttgcctccacccttctagtttccttggctgggctatgaattaaatagcctatgaattaaatagtcataaaatagattaccagcggaaaacccatatttaattacatatgtatactcaggagtcccacaatatatgagactcaaagaaaggtcagatgattgaagcctgtataacatcctgagctacggaaaagagcttggagcttctgggtgatggtgataacacaagttatgggagggtgaggagaggagctgtttggtgaatagaggttgtcttgctatgtagattaaaagttcttagataataaaagttgtctggagcagccctcttttaatatagatcattttactaatgtagattttcttttaagatataaatgcctttcttttttacaaaaggagagcttttcagagctattcctgtatcagcagtttctcagaataaccagcttaaaatatgccaaagaagtatatttcaagagcctcctgcagtcatactttgaagtggtgtgtcctgagccccagtaatgcaacagctcctcattttctccttcccctagcccttggtaacttctaatctaccttctgtccctatgaacttacttattctagatatttcatgtaagtggaattgttaccagtagaggatcttgactgcaaattgttcaggttcttggcattttgaacaaagaattggacaaaatgtacagcaaagcaaggaaagagtgaagcaatgaaagcagagatttattgaaaatgaaagtacaccccacagggtgggagcggctagagcagggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtatttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatgcttacctctttaatgaacccccaaactgtgcattaagcactttatatgaggttggtacttagtgtatctaccttccaaactgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccagtccccacgcaggtggatagtaagtttccaatttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctaggatcagagacaggtagttagtttctgtctgaaaagttgaaaccattaacaccaggcagcgctatctgagaatgtctgtatggggaaaaaaaatcacatccagttgtaattatttttattaaacagattttaactcagttttttaataggtaatacattcgtacagttcacgaacaaaatttgtaaagaggagagagagagtgcaatcttctgtccatgcccaactgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctaaactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttcctttgaggaattaagggactaattaaagaattcaggaacaaattcctcgaaagaaaaaaatgtatgcatttcttttgctcttacaatttatgcagttttaaaacttacatatttattggattttgattgaaattgcaataaattaggagaaattggctttatctctggttctatcttttggatttaaaaaattttttttaattttttttttttttttttgagatggagtctcgctgtgtcacccaggctggagtgcagtggcgcgatctcggctcactgcaacctccacctcccgggttcacgccattttcctgcctcagcctcccaagtagctgcgattacaggtgcacatcatcatgcctggctaattttttggcatttttagtagagacagggtttcactataatggtcaggctggtctcctgacctcaggtgatccacctgcctcggcctcccaaagttctgggattacaggcatgagccaccatgcccagccttatactaatttcttaatgaatttgtaagctttcatgttttgaacgtgataatgcagccatcccacgggatccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacgctcagctaatttttaaattttttgtagagacagggttgcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagatactgagggccaactgtacatataaattgtttagcgtagtgcctggcacatattaaatactcagtgaatgttaaaattctattataatttctctgctctagaacaatttgaagaatataagaaatttaggcttataaaagttttttgaaaaaccatcttggaactggtgccttttttatagtagatttttgggaacttttcccatttttgccatggcattaatctgttttggctcttgtgtcagatttttggaagattttccagttcatcctgagttatctttcattatttaaaaatctcctatatgcctgtaactataccccctttttttatttctgatgttgtatatttgtggtttagcagtcttttcaaagtactgtacttttagtctttccttagattgcttactgattttaatgttttccttctttctgtttgatcattttatttttgtcattttcttccttctaacttttgtcattattcattttctagcttcttgaacttataattcatttatttgcaatctttattgtttaataataataactttttttttttgagaatctccctctgtcacccaggctggagtgcagtggtagatcttggctcactgcaacctgtgcctcctgggttcaagtgattctcctgcctcagcctccccagtagctgagactacaggtgcccaccaccatgcctggctaattttttttatttttagtagagacggggtttccccatgttgaccaggctggtctcgaactcctggcctcaagtgatccacccgcctcagtctcccaaagttctgggattacaggcgtgagctacaatgccctgcctaataataactcttttaaggcataagttctctgtatatggttttggctgtatgccataactttgataacttcattagtgttctcatagtcaatcatttctcaaatttcatttcagtcttttcttaaaaaggttctcttgcttaaggtcaagagttcgagatcagcctgggcaacatagcaagacctcatctttacaaaaaataaaaaaaattagccaggcatggtcggtggtacatgcttgtagtcccagttatttgggaggttgaggcaggagggttgcttgaacctaagaatttgagcctgcagtgagctgtgatggtgccacttcactccaaccagagcatcagaaccggaccctgactcgaaaaaaaaaaaaaagaaatttttttctcttgaaaagttttagagaatagtgttttctaaaattttcaagtggttttgatgtttggtttcttgttctgtcacccaggctggaatgtgatggtgcgatttcatacttgttaatttctgcactatggccagtttatacagtttgtatgagttctacatctaagactatattgagattttcttagcggcctaggatattccttggactcacatattcctagcaataatccttagagttgaaaagttgtatttgttgtacacacatatatatacatacacaaatatatgtatataatatatatgtgtatatatgcatatatctatatgtatatatccatatatatgtaagttctagtgcttgtgtgtgtgtgtgtatctccacgctattgaaactttctacctttctttcttttcttttttttttttttttttttgatggagtcttgctctgtcatccaggttggagtgcagtggcatgatctcggctcactgcaacctcctcctcccgggttcaagtgtttctcctgcctcagcctcctgagtagctgggattacaggcgtgtgccaccatgcccggctaagtttttttttttttttttgtatttttagtagagaaggggtttcattatgttggccaggatggtcttgatctcctgaccttgnnnnnnnnnnnnnnnnnnnntcttgatctcctgaccttgtgatccacccgcctcagcctcccaaatgctgggtattacaggcgtgagccaacatgtctggccgaaactttctacctttccttccattctgtttcaccagttctctaaatgataattacagagtggtaacttccccatcaaaacatatatataggccagatgtggtagcttccacctgtaatcccaacactttgggaggccaaggccggtggatattttgagcccaggagtttgaggccagcctgggcaatatggtgaaaccccgtctctacaaaaaaatacaaaattagctggacatggtggcacatgcctctcgtcccagctattcgggaggtggaggtattcctcagagaggatcacctgagcctgtccgttcaaggatgcagtgagccatgatcacgccactgcactccagcctgggtgacacaatgagactctgtcttaaaaaaagaaaaaaagtgggccaggcgcagtggctcacgcttgtaatcccagcactttgggaggctgaggcaggcggatcatgaggtcaggagttcaataccagcctcaccaacatggtgaaacctcgtctctattaaaaatacaaaaattagccgggcgttggtggcgggcgcctgtaatcccagctactcgggaggctgaggtaggagaattgcttgaaactggaaggcggaggttgcagtgagctgagattgtgccactgcactccagcctgggcaacaagagtgaaactccatctcagaaaaaaaaagtgtatacacacaccaacacacacatacatgcacactctagaacctatctcatctatcaccacaaagagtagaatataactattcttccagagaaaataaaacatttagcacacttttatagtttttcttcttccctcttccttctcactttcagatttagttgaaataatgtgaacttttagttccagattactaccaaattgttaatttttttttcttttgtaaacatcctttctgaacaggtattaagcttcatggtcatattacaacgcacttgttagccataccttatactttaattggtttcattgctcatgataagttttcctatagcttttcttctcctttcttgaattatttaaggtgattaattttccatttggcaggaatactccatcaagtaattaaaaaaattattccagagtttactttctgagaccttaagtgtctttacttgtatgtccttcttttgctgtcacatgtgagggaaagttgagctaggtgtaaaattctgaggtcataatcacagtgctttcacctcagaatatataaaccttgcttcataaatttctagtctctggtgttgtagatgagaagtccactaatggtctattttttctctgtgagtaatctgtttttgtttgttaaggatctttatttatttttatttattttactttttagagatggggtctcactctgtcacccaggttggaatgcagtggtgcaatcagagttcactgcagcctcaaactcctgggctcaagcaatcctcccaccttgacctcccaagtagccaggactacaggcacctgccaccgtgcctggctaataaatatagttggatggttttcatttgtttatttgtttgtttagagataaggtcttgctctgttgcccaggctggtgtgcagtggtgtgatcatagctcactgtaacctcgaactcctagactcaagaggtctgctagccttagtctctgagtagctaggactataggtgcctgccaccatgcctggctaatttttaaaattttatgtagagatagggtctcactatattgcccaggctggtctaaactcctggcttcaagtgatcctcctgccttagccgcccaaagcactgggattacaggcttgagcccatgcccagcctgctaaagatctttatataattttttcttttttcaataatcttctatcgccattgttgatctgaaaaactcaagtctttcttcagcttttcatctcagggaaattgtattctgctttttaattttttttttttttttgagatagagtattgctcttggaatatagtggcatgatcttggctcattgcaacctttgcctcccaggctcaagcagttctcatgcctcagcctcccaagtagctggaactacaggaatgcgccactacacctggctaatttttgcattttctttttagtagacacaaggttttgccatattggccaggctggtcttgaattcctggcctcaagtgatctgcccgccttggcctcccaaagtgctgggattataggcgtgagccactgtgcctggccatactttttaatatactgatagcccttcatttgtttattttattttttatttttattttttgagacagggtctcactctcacccaggctggagtgcaatggcacgatctcggctcactgcaacctccacctcctgggttcaagtgattttcctgcctcagcctcccgagtagctgggactacaggtgcgcaccaccatgcccagctaatttttgtattattagtagagacggcgtttcaccatattggccaggctggtctcgaactcctgacctcgtgatccacccgcctcagcctcccaaagtgctgggattacaggtgtgagccactgcacccggcccatttgtttatttttaaaatttttactactgttgttatatggatattggaactccaagaacatattttacatcttttaaattttttccccattaattctgttgctttgctttttttccccgagattctcagagagctcctcgaattgtttttctaactcgccagctcatcttttcgccgctgactccattcttctatctgctacccctgtagagttgttgtgggtttttttccccccagcaatcttttttttttttaattgccaaaagagcttaatgctctcaggatgctttttcttggcagcctgctcttgttttctcattgtagtgtgttcttaagtctccctgaaaaacacagttggcatttacagaggtgtatgtttcctacacgatccccttttcaatgggtacttgctcagtttggctgctgattctcttcataggtcctgcggtctgtgctatctgctcccatgtaaaagttgacatctagattgttcagtgtttgtagctagcgtgggctggcagcaattgtgtaaagcacaatttataccccacattcaatccctgcagtggaacagggccgctccccacgagccccagatggtgtcagcttgtaagtagtcccacctctgctgtgggggtcagaggtggatttctctccattagggatagaaaaaaaccttttgtctgtacccattttagatgtccagctaggtccctgtaaattagactaacaagatatagattaacacgagaaaagcaggctgggtgctgcggctcacacctgtaggcccagcgctttgggaggctgaggtgggtggatcacctgaggtcaggagttcgagaccagcctggccaacatggtgaaaccccatctctaccaaaaatataaaaattcgccaggcatggtgtcacacacctgtaatcccagctactcaggaggctgaggcaggagaattgcatgaaccctggaggtggaggctgcagtgagctgagatcacaccactgcactccagcctgggcgacagagcgagactccgtctcaaaaaaaaaaaaaaaaaaaaaaagaaagaaaaacaggagctttttagcatgtgcatctagcatgggtatcacatctagcatgggaattgtgcatatacctgggagtatccagagatgagtaactcaaagcgttggttagaacttcagcttacatagcatcttaatgaaagagaaagaaatgtttagagaagtggcagggtaaaagaaaggggttttaggcttgcaaaggtggcaaactgttggaagttgtgtttctgttttgcattgctagaaggaatacctgaggctgggtaatttgtaaagaaaagaggtttatttggctcatgttctgcatgctgtacaatcatggcaccagaaacctgcttggcctcaggtgaggctgcaggtaggttttactcatggcggaaggtgaagggggaacaggcgtgtcgcatggcaagaggggagcaagagagagagaaggaggaagcaagagaaggagatgccaggcgcctttaaataaccagctctcccttgaactaccaaagagaggatttactctttaccacgggatggccccaagccattcataaggcatccaccctcatgacccaaacacctcccactagaccccaccttcaacattggaggtcacacttcaacatgagatttggtaaatatatgggaactctaatggagtaaggtttgtttgtgcgggcctacttggtgccagctttccatcttcgtggctgtaaaacttccctgagagaggagatttatggtagttcttgtttctcagaagtttctgttttttgtcataagagcaaagagcgtaagagtcaaaagagtttctgtttttagtcatgagagaagctcttagaaggctcctttctgcgtctgttggttttcatttgcctgcagctcaaaacaatcatatgccaaagtggcatattttggagtggcatatttttatcccttatgtcaggtacaatgggcagggaaggttcagccagcaagagggcaggattcctgttccttgagcacggtgcatggccttaacaaacctgaaaaatcatgtgctcccactcccatttcacattgtttcacaatttaccagtggttactggacaaactcaacttattttttctgcacaaaacttcagtgccataaataagagctcacaactttcctctggtcacaagtcagttagcagccacctcgctctttgaccctgggctgatttagagctcacactggggagcagccccagaggtggctttaaacctgggactcggggtgtctgccctggggtggctgccctggggtggctgccctggggccattggtatttgctccacatgcctgtggagtccattttttcatgttcatgtcacacctactgtgttgcatgttctttactagggggtggggtagaaatatgaatggacatagcccctccttgagatcacagcctggtaaacagatcagccattaacaattgaggcggcagggttccgtgcagaaggctgcatgactttgctgtctattgtgactgcgttttgatagttacctttgtcacactgtcttctgtattatgtttgccctcagcaacatgtcgtatctggcacagggctgacatcctgtttgtgctcagtcatttgtggaaggaagaagtcaggcaggcacaaaggtggctgagctcagaaaaggccacttaccctgctgggatcagctggggaaggtggcttccaagaggccatcacacttagtgtgatgtataaggaaatagaaaggccacagacaggagggactgcacgtgcaaggaaggggcactagtgagtttgcagcatctcaggaactgcaatagaaggttgatgtgagggcaggcactagaagggtgagttggggtcagatgtggcaggcttggaaggagtcaggactctatgctacaatttccagaacactcagtgttctcagctttctcctttgtcatgccttcataccacctaatcttctcaccagtgactatcctctggaagacaatgggaatgggaccctgtggagggctctgttgaaaacccattgatggggccgggcgtggtggctcacgcctgtaatcccagcactttgggaggctgaggtgggcagatcacgaggtcaggagattgagaccatcctggctaacatggtgaaaccccgtctctactaaaaatacaaaaaaattagccgggcgtggtggcgggtgcctgtagtcccagctacttaggaggctgaggcgggagaatggcgtgaacccaggaggcggagcttgcagtgagccaagattgcgccgatgcactccagcctgggtgacagagcgagactgtgtctcaaaaaaaaaaaaaaaaaggaaaacccattgatgggcattgaggagtggtgggatgatcagagcctctctctgcactctggtactttgacaagagtgggcaagtttgggaacagggatatcagtatttctttggctgcatacttatttatatttcaccccattccacggagaatttgaggggatttatcaccagatgtgggatacttatccaatagaaactgaagcaaagaatctggacaagggaaagggagcctcatgagtacactaggtcttaggtccaggtgggggtgaggcctgcaagaatgcagagatggaggggtgtggagacggctgtggtcccacactgccagcacttgcctgaccagacattctcaggagtgcttccacccaagcatggtgtgggtctagggctgcaggtggagctaagtcctgtctgcgtctgggtgtcagatcctaaaatttgctggatggagttggggaattaatccagctgaaagagcttgaaatatcattgaatggaggaaacaaaaggcctattaatcaagtttaagaggtgtgattgaaggattggcacctatccctgcttggtgctctcttggtgccctctgtgaagttagcagtaaattgcattttattggggattgatattattgggattgcttcctggcctgcaaggagcattacatgggcagaagaaaggctgctgccaggagttgggcaacatgatgaaagatgtggacaataaatgacccatttcctagtttttctatgaacttatcttgaaggtagatttatagaataatatgtggataaaaggggttttcctcctggtctcctttgatgttttggagaaagaagcaaggactttatttatttatttgtttatttttgagacagtgtcttgatctgacacccaggctggagtgcagtggcacagtcatggcttgcggcagcctcaacctcccaggttcaagtgatcctcctaccttagccttcctagtttgtagagacgagttttcaccatgttgcccaggttggtctcgaactcctgggctccacccacctcggcttctcaaagtgctgtgattacaggcttgagccaccacgcccagccagaagcagggaatttaaagcagcgcaagccaagatcaggattagggctggtgctccggtctcacttctcctgaaggccaatcgcctctactttctgcagctatgggagtgggctttgctattcagggatggaggcctgggacattttagaacaatttgggttttttagttttgtttttttgagacagggacttgctctgtcacccaggctggagtgcagtgtgcaattatagcttactgaagccttgacctcccaggcccaagttatcctcccacctcagacccccaagtataatagctgggactacagacatgcaccaccatgcccagctaatttttttttttttttttttgtagagatgggctttcattatgttccctaggctggtctcaaactactgagctcaggcaatccacctgcctgggcctcccaaagtgctgggattacaggcgtgaaccactgtgcccagcctttagaacaatttttaacaagacttgaaattaacaagcttttggcatagtggtgcacgcctgtagtcccagctactagggagactgaggtgggaggatcacttgagcctcagaggttgaggctgcagtaagccataatcatgccattgcactccagcctgggcaacagagcgaggccttgtctctaaaaaaaaaaaaaagaaagaaattaacaagcttttctcattgattgctaactgataaaattaaaaactattaatagaaccaccgccagccagccagacagccattgagcaatcacttattgagcatttatttcatgactggtgttatgatagctattgccagatgaaaaagaatgcctgccttcgaagcttgaatttgtggagagtttcagcctatggataagttgcatgtgtgtgcagacttgtactctatggcaagaacccagaggtcccagaagatacgttcagatcaagtgctgtggcagttttcagaagggaaaacttgtatttatgtgggagggtcagggaaaccctgatattttagcatttgggctacaccttgaagggtttatttgtctctataagttgcatctaaaacaaactgtataaattagtgagtttttttagttagtagcttaagcaaaagctggattgatggctgatgtaagtgaataggggtcaagctggcctctgacctgaccaattagatattcagattgtgtcaccaggaggtactttctctgtatttcttgtgacctggctttcttccaagactggtccattcacagaagggtttactcctcatgggtgccagatgattgcaacagctccagaggttacaccctcagccccaaattcaaggggaaaagagtgtgaatctctcccagcattccaagctaaatctcagtgtgtctttgattgggtcaggttcctctccctgcaagggtggctcaggctaggggggttctcagattagcgtaagcctgagtcatatgctcccccaaagctcatggactgagaacaggaatgtgtggctacctaaaggcaaagtccagtttcatattggtacaagaagaaagaagaatgtgcctttaatacatcttagaaaaaatgtccaatagccaccgtaaatgaaagcaaagaagaaaaaaacactccaggtatatggaaggcagtggaacagaaactgaagtgcaggggacaggtttgaagccagcctcaagtgaaacaccctgaccccttggtgcctgggtaaactcttttcaatagaaagccatccttttccaaccaggttagggaatgggctgttcaggctgcatgcaacctttcctgttgacaaagtggagaactatcctgccatttgagatgtttttcctgtgctattctcctaactcccacaccctcctgtaagattatcaggaagagagaactgttccctttgtacaaacaaggcgagaggccagagagttaacaggagcttcccaaaagggagagcttgccagagccggggccagaacaggatgcagggtttcctgattgcagaatgggtgcccctttcctactcctgctggactctacattcaggcagcccacagctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaagaaaaaaaaccccaagacattaagaggttggagccattttgttttttgaaacagagtctcgctctgttgcccaggctggagtgcaatggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggattacaggcgtgagccaccgtgcctggccatttttttgtatttttagtagagatggggtttcgccatgttggccaggctggtctcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaataagcaacttttttttccaggaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacctagcatgctccttcaatctaaaaattatctttatttcaattgcttaaattacttctcctccatcttccttttcttccttctcattttcttctttttcttgctctattactaataatatcacaatttgtaatttattaactttaggtgtgttcagtttattaatataatagtactactaccatttagggtgggggaacttatttacttaatgacttaatgaatgagtaacaaagattagaaccaccatatacattcacttgatacatatttttataaaagtgcttgagaatatcagaattatttatgtcacacaaggagttactgcctgttttctgtgtcaccagattctattaacatttaatgattacctttactctttgaattttgaattttgtaacaaattcctgctgtggcatattttgcaatttggttatgttctgccaaagctgtaacagtaggtgaggtgtttcaaatttggcatgactgaatagaagagctgcccgttctcaccatatgttactcaactcatatattgctatgttatttttaccttactcatcaaattatcttttctcttatacatggctttaattaattgattattttaggtatttccatctctggacatttcatgtactgaaaatagatcagatttaaataaaatagctttataatcagtatttatgtgataaactctgtcttatttcttgcaacatttaccggcatgtaaatccaaattgaatattggttaatgttcagcaatattcaatactatataattgtagtgtattgttatgaaagtcaatgaatttccccccatgatgtactttgttccaaaatttgaatctcctttaataacatataacacataagttgcttaaaaaatttctcactgctgacactatttggattgtacttatgacaggcatactggccatcacctcagcatatgaggataaccatattttagaaataccatgctggtggcactggggagagctgattggagctggagagaccagaggcagggaggcctcttaggacatcgtgctcaaggagataagcaataattgaggcaagaacagaggcagtagcagtgggaactgctgggacaggtttaggagccagcattctgccttaatcatctttacacccttgccgcatgcctagacctagttggtacttagtaattttgggggggtttttttgagatagagtctcgctctgcctcccaggcaggagcgcagtggcgtgatctcagctcactgcaacctctgcctcctgggttcaagtgattctcttaccctcagcctcccaagtagctgggattacaggtgcccgccaccacactcagctaatttttgtatttttattagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgcgcccggccgggcagtggcatctattgattgtatggtttctttcatttcttcagtaattatagtgtctttactatggtgagagtaaatagtccactgtgttttctccttcgagatgtaattttacacatttaactttgtgattcattggaagcatatatgggtatgaaacaagaagcaaggctctaacttcattcctgccccctaccctcctccctagccaatttctctgattccaattgttgaaaacccctttaatgtccatcagtttgggctgctggctgggcgcagtggctcacgtctgtgatcccagcactttgggaggcaggggctggcggatcacctgaggtcaggagatcgagaccagcctggccggcatggtgaaaccctgtctctactgaaaatacaaaagaattagccaggtgtggtggcgtacacctgtagttccggctgcttgggaggctgaggcaggagaatcgcttgaacccaggaggtggaggttgcaatgagttgagatcacgccactgcactccagcttgggtgacacagtgagactctctcaaaaagaaaaaagagaaaaagatgggttgctttctttgttatataaaatattacatttctatagatgccagggactacatcaggcctatctggtctgttctactgatccttctcttgactcttgaactagtaccatattctcttaataatggcatttctataatgtgttatcccttccttacactgattcctcaaacatttcttagcagctggtcatagtggcttaggcctgaaatcgcagcacttttggggccaaggtggaaggatgacttgagcccaggagtttgagaccagcctgggcaaaatgttgagactctgtctctataaaattaaaaatttttttcttagctattttatctgtttgttccttcatatgaaatttagaaacctagccaggcgtggtggctcacgcctgtaatcccagcacttctgggaggctgaggcgggtggatcacctgagatcaggagttcgagaccagcctggccaacatggtgaaaccccagctctactaaaaatacaaaaaaaattagccaggcatggtggctcacacctgtagtcccagctacttgggaggctgaggcacaagaatcacttgaaccagggaggcagagattgcagtgagccaagattgtgccactgcactccagcctgggcaacagagtgagactcagtctcaaaaaaaaaaaaaaaagaaaagaaaaagaaagaaaagaaatttagaatactttggttaagtttcaaaaataatttaaattgccttaaacctgtttattaactcaaggagaattaataatcttataatatttagtcttatctcttagtaggtttttgtcattttctaggtattttgtaccttcttttttttaatttaaaaaaagttttttagagatggagttcttgctgagttgcccaggctggcctggaactcctgggtgtaggcaatcctctcaccacagcctccctagtagctgggactataggcacacaatcatggctttgtagaattttttaaatagctgctgtgaatgggaagatggatttttttcccatatttcttctcatttgctttgctaagatagaattatgctatttttctttcttaattattatgtaatctagccactttggtgagcaatttcttattaagttagtggtgtttttgcttattgttttgagtattccagaagcaaatagatgttatttcgcctttctgaagatacggttaagtctgggttcttgtcacggagcccttctgggcagtttcccacttcacctctgcctcctccaaagtgccaggcacgcagcaggtactcagtgagtgtcctctgaatgaaggtaaaggaaccgcttggctaaggtcattcctggccctgggtggcagccctttgattcaggatctgcacctcagtcttaccagagggctgggggcttttagacccaggtgtctgattcaggctagccacctcacagacacttgccgcccatctccatctggagggaaagcaggggccagtcaccctagggagaccccattcaggacaaaagaagcttagaaaaaggacccagcggaggctatggccatccagaacgtcttgctctctatccagccaggctgcctgaggcgtgcccttccaggcttggaaccctgtctccaaggaaggggatccaacatcagacacagcccctctccccaagtgtccaggatccaaagggggaaaataacaactgtttcttattctcttccctttattcctataccctatagaattgcccacatttattagtattctgttttttaatttcaaaaaaaggaatacattcatacattcacaaggctcaaacataatctaaaaaggtatgcagtgaatgtcttactctaccctcattccacccatcccatagccacttttattaatttgcatgtccttttaatatttatttattcaaatacaatcaactatgaagatattcttatttttccccattcttacacaaaaggtagcatctgatacacacatttctgcaccttgatttctaacttaaaatatatatcataataatacaaatagttagcatttattgaacactcattgtatgccagtcatttttcaaacttttatccatatattaactcatttaatccttccagtactcctattattaacctcatttctccatggagaattttccttatcagtatataaagagcttcctcaatggcttacagctacatagtattccgttgtatgggtggatcataatttatgtaactaattgccttgtgagggacacgtgggtggcttctaattctttgctattgtggactgtgctgcagtgaatatattgtatggatatcatcttgttatgtgtagagatagagctgcagagcagatccaaagaaagaggattgctgggttaaatgcatttgtaattctgatgggtattgccaaattgccttctgtagagttattagttcttttcataattgcttagtatttctaattaaacgtagcattgatgagcactatgtatcagtctggctggctagtaggctctctgttggtggttccagaacaagttgatctcagtgtagtcccagatgagaccctttcttctggcctcaggtgggctgacttattccttttttttttttttttttttgagatggagtcttgctctgttggccaggctggagtacagtggtgcaattttggcttactgtaacctccacctcctgggttcaagcagttctcccacctcagcctcccaagtagctgggattacaggcgcacaccaccaagacttactcttatcactgccggtgagagtaaattacagcaatatttctggggaactaacagtattttccctggtaatatttgaagaagcagccttgtaatggttaagaacatggactctaagctggactgcctgggtttttatattttctttcgctgctgtaacaaattaccacaaatttaggggcttaaaacaatgtaaatgtattctgttatggttctggaggtaagaagtctgaaacaggtctcactgaggtatataaaggtgtcagcaggctttgctcctttgggaggctctcagggagaacgttttcttgcctttcccagcttctagaggctgcccacattccttggtgcatggcccctttctgtcttcaaagccggcaacatcacaacattcccacctctgcattcatcacatcacatctcctctcattctcctgcctccctgccctttcctttgaaaggattcacgtgattacgttgaacccacccagataatctagaataatctctttatctcaaagtccttaattgaataacacctgcaaagacccttttgccatagtaaggtgacatattcacaggtctcaggaatttgcacgtggacatctttagaggccactattctgctactacagtttgcatctagactctaccacttactaatcgtgtgatcttgaacaaattattttgcctcttgcaccagttttctcatccttaaaatggggataataatggtatctattccactggattgtcaggaggattgaatgagtaaatatttgccaatgcttataatagtatctgagacacaataaatgctatggaagtatctgctagctaaaatatattaaccaggccaggcacggtggctcacacctgtaatcccagcactttgggaggctggggcgggtggatcacctgaggtcgggagttcaagaccagcctgaccaacatggagaaacctcgtctctactaaaaatacaaaattagccggggtggtggcgcatgcttgtaatcccagctactcgggaggctgaggcaggagaattgcttgaacccgggaggcagaggttgcggtaagctgagatggtgccattgcactccagcctgggcaacaagagcgaaactccatctcaaaaaaaaaataaccaaataaaaatattaaaatacaaacactttgatctagcaggcctatatttataatctatttcataggaacaaaagcttccatgattaggctatataacttggatattactaaagtgttgtccatattggcaccaaaagaaaaaaaaaaggaaaggaaaacgaaagaaagaaaatgcacaaacaggaaattacctgaatgccagcaaaacgacagtgattgaatcaattgtggcccatctgggatataccagagctattaaagagaatacatctgatctgtgcctatgcacctagaggaatgctctgagtgaaagttcgttgagaggaggaagttcaaagtaattgtatgacttgatttatttctttcttttttttgagacggagttttgctcttgttgcccaggctggagtgcaatggcaccatctgggctcaccgcaacctccgcctcccgggttcaagcaattctcctgcctcagcctcctgagtagctgggattacaggcatgcggcaacacacccggctaattttgtatttttagtagagacggggtttctccatgttggtcaggcaggtcttgaactcccgacctcaggtgatcctcccgccccggcctcccaaagtgctgggattacaggcgtgagccaccgcgcccggccgatttctttctttctttttttttgaacaaacatcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaaggtaagcacgcacgccaccttcctgggcggcctgtgcctctgctgcaccctagggaaggcgagtcagaagagatcatctccatttgacagaaaagaaaactgggtgtttattcagtctttgggggttggtaaggtcttaggttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagagggaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggctcagagatggagagaggtacacttggggtttggagccaaaagcaagcactctaatgccacctccttttcccttctggctgggttcctgcccactgcattcgagagagctctccttccagccgcccctccagggagttgtccagtgctttgggatgccctggaaaataggtatcctggaaaagcaacagggacctcctctctatcactgtcccaggtcaggatgtcccttaccagcatgtccttgacctgcctgtgaccttctttgtgttctacagatgcagctgtatccaagaaagccagcccagaggctgccagcactcccagggaccctattgacgttgacctggtgagatgggtttgaggtctgaaggggtggtggtggggcccagcaggtcaggcaggttgtgagtcctgctgtccctgtgtgtgcagggagagcgtctgagtgagggacagcaagtggctggactggaaatttcagtgagaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgtgagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagagtgtctcagggttcaaggtatccatgtcccatctaatgctggcattccttctgcagcacccctgacctgtggctgtccagctttcatgtacacatctccagggacaggaagcttgctcattctagaggcagctgctcccaactctggactgctctgacttagaaagtgcttttccgagtggaaatgcagtggtgtccctttgacttgccccctttggcattcacaagtatggctcctttccaccagaataagcatcctcggtttcttcctggacttggcatctggtctcttccctagcctagtcactcaggtttgcatgcgcctagcctatcaaggatctggcccaggactggccagtccttcatggacagcaggtcttctggtggtgggtaggggcctagcttttgccatggcatgacccataggagagagagagtgctgtaggttgaggcaatcaggagaggcttcctggaagagacaggacttaagagtctcagagttttagagccaggcaagagcatggagtctaaccccctttttttcacagaggacgaagctaagacccagaaaggatgtgacttacccaaggctacacacagcaaattaggggcaagattaaaagctgactctgttttttgtttgtttgtttgtttgttttttaaatgaaggctcgctctgttgttcaggctggagtgtagtggcgtgatctcggctcactgcaccctccgcttccggggttcaagccattctcctgcctcagcctcccgagtagctgggactacaggcgcgcaccactacgcctggctaatttttgtattttttagtagagacggggtttcatcatattggccaggctggtcttgaactcctgacctcatgatctgcccgcctcggcctcccaaagtgctgggattacaggcgtgagccactgtgcccagcctaaaagctgactcttaactgccttgggtactgcattcctatatacacaacctcaagtaaaaagaggaattttttaatatatgtgtgcataatacaatcacatagtcagaaataaaaacatagaaagtgatcaatagtgtcttactcccactttagcccccagttcttatgcccatataactatcttttaaaaatttcttttgagacagtcttgctctgtcacccaggctggagtgcagtgacacaatctcggctcactgcaacttctgccccctgggttcaagcgattctcatgcctcagcctcctgagtagctgggattataggcacgcactaccacacccagctaattttttgcatttttaggagagatggggttttgctatgttagccaggatactctcaaactcctggcctcaagtgatctacccacctcagcctcccaaaagtgctgggattacaggcataagccaccgtgccccacctcttttttaaattcttatatatccttccagaatgtatgtaattacaagcaaatattattatagatatttgccttttgcattctgtgtttcacaaaggtaggataataccagatacacatggtatcataccagaattcttatcctatcaataggtagagagcttcccgatacctttttgcagctgcataatggaccattaaatggatatggcaggctttatttagccagttccttgttgctgcatatttaggttgttttgctattacaaacaatgctacaatggatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccaggtgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcagtccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtggggtggcagcagctcagatattttccctcctctgtttctcataggctttttgtaatcgtgttataatactttaatggaaaaaaataaatttattattttaaagctataaaaattataaatcagtcattatgatgtgtttttctctactgagccctctggtgtgttccctgttttattaacgtggatggagggtgtgtcagggaggttgggacagaggcagagaagaggccagcccggccttcagggagttcgtggcctgtctggaaagagggtcttttacataccagcagtttgcagagccagacacagaacgatagagcaggaccttttaaactcctttttcaaaaaaaaaaaaaaatgtttaattttggtaaaatacacataatataaaatccatcatcttaaccatttcaaaatgttcagttcagtgtacactaagtgtacaggtctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtgttctcagggttcatccatgtagcatgtgtcagaatttcctttctttttaaagctgaataataatatcccattatgtgtatatgccacattttgttgatccattcgtctgttggacacttggcttgtttccattttttggctattgtgaatctgctactatgaacacgggtgtacagatatctccttgagaccttgctttcaattattttgcatgtttactcagaagtgggatcgctggatcatatggtaattctatttttaattttttttttgaggaatcaccatgctgttttccattttttattgcaccatttgacatttccaccagcaccgtgtaaaagtttccacttctctacagcctcaccaacatttgttatattgtctctctctctttttttcttaaataatagtcattctaatgtgtgtgaggtgggttaaactcttttttgaccactatcctctattgaaaaaaaatatatattatatcttaacttatagtatatacatatgcacacacatactgtagctaaaggagttttataaaataggctgggtccagtggctcacgcctgtaatcctagcactttgggaggcggaggcaagtggatcacctgaggtcaggagttcaagaccagcctgaccaacatgatgaaacctcgtctcttctaaaaatacaaacattagccgggcgtgatggcaggcacctgtaatcccagctactcaggaggctgaggcaggagaatcacttgaacctgggaggcagaggttgcagtgagccaagattatgccactatactccaggccgggagcaacaagagcaagactctgcctcaaaaaaaaagaaagaaagaaaaaagttttacagaataaattatgattgttacatgggatgtactctgataatttctattctatactattatttttgacataaaaatgttggtcatgccccactaaattgctttcatggttggatccactaatgggtcacaagctgcagtttgaaaaccactggccttaagagtgactagactttcctagaggcctggcagagacagatgcctgggagataatctgttctctctccttcccaagacaggctcacactctctaataccagagaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccgaggtatgtgaccttgggaaatcacttcacctctctctgcctccgtttccttctctgaagattggcaataatcatagtacggtacctactttttttttaactataatttttatgggcggataaaattcatataaaattcaccattttaacttttgaagtgtgcaatttagtggtatttattacattcataatattttttaaattttttaattttttttctttgcagctccagctcaaatgattaaatttttttctttttaattttcagagatgaggtcttgctatgttgcctaggtgggaggctcaggtgattctcccacctcagcctcctgtactttcataatcttgcacagccattgccacctatctagccccagaatatttttatgcccccaaaaggaaaccccttacccatgaagcagtcagtcccatttccccctcccccatctcctggcaaccaccaatctgctttctgtgtctatggatttatccattctgggcattgcatgtaaataggatcatacaatgtgtattttgtgtctggtttctttttttaaaaaaatttattattattattagtgtttgagacagagtctcactctgtgccccaggctggagtgcagtgacacaatctcggctcactgcaatgtctgcctcagggctcaagcgattctcatgcctcagcctcccaagtagctgggactacaggtgtgcaccaccacgtctggctggtgtctttcatttaatgtaatacattcaaggctcatccatgttgtacatctcagtcctcattgctttttatggctgaataatattccatcacgtggctataccacattttgtttattcagtcatcagttgatgcacatttagtttgttttaccttttggctattgtgagtagtgctgctctgaacattcacgtgcaagcttttgtttaaccgtctgttttcccttcttttgggtgcacacctggggtagaattgctaggtcatatggtaattctacatttaattttttaagaaactgcctctatttcattttgagataggtacatgaagcacttagcactgtgcctggcacagagtagtaataagaacaatatttatcatcatcaatgacattttctaagtgccaggtattttatattttacttgtattaacacatttcatccacattaccatatgaggtagatgttattattcccactttatagagggggactgaggcctgaggagttttaagcaattcatccaacttgtgtagtagctgacccaggtagagttaaggctgagagggcagaggcaaggtcccagggaggccagtttcagctcaatgggaggattttctcactgttaaaggagctgctttcgccagtagtgagcactttgtccctggaggtgtgtgtctaagtagggctaattactgagcatgtcctgagttgggcagtgtgattcctggggtatcttccagccctgttaggacacacaacaaccaaagtggtccctgggctccagtaactcagagtcagaaggaggtgatgccagtcgcggtggctcgtgcctgtaatcccagcactctgggagactgaaacaggagaattgctcaagcccaggagttcaagaccagcgtgggcaacatagtgagaccctgtctctacaaaaaaatttttttaaaaaaaggaggtgatgtgatggagagtttggaggacttcttgtccccagtgagctcggagctttgagtcagggagcctggacctgtgacttggtgaggccccagggattaggccaaccacaggtctggggtacctggccctggggctgctgcctagtcatttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggtaaggttctccccagccccagccttccctcctgaaggcctgagttccaccaggaaagtgagctggcactggggtgggaatccaggccttcatcagatcagctctttgtgggaaagtgtttgctcgacgccttctctgtgctctcccctgttcttggctgcatggtcagggagcttcccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaactctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccatttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtgttctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcactgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcacctcgccatcaccgagcactgtcagtccctcagccggtcctctcagactctgaccgcagcctcctgttccttgagctctcagtcctaccttcgcctccctccagccccgcgcactccccatttcatcccatctttcatcagaattgcagctccctgcccagcagaaaatcctggaaggactcaggagcttgtcgcctctgtgctgccacctggagaccgagatctgcaggagaaaggcctgggaaaactatgagtggttgcctgtgactgctaagggctccttggtgctccgcccagcatgtccttttgctctgcagggcagcccccgcctgcctttcttcactgggcccttgtcccagcctcaccctcagctgatggcggcaccttctgctccagggagaaaacaggagctctccaatggcatagggacagttgacatcttgctatttacagatccccatcgcaccccttccctgccctcgttagggtggaagggatgtccacctgcctccaggactcaccctgtgtcctggccccagcccttgaccccctgggagcctcactcctcctcctcatctctcttgcatcttctaatgtatccactgccttctgaactaaacaccctgaatgaggtctttctcatctcagaaaactccacccacttctctctccagctgtcggctccccttcctctgctctccttgtttacacttcagccccctccttgccccttcttcaccccacctcctgcgcttccccgccagtaccagggtggcctctgtgcctctaggtgcagtgtcgcgtttagtcgttattattcttgaccggcgctgggcccggtctttcctggaaagatcgcctgctcggatgcagctctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccataggtacctcaaactcagcaccttctcctcccgtctcactggctcgccccactctctgcccggttgcacaagccaagaccccatagccacccagggcaccccccttttgattattcctcacatccaaccagttattgagtcttgtctttctagggtgtaaattcctctgaaatctgggcacttctttccatcccataatcttggtaaaattaaagctaccactgaccctgggtagaggcagaagcctgggaaggaaaggtggagaacaggtttggagtgccaacagtgtccccagatgtcatggagaatcaagtagagggaccccagcaatattgggggtggggcggggagtatgtaatgctcagctatcagcaaggagtcattaggggctatacagtgaattaagggagggggtaaaagcacatttcaggtgatgatgaattaaatacctaggagctcacattagagagcaggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagccttgcagtgaggaaagttgcagaatactggtctgctacattactactttccaagtgtatcagggcatttaggaacccctcccttgagcttcacctgtgtcctagggattcagtgagagactgtttgtgtaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttctcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcctaacatgtgcagtattcctggggtctttgaggctttgcaagagctggggttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagttttcccaactacagattcctaggtcctacgccctgagattctaatcgagtcagtcttgggtgcagcctgggcctcagttttttcttaaagctatgaatgcctaaccaaagtcaagaaccactgaatcgggggattcattgcatgtctgtggtagaggaatgctgctcatttgtttatagatgtggcagtcttgaatgcaggtgacattttcataccagggtgtaataccgcagaggaggggagaggctggatcttccctgatgtacctcctggacttttggagtgtgattacaatgccaatccagccacttcctctgagcatgcttgggacgactgttagacctgctgtgttgagttagaatgcacttgacctgctcaggccgtgaaatctatgaggaaggggagtgagatggatgtagctcatgagccagattgcaggtgtatccaagttgcatgtatatcctgaaaaaatcctggctctcacgaggctcagcctgaacacagttttgcattcaaagaaacaatgtccattaaccaagtataataaagaaataaatcccagtatttacttgcatcttttgaaagaacattaaagggaatccagctcataaccccagcagcacttcttcagtccttcttccccttttctttggcgcctggcatctctcactgcatagcaaagctttcccccttgattcccggtcctcacacgcaggctcaaggctctgtttcccatcttctttcttctgtcccccttccttttctcttccaagcaaatctaagtcttttccagtgactgtccctctctatgctcccccgacacccagttatcctaatttgcggaataaggccaaggtgtggggcctgggggcagaatgggagagtctcccctagtgagcagggaggggagtatgttctgcaccaggccactatgtctgatggccctgctggcaaacctgagtctttcagaaagtcttgtttaaatgcgtcagcactccccagctgtgatgctggagtttaaggcggagcaggggagaattctgggtttacagctggctggagttccagtgagaccagctccatgggtggccatactttatggaagtccccaagggcaagaggaattttggaggaagtgagtcagggctgaaaggtccagcctctcctccattaacaagcttggtggaaagggggtgtccttttattaaaggagacagtagaggtttcttagagaaggcagctcgagtaagtttaggacaaaggacatttccctggccccgggacaatggaaggctctaaaaacgaggttctagtggctgccataaatgaccctgctgtaacgatgggaggggtggcctaaagagacagtactgtggctctccagggagctctcctcttggaagagcagatctgaaggcgggaagactggttctaaggccgaggacattgccccgagctttgtggaggcactcaggaacacaaaggggcatttccagttgggtttggagcaggaagaagaacgaaaaagagaaagtcctgtgtgccatgtcagtgggtggcagcatggactcagcctcagctattggcaccaaggatctgaaccagggaggacccagaaggggagcccagcccctccaccagcttgtgggagagcgctgctgcccagtgaagcctggagagaggaaacaactggattctcccaaagcgggagaaggtggagtctccagccacccagctacaagctaggaagacgccttgtagaaggctccttacagggaggaaaccgagttggaaaggcgagacagcagtgtgggctcacccggagcaagacgtgtgaaatcagcttttgacagcgtggctgaatgaggatctggagatgcgaggcgctgggcagactctctgactagatccctggatatgaagaggcaaagccagctctagatggattcatagtgagtgtctgcttctgacaataactggcagaaagctgatgagcctggagcagggctgtgaaatgcaaatccagtgaaatccagccactcctacaaaaacccaccacatcttaggttacttgtgggcggaaacgctttttctctcagttgaagcttggttggaagcagatgtttcacttgggcattggaagggtctggggaaatgtgctgcctcctaggccagggacattagccagaggccagaattaactgaggctttagcaccaggtgacaccaacttcattgagaagccagcggcagtccataaagaggaaaaacccaaggcctgccctggactctgtcccagccatgctcccaattggccctgtgatcctgtccatgtctcttccttgctggtctctggctaacgtccacaggtggcattcatgggaggttccaagttggtcatcaaagactaaacatctgggcttggcagctgagcagatgataagcaattaactctgtattaccatcagaggctccacctccctctgtagtcccagtcccttgggaaaatctcagagctggagcccttccctcatcctctggctccccaccccatggcttctcgaacagtgttcccaccaggaccttgggacaggagagaacgcctcacctgaaggactcccaaaactcaggtttctctaagctgctggggcagatgccaagagcctccactgctctctcactgccaaggacctgggtgtccacctagatgtggccttcaggaggccaagcagtccttcccctcgcctttgtgtaggacactggcacctcggctgacttcggggacaagaaaaggcaggctcccgaccccttccaaagaatcatctggggttcaagatgaggcttctttctcccgtcccaagttttggtgtttcttctgagtctgctcagaaagatgaaattaggagcagacatctcaggtcctgcctgccatagcagatggctccttccctgagcctccataagcagcacagcacactcatgcacacacccactggcattttctctcacactttcatacacttgtgtcaacgcaggttcacagctcacacttaactgtgcatgcacacacagatttagcacttggattcattcccacacatgcacgttcacaacctgtgtgtgtcacccttcctcccctactcatgagggtgtatgccctggttcatacatgtaaccctcacatgtgacacacccagttcacacccattcatgcacacataccttctcttgtgcacacgtcccctttcccagtggtacaccctccttcatgtgcacgcagatgctcccagctataccagcttgctagtgttctgcacaggtgcttgccttggccctctgaatccctgacgcttggtttttctgtgttgcagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccacaagtgcacctctgaccagttcttctctcagacagagagcctggggaacacactcctagacagaaacacaatgcgtgagctcattgccgtgagccctgtcatccaagtaaggcctctggctgtgctacacgtttctgagtagagggccaatcccacaggtggctgcacagggctgcccacagatccaaggtcacagagggatcagaccccttatcctggaagcccctctacttcctccagtgcttgccctggctctgcaaatgcccctccttgagccagagccccaggccctaccctgtggcatggactcaacattggggctagcccagccagacagaaacagcaagtgttttcatggtacagaaaagtcatttgcagacctcagtgggaggctcttggccttgctctgagtggagtgctttctatgtcccagggctctgactgggctggggtccttgaggggattggaggaaggagcatgggatggagagctaagttcaagcagcctgggatctctagtataggtggctgaggctgatagaagacaggagggacctgtatccatggggtttggccaactctggggccggtagtggaggaggggagagctggatccccagctggtgaacaaagtgtttggagggcagccgagcctccccttctgactgctatcccatcacaaccaggatcagagctgcatttgggggctgatgtgtggctactgccagcagaccccaaggtgaggtctctagatggtgagtcagcagccctagaggaccccctgctcccaccccagagctctctgtgaccctgggtcctcaccctgcccttctctcctgcccagcccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatccca

SEQ ID NO: 12131 - DNA, 9739 bp, Human
atatatggctcaatgtttatgttttaaactccactgctgttcctatgtgcaacacagagtcagcttaaaattcacacagctttcttgtagcagtcccactgaatacaaggtctcagctctagtgtgagggtttgggagtccttcatttatttaggcagaaaacctaaatgttgaatgctgtactccttaatagtgtacagctaacaaaaaaaaaaaagttttgaaggtacaagtgatatcatcatttctgtaaagtgttttggaaaataaaataacatatccactaatcaaaagctttttctttcacagttgttttttctatcccagtacaatgtactccctccagttacattctcttgggtttaggattgggttagttggttagctgaggaattttcctattcaccatttctttcccaccttgagctattcaggcactgggattgtaaatgaaacttcagcccactgtatatgatttcacgtgttttactcagcttgaactctaactatgtaactgcaatagttatgtcacagctatgcgactgggtttcttgagcccttcttgctagtaattctacctgttatgagcaaattcatcatatttttgttgttgtaaacagtgccaacctgtttactaaatgtataaaacttggtaatatcagttgtctccagccagaattaatgctaaggtaaaaacaaacaacaaacaaacaacaacaaaaacaaacaaacaaaaaacctgctaggaaagatatagcagtaatcagagattctcaagagcaacacttatgttctaagtggatttacgtttgttccccttggccaaagactggggctttgatgtaatatagtaggctggatcttttgattttttacctctcttgatttttgagaagagagagagtgtttctagctaatcgtggtgctatcagcatcaggtgatctctggccagggcctccgtgcacgtagcatgtatggtatagtataatagaagcagggtaagatcatggttcagaacccgggcactggcagcaatgctgggttcaaacctgtcctctccttattcaacttttgggagcaatttacctaatgtccccaagctcatttttatcattggtaaaatggatataataatagttcctaactcttggaattagtgatataattaaatgagatcacccgtattaagcacttagcacagtgtctggcccatagtgagttgtcaatataaattagtactctttctatagaaaatcctctttataaaattgtagattcattttaaatgacttaaacacaaatagttatagtatccaggaacctgcttagttcagactttaagtatttctagctgaaaatctttgttgtgctcaaagaacatgttatagtgctacttcttgtttcatcacatgaatacaatttctgtgctctgctgcaatagactgacttctttgtctgcctactctgcctgcctgggatatgtgaactatgccaagccttcttacctatgaatacttcctcacactgctcccctacgtttctctcccacaacatatttgagactgttatcataatacttacagacattttcctctttttcttccctttcaataagaattcttaattgtgcagactcaggattgagagtgaccgacatgcctaaacacacacacattcattcatgatcacagaattcatgcagtcttttccaaagcatgaagggcctaagccttcttataaatgtaagattgatcaaaaaatttttgaagattcaaatagtaatctcattcattttataaatttttttggagacaaagggaagtattatgtggggttttcttttatcctattgggcgggcagctggccattgaagagccattcattgcttagtcccgacactgcctttccccattgggtctctgtaagagtcacacgctttgggcatccttgaaaagaatcttctgaggcctcagcattttatctgagtcttctgaatcccacttagaactgtgttgagctctcacccatcacgatgagcaacaaattcctgggcacctggaaacttgtctctagtgagaactttgacgattacatgaaagctctgggtaagaaatgctttttgttgttctgctgaaaagctcctttttaagaaagctacatgacattttcatctactacttttaacaggatactggggagttttgcaaggctgcagtacaatcctcttttaggattaatcttttgttgtgtcattcagataatttatttgaattttatttgtggtaatttttaatagaattaacttaaatgagagagctgcttaaatgcatggaatgcccactgatttcaagggcaatttcataccaagagaattttggttgcaggtccagaggagagaaagcttaaaagcatggtcaacccattttctggcttttctgagagctacgttcatagcaactgaagtgttcataaaataaggaattgaatatattgcaaatcctagaaaatctcaatttaaaaatttaagttttagctaaactaacagttttttctctctacctctaggttgtcctttattacacaatcatgtagatacagagagtttgaaaaacaaaaatacttcctaaaatactgtgttcatagtctagggaagttactgagagaaaaagaactggagttatggcagtgaattcaaactcaatttcgctaacatcagacgtttctggagttggagcagtgagtgaagatggaaaaccgagtcattagttacaacaactttattttatactatttctagagtatgtcccatcgatataaacacaatagatatgaagagtctttgggaattttcagaactatataaatacaataaagagtgatgccagtgacccgagtttgctgtgcttgtcaaagtgcctacagctttacttaactgttcagaaagcctgtataaaatgttctattttagataaaatgagcaaagtcatgtcattgttgcctggaacagtaagagaacttatggggatcaattcatactgtgagatcggttagatttaaagacttcactttacagctgaggaagaagccaaataaaagaaagtctcagtgaaggattttctaattccactgttttccagtttagcatgcaaaataacaccttgggatttggtaaatataaattctcaggctctgacccagagattatgatttaacttgagaaacattgtcctaaactgtataaaataacaaaagattaatcagaatttgaagaaagaatatagtttatagtttattggctgtaactcttaacttcttattcagtatgtaaaagtttgagatctttttaactggaaaaagttattcaaccattgagacttcctggaaaattagtttttctttcatatattttttattttacattttcccttttccatatattttatagtcttggtaataatggtaataaacttaagagtctaattttgtttcatttttgaaatgtagaagagttttttaaaaaatattttatttctctatgatcatttataatagtatagatctcaaagttagatggatagtttttttcctaccagctagatatagaagccacaaaatttcagaagtgaaattctatcaaaaatatgaggggaatacttctctatatccataatatggtattgagggaaaatatcatagaacaatacgtatatgctatagtctcatctttaaaatatatctatagtatttgtacatacaaactaaaatctctagaatgatttatgcaaatctataattagtaattttcaatggggaataggattggatgtgataaaaatggatgacttgcagtagctatttcagctggaaacttttactcttgaaaatctgcagacattggccgggcgcggtggctcacgcctgtaatcccagcactttggaaggccgaggagggcagatcacgaggtcaggagatcgagaccatcctggctaacacggtgaaaccccgtctctactaaaaatacaaaaaattagccaggcgtggtggcggcccctgtagtcccagctactcgggaggctgaggcaggagaatggagtgaacctgggaggcggagcttgcagtgagccgagattgctccattgcactccaaccaggacgacagagcgagactccgtctcaaaaagaaaagaaaaagaaaaaaaaaaaagaaaatctgcagactttacttttgcaacaacaaaacctaaaatgtttgagtcctgggcatgtatttccattaggagtgaaacatgggaggagatgcttagtagtaagtgatattacctgccatcaactcacctggggcaccactgagcgtaggatgtggccaccacagtctctttggctatgctctcttggtcaacataattctaacactatcttaattttcaggtgtggggttagccaccagaaaactgggaaatttggccaaacccactgtgatcatcagcaagaaaggagatattataactatacgaactgaaagtacctttaaaaatacagaaatctccttcaagctaggccaggaatttgaagaaaccacagctgacaatagaaagaccaaggtaatctttaatgtttctcttcaaagttggcccagtgggctgcttgagagagaggaatattcctgctagtgtaaaagggtagactcaattctgttgaaaaggagtgtacctcctgagacatctatatctattatgaaaatggttccatactgaaagaactgcttctttgatcaacaaatttcaggcaagtcaattgcatgaccttgtctttgcagagcatcgtaaccctgcagagaggatcactgaatcaagtgcagagatgggatggcaaagagacaaccataaagagaaagctagtgaatgggaaaatggtagcggtaagagtatctttacttctaaatagagaaataatgctatataaataatttgattatattgttttcaaaatattctttgttctttggaatatgaatggataaaaatgactaagaataaagtaagagttaatgcttcagtgatatttaaactattacagactcatcttcaagtactgacccaagattttagaaataaaaaaagccatttgttattttacaaataaaaatacctaaaaatggtagtaaggttaaagaaagtataggtaaatcttactagtttgggctcacaaagaagaaagcaagtctaaattttaaaagcaaaacactctctgcaaggtgtattttgtagactatttgcaaagtcatttgtagactatttgcagatatcccacaattttgaattcaagagcccatagtaacttagaatcaatcatgtcaataaagcaagctgagctcattggagacttctagttggcagatgaaaataatgacaaaggttgtatgtgatgacctttgatgattttttttttttagggttaaggctttatgttcactaattaacacatacattgaatgtaaatagattcatgtactcttccgaatgtttctttctttagtacagtggttcttagcccttgctgcacaacagatttacttggggagtaaataccaatatggaggcctccaaacagataattcaatgtaaatctcttgggggaggaggaaccatcactatatttaaatattccccaggtaacgcaaatatgtagacatttttgaaaaccactgtcttattagatttaaatgcaagtgaactatacataaaaacttgccacttaaaaaaattcctttacagcaacgtagatcaacttttaaattgtttcttctatttcaatggtcataattctgaattactggagactgacatactgatattttattcctttctaaattaatcttatgagtttattttgaatttctatttttattacaaattttctgttctctggtttgaacttgagatactcaattaacctctctcttttttaaggaatgtaaaatgaagggcgtggtgtgcaccagaatctatgagaaggtctgaaaaatcatttcttcattgaagtggctttttatcatttaatgatggaaatcaattgcttccattgacaaaactgaatacactgcaaatatttgtttttgcttttgtcttaatatatcagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggcaagctaggagaatgggctattataatgtaaagaattgtagtctcagttaaaaggggtagcctctactccagccaacattttaaaattaatggataatttatagacagttaaatttatagacagttaagtaaaaatggataatttatagacagataatttatagacaggtaaatgtgagttaaatataactcacatcccactcaagacacaaaacattttcttaatcctagtacatttttttctgtcccttcccaatcagtgtccttttctgttccacccctaccaaaagcaagtagtggtttggtttctatcatatagattaattttacctgctcatatgaagggaattgtacatcatgcattcttttctgtttgccttttttaaattcagcatcatgtttttgtgatacatccacattgttgcatgcagctgtagtttgtttctttttattaccaagtactatttcattgtatgaatatatcacagtttatccattctactattaagacaattgagctatttctaattttcggctgctatgaataaagctgctacaaatatttttgtacaagactttttgtaaacataggagtccctttattttaaataaataactagtcatatcattaggtccagtaattgttgacaggcaggaacgggggaccattgcattgtgcccaagtaataataaaactatttcagatgtattatatgattgagcaaatgagaaaacatgttgatgttgatgggagtcaggatgttcactatggaaaaacaaatatacaaatatgaaatgagggaaggcaagaaagaaccatgtggaaatggaatagaattggtataaattcataatttctaaaccatgtatatgtacgtttatatgtattataattgcatacacatgcctccatgcatatatgtgtgtgataatacacatgcatttatgtgcgtgtgtgtatacacatgcatatatttactaatcctatctgccaaaatggcttagacacaaaaacacctcagcagaaatgaatatacctagcactcagatcttcgtgtctaatatagtttgccactaaaaggaaccaaggctacttggaaaaatggatgattccaaagcaagggcaaggtaggaacaagatgagcttgaaatatcttgttatgccagaaagtaatgttaaaaaaaaaaatagaggtatattgccaaaacatagagccagcttgaaggggctcccactggccaaacttgagccaatctgagagcaaaataattgagaaaaataaataacaagataattgagaaaaaaataaaataaattcccaattccattgggaaaaaatagaaatccatgaatccatactgatataatgatagataatcgatagataggtagatgactgacagatgatagatagatatatagatagatagatagatagatagatagatagatagatagatagagaaatgagaaggtttctcttttgcaatagaacgtcatggaccagtgttaaatgtgagtggaaggagttctggaattggaaaaccatcatttttcaaccatcacagtaaatatggctcaggcaagaattatcaatcaatgctaaagctagggggaaatttcgcttaggagcaggatattagggtattagtctgggcttaaagtatctcctcacagattgttgttagtttctggggaaagaatagtaaccatgcaatggaaaaaaatggacaacctcttgactaggttatcaaaattaacctcaccaataaagggtggatgttcaacatgtgccttcaaatgtgacccactgagaaggaaacaacatcactgtaacaacaacaaccagaaacgacagggggttttgactgaattcttcaaaaatgtcaatgtcatagaagacaaagaaaggttgtggaaatgtttcagattaaatgatagtaaaaacacctgacaactaaacatagtaagtaatactagactggattctgtaccagaggtaacataagtgctccaaaggacaatgttaggtcaactggcaaattggaatatagacagtcaatcagataagaagtatactttgattaagtaaaaaaaatccctattcttggaaaatacacaataaagtattttgaggtaaagggccataatgtatgcaatctactctcaaaaaattcagaaacatatatttgtgtgcatttgcatgtgcaacagtacacacaaacatacataaagagagcaattgataaggcaaataaggtaacatttaacaataatctgatacacataaatagagaaagagcaattgataaagtaaatgaggtaaaatttaacaataatctgagcaaaaggtatatgtgttttctttgagacagtctgattcttgcaacttattctgtaagttggaacttatttccaaacatgattgaaaaaaaaccccgcacttggcaacttcttctctttttcagcctagaaatgtctgtgttaagtggttttttatttattgttgttgtttgttgttattgttgttttgttgccaggctccaactcacaaaatacgagtttaaaaactgcgttgttatttttagagatttgtgataatacaacttgttataaaatttattcctcaataaatataatttctctactatgcaaaaattatgagtgctttttattttcataaaagaaaatgttgaactacactgataagaaggaaggcaaaataatcatttcagcaaacagtatacttgttagatttgaaaacgattttaaaacaaccataagagagggaaaaataaaacaaaatgatattttagtaaatttgggctgctgttacagcaaaacaaaaataaactgaatagctaataaacaacagaattttgtttctcacagttctggaggctgggaagtccaagatcaaggtgtggcagattcaatttctagtgacgactggtttcctggtccataaatggcatgttctggctgcatcctcacttggtagaaggggaaaatgagatttctttggcttcttttataaggaccctagtcccattcatgagggctctactctcattacctaatcacctccctaaaggtcccacctcctaataccatcaacttgggagttaggatttcagcatataaatttaggggtacacaaacattcagaccatagcacttgagttctgtaatattcaaaaatagatcagaatataattttccttctctaattcttttttaatataacacagtggttaagaacacagctagaggcaggactagcttgcagctcctgctccaat

SEQ ID NO: 12132 - DNA, 7879 bp, Human
aaggatgggtgtatttagtagtataatcatagagggtttagtggagtacatttttattggtggccaaagcattggaaagcaccttctcaaatgattttttgttatcatcagtagtatcttgttttttgtttttgttttttttttgagacagagtctcgctttgttgcccaggctgcagtgcagtggcacgatctcagctcactgcaagctctgcctcctgggttcatgccattctcctgcctcagcctcccaagtagctgggactacaggtgcccgccaccatgcccggcaaattttttgtatttttagtacagatggggtttcaccatgttagccaggatggtctcgatctcctgacctcgtgatctgcccgcctcggcctcccaaagtgctgggattacaggcgtgagccactgcgccccggcccatcagtagtatcttgttaatcagtaagagtttgatgaattaaaataatatcatacactcaagacaaaaaagaattaaaactgagaaatattgtgtgctgttgcaacataagaaaggagatgataaagcctattacctcatttaaaaatgacgtcacgcttatatttgaggttagtcagagggtacattttgttgtcgcttttaaaactaggtaggcttgtgtctagtgggtcattgagtgttatcctctagacataggtttaatggaagatattaataaccatgagtgcttgaataagagcaccacctgctgaatccactccatctcccttctcgtctgctccgtgaagccacctggggaggtgaagccagtattcacagtccagagccccactgtaccctcccacctcattccgccctcaccagaggctgcagagactgaggcttctgttgttcctcccttcctcaccttcctcttctctcttctcttctcttcctcacggtcttctcttccctacccattgcccctctctgccatgactttattggagaagcctagttggaggacagttacgtaaaagcagacagacagttacctggcaatgtattaggaccagaatgagtcatggaaattattttcatgagaaataacattttaaaaagcagttactttgttttaaaatgtattttatcacatttgaggcttccaataatttgtttttcttttgcatttttttgtaccctcaatgtcagattcatgtgattgatctgattcttcactaatgacaaaaagccaccaagatacatctatttaagctttctcgcttttgaactggtggaaaggctcaaaggtaacctttattggagcgttatcttgcagagatgaagaaacaaatatttgtttattttgctttcaatgatcttatatattgtttctattctgctaaaggattaataagccttatgaagagaatcagcaaagtaagaattctccacataattcagatacgttttcaacttaaatgttaactttaaaatgacttcgggctggccacggtggcttgcgcctgtaatcccagcactttgggaggccgaggcaggtggatcacttgaggtcaggagttcaagaccagcctggccaacatggtgaaactccatctctactaaaataaaaattatccagacatggtggcgtctgcctgtagtcgtagctactcaggaggctgaggcaggaaaattgcttgaacccgagaggaggaggttgcagtgagctgaggttgtgccactgtactccagcctgggctacagagtgagactccacctccaaaaaataataataataataatgactttgaactgttctgtatggtatagtggtagtgggtgcatgactatgcatttgtcaaaacccatagaactgtatacttatacttacaccacaaagagttaattttaccatgtgcaaatataagaaaatcaactagaatggcaggaggaccccaagatggaatgtactttgaagctacaagaggctaagtagtttgccaagacttagcatgagttcactggcagaggggttgtttatttctatgtcccagggaagtctgaagaagggagagagagacaaaaaaaaaaaaaaaaaaagaagaaggaaaataatagtatcagatcaagatttttttagggtttttttttgagagagtttcactctgtcactgtggctggagtgtagtgatgcaagcagggctcactgcaacctccacctcccagactcaagcaatcctcccacctcagactcctgagtagctgggactacaggtaggtgccatcatgcctagctaatttttatttatttttttatggtttttttttttttttttttttgtagagacagggtattgctgtgttgcttaggctggttttgaactctgggctcaagcattcctcctgcctcccaacgtgctgggattacaggcattagccaccgcgcccggctttcaaggtgtttttattttgtacatctttgaaagaaatggataaaataaataatcataaagaacttatctattcattttcatgtagaaattttatgcaatacatgcttttaaaaatataattattggcctggtgtggtggatcacacctgtaatcccagcactttgggaggccgaggcaggaggatcacgaggtcacaagttcgagaccagcctggccaagatggtgaaaccccgtctctactaaaaaaaaacaaaaaaaaaacaaaaaaaattagctgggcatattcgtgggcgcctgtaatcccagctactcgggaggccgaggcaggagaatcacttgaacctgggaggcgggggttgcagtgagctgcgatcatgccactgcactctagcctaagtgacacagcaagactctgtctcaaaaaaaaaaaaagtacatatatatatatataattatttgggggaggcgtaaatattaaattactgacttttttgtgagtaaattaatttttttcttaaagaaactttggagcacaaggtatctagtactgtgggcaccaaaaaggcaagagggaggaaaggatacataaatgagaaagggatggctacagggagtgaaggaggatgattcgggagagaatggtgtaagagtatcttaaattggcccttctgagttcttttttttttttttttgagatggagtttcgcttttgtcatccatgctggattgtaatggcatgatcttggctcactgcaacctccgcctcccaagtttaagtgattctcctgcctcagcctcctgagtagctgggattacaggcacgcaccaccatgcccaactaatttttgtatttttagtagacggggtttcgccatgttggctaagctggtatccaactcctgtgctcaagtgatccacctgccttggcctctcaaagtgttgggattacaggcatgagccactgcccccagcccatctgagttctttatagacatctaggctattgatgattgggaattagtaggaatattaaatatttctaagctgttgctcattaacctattcatatacaggaacctgtaacatccttgaagtacttgggaatccaaagacttttcttagctttgcatgctggatatttggacttttactgctactgctaatatcaatccagtgacaaagatgaatatgggaaaagctagatctgattgaaaaaaattaatcaaaagatataattgaatttttttttgaaatgagagagagcagttgagctacccaactcagtacagaatttcatttagtcatgaggtatgacttcttgaaaaggaatcactttatttattcattcatgcatgtattcattcattcagtaaaaaattattgagcgatatatttattaagtaatttttttttttgagacagagttttgctcttgttgcccaggctagagtgcagtggtgcaatctcagctcactgcaacctccgccttccagtttcaagcaattctcctgcctcagcctcccaagctgctggaattacaggtgcccgccaccacgcccagctaatttttttgtatttttagtggagacggggtttcaccatgttggtcaggctggtctcgaactgctgacctcgtgatccacctggcttggcctcccaaagtgctgggattacaggcgtgagccaccatgccccaccctatttattaagtaatttaacctaagaacctaagacacctaaagaataagtaggagttaccaaagcaaaaaaaaaaaagttatatggtaaaaacacaaatcatatttcttccttaaaacttcctatggcttcccattgtacttagaataaaactcacactccacacttccacagcaaaaagtccctgcatgattgggttcctcctgtctgtgcctcttgcttcatcccctattactcttcacttgccttgatgtttcttgaatataaagaccaagttcatttctaccttaagacagagtcgcccatgctggagtgcaagtggagcaatctcagctcactgcaacctctgcctcccagattcaagtgattctcctgcctcagcctcctgagtagctggaattataggcacacgctccatgcccagctaatttttgtattttttttttttttaaagtagagacgaggtttcaccatgttggccaggctcgtctcaaactcctgatttcaggtaatctacccgccttggcctcccaaagtgctgggattacaggcgtgagccactgcgcccagccaaggccatttttttctgacatactgtaatgcatttgtatgccttctttattttttctttaaatctggggtaatgaagcttcagacaatgaagtataacctcctcattaattctttcctccgcacagtaattctgtctccccactcctccgtcttaagtcaaatgtcactccagtgttgccttccaagacaaccttatctaagtagacatttttctccataataacttatcactacctgaagttatcttgttcatttgtttacttgttcttgtctgtctcccttcataagcatgcaagttctgtgagagctggaactttgtcctgttcattcctgtatctccagtccctagaagaatgcctgacacatcataggcattcaacaaataatacctatcctggaaggtgagatttgtatgcaagatattaaactcacttgttcaaagttcgtgctcaacaaactttaattttccttcctgcctattgacgagactaatcaatttggttccctgatcagcaaaaatcacacacatatcttggatgttaagaatgctgcatactattattctgaaacaacttgtaaaggaataatgacaatgtgtgggggtattctctttttgctcttcctaatccactcttcattctgccattctgctcggtgtccctggaacatagacctttaggactgcttcagtgggttccattatttgccagcatttggctgggtttggcaagtgggaggctccatccggagatcagaaggtgggagcagggtgaggttatcttgactgagttcctttactgaagacttcaagttcctgttcagccgtcctctcctaagctctttccagtcagtggtcacattcctgcctgcctggggatgttacatcctttgttggtttcccttaaccgtgtccccacctttgtaaatagtccttttattaaattctcctaaatcattgaggagtgctatccccttaaaattgaatgtccatctgtttcctggtaaaattcttattgatagagatacaatgggaaaaagtggtagaattacaatgtggtcttcaacgacacaaaacaacaaacataagaaaagccattggtcgggcgtggtggctcataactgtaatcccagtgctttgggaggcctaggtgggtggataacctgaggtcaggaggccgagaccagcctagccaacatggcaaaaccccgtctctacaaaaaaaatacaaaaattagcaagactctgtctcaaaataaaaaaaaaaaaaaaaaaaaaaaaggaaagccgtggcgtgactagcacagatgatgtgtcaagtcaaaatgtgcatgttctgtcatctcctctttttgtgcctgtgaatcaccagcttctgaggttaggtcctctagaagcggatgctgagatagagtttggggttcaaagaatcaaacctatgaaaggaagtggcagatagcaggattgggcagagtgggaagtcaaactgcaatgcaggccctgcaaagactcagtcaacccaacaggaagctctaggtgagaaatgcccatcaggttgtcccacatgaggctgaaatgactctgcctttgtaccctcttgtttattcactagattcactggatcacccaggaaggggtgatcttgggtaaggtcatatgctaaatgatcctgaaatgcaggctctattagatttttttgaagaatataaaaatcttagctctgagagagcaggcttcctactgatcattgtttttggaaaacaaacaaacttcctttacttaggaccttgaaagcaaaagtccttccttcactttagcttgctcaggagctgggtatttgtctctgcgggtgctggtataggtctctgcagctgaggcaggccctgacatagctgccagtggaggctgtttactaactgtactccctgtaggtgggcagaaagtcctatcttggcgagcggatgtggagggccatctccatctcttccccacaagtctaaaatcttaatctctcctgggtcttatctctcactacacacacatcataccatgggaactgtttccaaaggctctatcctcatccatagtaaaatccctctagattaatcagttctccttatcccaataccttctaattaaatttctgtgtcttataaattgccagagtaacaggcagatgttggaggaaatatgttgccactttaggaaatctgagatactaagagagaagactgtactatatatatagtatcagaaataacatcaccaagcggtagaagggcagcattcatgattctgtctttatattctcatggaaagggttgctctgtgattctatgtctaggtactgaatatgtgtggctttgagggttcattattattattattattattattatttttgagacggactctcgctctgtcgcccaggctggagtgcagtgacagtcataactcactgcagttttgaaccgctggattcaagagatcctcctgctttagcctcccaggtagctaggactacagcatgtgccactatatctggctcatttaatctttctttttttatagagatgtgatctccctatgttgctcaggctgcccaggctggtctcgaactcctgggctcaagtgattctcctgctttggcctctcaaagtgctggggttacaggcatgagccgccatggctggctgatgattcattctttggcattatgcagtaagtactcttacttcccatatggtttgtaaagaatagtataggccttccaaatcagtattcctggctgagctgtgttaccatgacgccttcctcagtactaacatttagcattacatttgatgaatttgacatattctgcaaaatgcatcagcaattagataatatctggctaagttaatatgactatttttcatagtgaaagtcacactttagtttcttttaaccaaatgctcttgtccctttcatgtgccgtctcctcatccagtttgttagagatagttcatcaacattgtgctaccacattttcagatatcttgttaaattataatttaaataatgatctgaacataaaatgagatcatctgaatgcattaagtagcacgagtgtgggagcatttctaataggagcaaatctctccagaccggcatcttaggcaaaaatttttcttgaccgaaatctcc

SEQ ID NO: 12133 - DNA, 37297 bp, Human
tacaggcaactgagccactgaagaattttgacgaagaaaatgccaaccaaagcagtcattttaaaagtttatggctgttcagttacaggacaagttgtgaaaagaaagaaaaaaaatggaaaaaaaaaaagtttatggctgaaacagtgtaattgattaaaaagtgaaaatccaggccgggcgcggtggctcacgcctgtaattccaacactttgggaggctgaggcaggcagatcacctgaggtcgggagttcgagaccagcctgaccaatatggagaaaccccgtctctactaaaaatacaaaagccaggcgtggtgggacatgcctgtaatcccagctactcgggaggctgaggcaggagaatcgcttgaacccgggaggcagaggttgcagtgagccgagatcgtgccattgcactccggcctgcgggacaagagtgaaactctgtctcaaaacaaaaaaatttgtaaaactgatcccacaattccctacatttgtaacttttaaaattcagaggtaaatacatttttatttaaggaggaataattcttcagagcaaaataatctgaatatcacctggaatagagattggacagaaaaaagtgtgaacagggaaaactaggacaagtcatatatgtaaatgagagtataaagagtaaatgagagtggtcactgctcactgcagcttaactaatcagatagttaagttgcaggcataaagtttttttaacttttattcctcaagtaataaattgaggaaaatacaaatatgtacaaaatttttacaaaagctatccataaaagggcaagtagtaatatatagaaaagatctaccagattagtaacaaactacccccattaggaaaatggtaaatgatatgaataggaaattcaaaaaaagaattacagatttccaataagcataacttaagatatacactgatattgtaaggaaacacaatcaccacaaccttgctaatcaaagaaactaatgatatttattggaaaataatgggaatttttaatagactgggttagaagactagaagtgtacgtcccaaaatattaatagttcagctgtagggtgagatcactgattttaattttctccttttatacatttttccagatttctctacagcaactacgtatcattttgtaataaattttaatttttcgatgcacaaagcaattgcctggaattgcagttcgatatgaacccaggagttacgcttgtaaaataaactattgctgatgtgacatttccatttctcaagcagactgtaaatttctcagatgtaggtcatcatgttataattagggttccattgctcatgatctagatgaaacacttctccctttcttgtggtctcttcattaatttggtccctaccgcaaaggcagggggattaaaaataaaatatcttttgacactggttggcaggtgtactaacacgtgtgcgggaggattcctgttctcggcatggttcacgccgggctccggcagcgccctagtacgtaaggggctgcactggagtgtggactgcccggtatccttagagaaagttttgacagtgtgacgccagtgtcgcctctaaccacgtacaaaacgcgccatgcattgggtagctattacagtgcacatttttgtgcaggaagctaccccaccagcgcaagtatttcagaatcaagatcgcactcccgtttccccttctagggaaaggattccagataaacactgagaaaacagatttaatatcttaggtcaaaactccaggtcttcccataggaaggcccctgggctgtcattctgaggtgcctatttcccccgcgccgtgtccacgtccacgagtccacgaaccctccgagttctctctcctcacctgccgagggctcgcccctctagccccgccccgccccgcccaggacgcgtgacgtcacaacaagcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacaggttagcaccgggccgggccccgctggctttcttctttccttccagcctcttcccctgccttccttctctcccacaccgacagtccagtgggtagggtaggttccttgcagcgggtcgtcttccgtggggatctccctccggcgcccctggctggttgtcagtcctgccggctacacctgggccatcgcttgggctgcttttggtctggcccttggaggaaacgggtggtcactgtcttttagaggctgccatatccccttccagaaaacagttctcgtttgtttactcgtggttcttgttcacccgagccttctgttgcctttcagaactcgcaaactttgagaagaacgtgagccaagctatccacaagtacaatgcttacaggtgggacagtgcagcattctcgggtagcatacgttctgggataccctgtttagtgtggcaattaacaggactgagggcccagtggatatttggtccatctgcaagagcgggaaaaagcaagaatcgaggctggtaccttactatttcttgaagaatgtgggcagtgcgttataggatcagttcagataagttcccaattctgattgcagatagctgtagcctgatacgtattttgtcatcatcaaacatgaattactagaaatgcggtgtaattttaaccgtaatgaaagacagcggatgaagtccatactgtgaaatatatgtggttcaaggaatcacattttttcttttggttggtctaaagttgatcctgtgggatcctgatcctgatccttgttccttgttcatgggatcctgtccttgttcatctcaccaggggccttatcctattcattctttccacatccacctgcttctactccttagcctatatttatttatttatttatttttatttgagacggggtctcgctgtggtatgatcatggctcattgcagcttcaaccttccagcctcaagtgatcttcccatctcagcctcctgagtggctgggactactacaggcgcacgccaccacacccagctaatttttttttctttctttttttttctttttttttttgtagagaccgggttttgctatgttgcccaggctgatctccaactcctaaactcaaatggtccacacaccttggtctcccagagtgctgggattccaggcatcagcctcggtgtcagctctccttagcctataaatatgtgcaagtccctcagctcttaaaagcaaaaccaaaacaatcttaacttccctctagctagcaccttccctcttttctcactttatggtgaatcttcttgaaaaatcttcattccttgcctggacttcttaatacctaatcatttactcaagaagtcccagtccttgcctggacctaccagtgctctgaaaatccgctcacctacgtctcatcttattggactctctgtggcattcacccctggctcatgctgtgaatatctcttgacttctgtaatggcactctttctggtctttcatctcttcttctgtcttaccttttaatgttggtataggttgagcctccctaatctgaaaatttgaaatgctctaaaatctggatgattgccgacatgatgacacaagtggaaaattccacatccgatctcatgtagtaggtggcagtcaaaatggtcaaaactttgtttcatgcacaaaattattaaaacgactatataagattaccttcagggtatgtgcgtaaggtgtgtgagaaatatgactgaattttgtatttagacttgtatctcccatatccctaagatatcttattatgtatacgcaaatattccaaaccctgaaaaaaattcaaaatctgaaacaatgctggtcccaggcatttcagataagggatagttaacctgtggttccggggagtctgcctgcccttagccctcttttcttacttctgtagtttccctggcaatcttgccattcttgactttgaaatgccacttatgtcagtgactccaaatctgtgtatcactggacttttttccacatttttagccctatactgtctttatcccaagtcagctcccttcttccattcccactccacacagttcagagctgattgtgctccctcctttccttacttctgtgacttcctctgtaaagtaaaataattgtattatcatccatacatttgatgattcaaaattacagagatattcaactttgtattctatttggatcacagcaggtctcagaaaggaggtgtttagtttgaagaagctcatcgggataagtgagagggccagcagtctagacaaataaaatgtgccaaagcattgagacatgaagggtataacgttttctggaagtcagatgttcagtttgcttaacgggtatggtatgagtgggaaataagtctggaaaagcaggtgattccctaccactcctgcatgctcctccctaccccagtagacatttctgttgattgtggccaaagtattcttttgaaaatagttatctgatcttgtcagtcaaataattaaataatattttctctttaccttgataaaacccaaatacatcatagcatacaaaaggcctttcatctgattcttcttcccttttaggctttgcctcacagtgccaatgacctggaactacttgcctttcctgaaatgatcccctccataaactgtgtttgcctgctcctttacttataaatatgtcttttcagattcatcatcagtcatgtgcttagagagaagttcaaatccaaatataaagggttatttgtgctataacagaatgcaaatccaaggttccaaagactatccagtgtttatgcttttgacttagctgtactgtcacttctcatcagcatcaactctgaattacattttgcattgaaattatagacagaataccgtcagcgagctcccagggtgtatccaatctgtcaccagattaacaaactggatatgtgtggaggtgggcaagaattacaggtcaccgctttatgctgaactgcagtgggaacaattttttttttctgtccataagtttattgtctttatctgaaaaatcctcgtagaaaattgtttggtttagctctcagcagccccctcctgagccgtggggaagcttgccttcttttgagctatgcgatctttcttctgagcaagggacattttgggatggttccacctctttttaacttctttcttgagcttcttttcatagactggattctctcctatagcagcatgagctttcatctccttcatcatgtctgaagttatgctattctttatgtattgagagaactgtttcttgtaagcatctttatcttccattaagtagtgcatgtaatctgcaacattctggcctatgttgtgcttctggtgtaattctgcattgaattccttgctttcagaatcataaccagggaatcatttggtactttgagggatagacaagcctccatccaggtcaccaaaaactttattgccagtggtagttctggcaaggcctgcatccaaatagcaggtgaaagcacctggctgaccatcaatgctttctacattgtattatcgccagtcacctccacttggccttcatagatcttgtccatgccaaacctattgagaagcctgtgggccagcagcaggccagtacaatatgttgcagcataatttgtcaggccaaccttcacaccatattttggcagttcgtgtgcatatgctgcgcagactatcatatccccctctatacgggcataagcaatctgacaattgatatctctgtttgttatatgaactatcatcctctatttgggtgtgttgtatttatttttatcctgtattaccaagcgtttctgagcatagtaatcagttttaccatcttgtcatctttaagtttcatttggtatctcttaaagtaggccttattcttaacaactttaacaaagtccatcctgtggaacagagacctgcaggcccagcagcactagggggtggaaaggcgggagcaatttttaaaaactgatgtaggggccaggcacagtggctcacgtctgtaatcccaccactttgggatgccaaggcgggtggatggcatgaacccaggagttcaagaccaacctgggcaacatagcaacatcccatctgcattaaaaaaaaataaattgatatagggacataagggaatgcagtttgaaactatgaattttaaaatagctatccaagggctgcgtgtggtggctcatgcctgtaatcctagcactttgggagaccgaggcaggtggatcatttgaggtcaggagttggaaaccagcctggccaacatggtgaagacctgtctctactaaaaatataaaattggctgggcgcagtggctaacgcctgtaatcccagcactttgggaggccaaggcaggcagatcacgaggtcaggagatcgagaccatcctggctaacatggtgaaaccccgtctttactaaaaatgcaaaaaattagccaggcgtggtggcgggtgcctgtagtcccagctactcaggaggctgaggcaggagaatggcatgaacccgggaggcggagcttgcagtgagccgagattgcgccactgcactccagtctgggagacagagcaagactgcgtctccaaaaaaaaaaaaaaaaaaaaaaatatatatatatatatatatatatatatatatatatatacacacacaaaattagccaggtgtggtagcatacacctgttatcccagctactcaggaggctaaggcaggataattgcttgaacctgggaggcagaggctacagtgagtcaagatggcgccactgcactccagcctgggtgactccatctcaaaaaaaaaagtaacataggtatccataagcagatctggtgtctaataattcaaatgtggcacatttttatgaggaagttatgaacaatttctaaaaactagctattttaaaaagggcccaatgatgatttctacttactcccaaagaaagacagctggtctccccatcccttgagtattatgtatacagtttaaatcactttgttactcagcacaaatcaaaacaaatcactttgttactcagtacaaatcatactctttgacgtatagagtttaaattcagttattctcaaatgtggagcttttcaagatactttaaaagttagacgtaggccaggcgtggtggctcacgcctgtaacccagaacttttggaggccaaggtgggcagatcacaaggtcaggagttcgggatgagcctggccaacatggtgaaaccctgtctgtactaaaaatacaaaaaaattagccagatgtggtggcgcatgcctgtaatcccagctactcaggaggctgaggtaggaggattgcttaaacctgggaagcggaggtgacagtgagctgagatcacgccactgcactccagactgggcgacagactgggcgagactccgtctcaaaaaaaaaaaaaaaaaaaaaaagtggccgggagtggtggttcacgcctgtaatcctagctggttcacacctgtaatcctagctttctttgggaggctgaggcgggtggatcacctgaggtcagagtttgagaccagcctggccaacatggagaaaccctgtctctactaaaaatgcaaaaaattagccaggcatggtggcgggtacctataatcccagcaacttgggaagctaaggcaggagaatcgcttgaaccccagaggcggaggttgtggtgagccgagattgcgccattgcactccagcctgggcaacaagagcaaaactccatctcaaaaaaaaaaaaaaagttagacatatattaggtggtctgtcagctcatctgagttttaagttccatatggaggtagaaaattaggccaggcgcagtggctcactcctgtaatccccgcactttgggaggccaaggcaggtggatcacgaggtcaggagatcgagaccatcctggccaacatggtgaaacatcatctccactaaaatacaagaaggcgcgcctgtagtcccagctactcgggaggctgaggcaagggaatcacttgaacccgggaggcggaggttccagtgagctgagatcgcgctgctgcactccagcctggcaacagagggagactgtctcaaaaaaaacaaaaaaaaagaaaattagttatcttggtgaaagcataagcatagatatttgcttgtatatgtattccagtttaagaaaaattaaggccttgatggatttctaattggttttccttttcttctttccttatagaaaagcagcatctgttatagcaaaatacccacacaaaataaagagtggagctgaagctaagaaattggtaagtttagttagcatgttgatcgaagagttcacacgtgtccaaatttggtgggttcccaccaaaccaaacttgcctgtctgaagcagccttgacccacacaggctgatttcactactcctgatttcttggaataacattcatgctgtttcatacacactttttcaagctcaaaatgttttcatttgggagaagatgggttaaaatttttaaaaatatatgtaattacagttttctttctctctgttacaatatatacatgtactcacgttgaatttcaacttgagtgttggtttttaagaagagtgaccaagtggcactagcatatctggtcccacctatttttctctgatccccaggtgtaggaacctatgtgagttagtgggagtgcgtgttccccagagagatcttactaataagcacatgattaagacccttttgttttatggcatttagccctgttctctgtaatttccacgaagccttgtgtactgtgtcacagtttctagagggtcacatgcctcgttaatttgtaatataataccccttatctgaaatgcttgggaacagattattttggattttggattttttttttgaatatttgtatttggttgaatattcctaacccaaaaatccgaaatccaaaatgctccaatgagcatttccttttgagtgtcatgtcagcactcaaaatgcttcagattttggacattctggaatgtggatttttggattagtgatactcaacctgtaatatcactgagaatatcctgagatggtctatctattgacaatcagattgttgtctcatctaaatcttactaaatgattcaaagttccttaaatttaaggaccatatcttattcatcttttgtgaaagatgtcaaattatcatggcttttttgtttgttggttttgagacagagtctcaccctgttgctcaggctggagtgcagtggcacgatcttgggtcactgcagcctccgcctccagggttcaggtgattctcctgcctcagcctcccgagtagctgggactacaggcatgcgccaccatgcccagctgatttttgtatttttgatagagacagggtttcactgtgttggccaggctggtctcaaactcctgacttcaggtgatccactgccttgagcctcccaaagtgctgggattatagtcgtgagccactgcacccagcctgagatgccttttgagtagtccaggtcctgatagttatcacctccttttgttctttacctattaatgtttcacaaatgtcctctggaatttaagaattaatatttgattatcttttaaccttctcaggagatgagccataattgcccttttttttcttttttctttttttttttttgagacaggattttgctctgtcactcaggctggagtgcagtggtggcataatcacagcttactgctgcagccttgaccctcccagccaagcaatcctcccacctcagcctcctgagtagctgggactacaggcatgctccatcacactcagatattttttttttaatttatttcttttgtagagattggatcttgttatgttgcccaggctagtcttgaactcttgggctcaagtgatcctcctgcctcagcctcccaaagcgctgggattacaagtgtgagccaccatgactggaccataactgccgttatatttttgcccttcagagtcataacattaccataaatcttggacattgtgtgatttagtgacagattgtccacattcaacatgtgccacatcttaaccttgacttcgctactcagtacaaatcatgctctgatatataggctttaaatccttgtggcatagacagttctcagcatcagtatatcctccttaaatagactagccaagtaagttataaatacattagactttaattctgagtttctgtcttggtgaactgacccattgatagtctcaggaactactcctgcttccattcacttcctcttttatccctacagtacttccttttttatgtttattgcaaatagcctgctcatttcttagagaaaaactgaaaagctctgatacacttcatctcaaatctgcgcttatggtatattcctaaaaagaatacaaaggtatccaaaattccttttgcataagactggttgtaaaaatctcatcattattccttttcacaattattgaagaatcacagagttgctatctagcccatttctggaattactcctcagtaattctagaaattattctagaattactcctcagtaattctagaaattattctagaattactcctcagtaattctagaaattattctagaattactcctcagtaattctagaaattattctagaattactcctcagtaattctagaaattattctagaattactcctcagtaattctagaaattattctagattatctaatctattccttcttagtaacggaagtaatagattcttcttagattatctaatctgttacttctcagtaattctagaaatctgaaatttccagaatgagtagtttgtcttttattccttaatgtttggtatagaaagtagcttgggtctgaattgcttgaggtcagtatgttattgagtaaaattattgtagcactatgtgtaaagggaaaaataattaccctttaaaaaaatattgtgatacaggaaatgagcctgagcagtttcctttttctaatctattctgcttcctaaatcttttgttcatttctatctggtaattgctgttttccaaacttgaatatgctttcagtaatttggggacatttattaaacattaaataaattaagaatattgatgagtgaacctaggcctgagaggcagtagagataactggcacacctgttattaagcatgctgaatgtttaactaaaaaggacaggacatttttcaatacacatgaaaaaaagttcaattttactgataccaaagttgcaaattaaacaagacactatatagtgcccatcaaatacatgcagtgtggagaaagatgtgaaaaaaaggaccctcatttactacccatgaaagtgttggttgttacagcctttctgaaggctgctttgtcagaatgtatatatcgtttgacctagcaattccactttgacgtatgtttcctaaggaaggtaatagagatatgtatctactaggattcattaattcataatttttgatcacctgtatgccagtcactagggataaaaaaatgaaaagacaggatctctgctctcccaaaacttagattctagagaagtgctgcccaatacagcaaccacaagccacatttggccattgagttcttgaaacgtggatgttgtgactgaagaatggaattttaaattgtaattaatctaaacttaaattgtcatatgtggctagtgtaccatgttggaatgtgcagttccagagcagcgcttcttagaacaaggtgtctaggccagcagcatcagcgtcccctgagaacttaggcatattcttggccctactccagacatggtgaatgagaaactctagggtgggacttacattctgtgttttaagaagtgcccccatgtgatgctgatgtatgcaggagcttgacaacctctgttctaaaggaagtttatgaatattattatactgtcaaataattggaaacaatctacatgtttacctgtagggtatttgctaattaaattattatgcatttatacaatgatatactgtgtagccataaaacaaaagttaattttaaataagatataattattttctcagagtttcccttttgtcattcatgtaagcattctgtcttcgggagaatttattttcactggggttcaattttctgtgtcctttatttcaaaccttatcacatggtattcatttgtttttcattttctgctttttactttatcttttagtgatttggtaagcattatattcatatgacttttatatttctaattttccatgtagcctggagtaggaacaaaaattgctgaaaagattgatgagtttttagcaactggaaaattacgtaaactggaaaaggtaaaattttaacttgtttacttcattaattatagtatctgcctttatggccactatgtagcgtcattgcagggtgaccaatgtcattcactgtagtgagactcacaggaaatgaggtgagtgaagttgatggctttaactttttgaatgttatttccataaaatgttcacttgttttatgtggcatttaagagactattaacacccgtaatagagttggctcatcgttttcagtactattcagaaaagagattataaactttgactgaaagatcgttatcttttagaatttctttatttctttatttatgtttttgagatggagtcttgctctgtcgcccaggctggagtgcagtggcgcgatctcggctcactgcaagctccgcctcctgggttcatgccattctcctgcctcagcctcctgagtagctgggactacaggcgcccgccaccacacccagctaattttttgcatttttagtagagacggggtttcaccatgttagccagtatggtctcgatctcctgacctcgtgatctgcccgcctcggcctcccaaagtgctgggattacaggcatgagccaccatacccggccatcttttagaatttctatgtttacactcacccaagcatttttatggttttatttcaccccatgatagtaattatatcacttctgatctgttaagaatagaccttttaaaagtattggataacttagagatgagacatcttcagttactctgttattcacctattactccttaggttacttgtgaataattttgtgtgggtcacccaggcaaatgtaaatagctcttcatgtcttttagcagactggtatgtttccaataagatcatttaagtcctcaaagcattcctaaatcattgttagacttttttttttcttaaagattcggcaggatgatacgagttcatccatcaatttcctgactcgagttagtggcattgggtaagaactattttttaagcagacacaatcgtcagttagtttatttttcctgttagccaaagtaaattacatgctgtttctcaaaacctgtacttcaccacctctgtaccttagccatacagttcacccttccatagcttatgatctgaggccgattcttcagatagtgtctctactgtaaggtccccatccaaggcagatgttacctccttcatgaaaccagtttggttacccaggcagaaagaacctctccctcctctgaactccactaccatttcctccgtgtgcatctatttcctgctccagcttggcctcttttgtttctctgagcatgatatttatcatagcacctcatgaatttggaacaagccctcaagctttttttaaattattttttgagacagggttgctatgttgcccatgctggtcttgaactcctgggcttaagtgattcttcctcctcagcatcccgagtagcttggattataggtgcacgcccccttgcccagcttcaagcatttttaaatgaagggattattatcttaaaatttgagctggtaccaaggtgggcttttttgacactggctgaagtaaagattaacattgaaatattaaggctttagtgctctcatctttatggcatggggcattcctttaaatataatgatttgttctttaaatggcagcattttcggtgaaagttattctaaaacatattaaattcttaaacctagtatgttgaaaatgaaaatgactgcttggggactcaaggccattataaaattttcattggaagaattacaaaaattttttttttttttagagatagtgtcttattctgctatctaggctagagtgcagtggtgctattatagctcactgtaaccttgaactcttggggtaaagtgactctcctgccttagtactccttttgagtagctgagactacaggcttgcgcaaccatgtgtggccaatttttgtatcttttgtagagaagaggtctccctatgttgcctaggctggtcttgaactcctggcctcaagccttcctcccacttaagcctcccagagtgctaggattataggtgtgaaccacaaggtgttttagagagcatctattatcctttttttctaggcaagagaactgaaagttgaatatagaacatgagtaaccatggcagagccagatttgaacccatatcttctgactccgagttcagttctgtttcttctatgctgcattgccttcctaacatcagtatcagtttctatatcacaatataatgtgatgatatttgcatagcttactgaatgatacaggtttatttgtcccgaaacactgtggccccagactattgtgcttgtatgtttatatgtgtgtgtatgcatttctttctgttcaccgctcctgctttattatgctgtaaactggtatggtgagaagagagtcaggaaatctggataatggtctagagctagcaccagctagatttgtgaccttagcaaatcacttcatctttctaggtttcagtgtccttccttatgaaataagagagaaatttggttaatcagtaagcttccttctgtccccatcctataagagcatcttcagtcatttctgacattctgatttatttatatgaataaagtgatattttagaaacctaaatcagattttatcattgctttgtgcagtgtcctctaatagctttccattgcactcagaataaaatccaaacctatcaccatggctctaaaagcacagtagagtgtaacacctgcgtactgttccatagcacctcataccgtcacttacatcactctatgcatcctagtttttctcttctcttgaacaggccaagctcatgccagccttagggcccttgcactaattgtttccttttcccgaaacgtttttatctttgatcccctagatagctggttctttagtcattcaaacctcagcttagataccatctcagagaccttctaccactcagtctaaagtaggacccagccattctgtcatattctattttaatttatccatctgattttttcttgtttatgtaactaactattgtctctatctacccacttacattcttattcctgctacattttcagcacccaggaaagtatctgacacataatggccctcagtaaatcttagttcaatgaatgaacagttttcaagtgccatctgtacatgggcactatgacagcagctgcttagacatcctttttatgtctgaattcatagttgtcttcctaatgattgaagcttcaataattcgtacttcggatacagttgaacattaccaaagtagccatgcaacattttagcaggtcttgtttagcttaatagcagctcttcttactattaagacatggttgttacaaggatcccaagtttcacccaatgttgagataatgcttttgtttttgtagtccatctgctgcaaggaagtttgtagatgaaggaattaaaacactagaaggtgagtatgactgtaggtcactaattccagattaaatatggtcctgaaggaccattagtgctctaacaaacttcaacttgaaaaacccattctcaatcagtagatacaaaagataagattttctttttaactctgtagtacagtagatatagggtatagtttatattaccatcataaacatttttaggtttgtaactaactcagagaaaactaagaagaccaagaaccagggccaggcgcggtgcctcatgcctgtagtcccagcactttgggaggcgggtggatcacttgaggtcaggggttcgagaccagtctggccaacatggtgaaaccccatctctactaaaaatacaaaattagccgggtgtggtggcaggcacctgtaatcccagctactcaggaggctgaggcaggagaattgcttgaacccgggaggcagaggttgcattgagccgaggtggtgccactgcactccagcctgggtgacagagtaagactctgtttcaaaaaaaaaaagaagaagaccaagaaccaacctcttgacttaaaagcaatgaaatagttatcgtttgcaaatttttcaaatatctaaattgcctttatttctttttttttttttttgctctgcctcccaggttcatgccattctcctgcctcagcctcccaagtatctgggactacaggctcccaccaccacacccggctaatttttttttgtatttttaatagagacggggtttcactgtgttagccaggatggtctcggtctgaccttgtgatctgcccacctcggcctcccaaagtgctgggattacaggcgtgagccaccgcgcctggccccctttatttctttaataaaattttaggcaataaaatcttagattaaaagctaagttatatattactgaaaaagattctgtaagagatttgtaatggttattaaaggaatttttgctttcaaagaaaagataaaaatagaacctaacaagtaattataaaacgttttccttaaatatagtaatcctttacatgtaatttatctctttatacttttcatgggtgtatgtatacatatggattcattacagcatatccatggcatttgggatttagtatttgtgagtatttgcaagcagcccagtggttaggtaggcaggttttggagactgacctggctttgaatcccacctccactactttattagagtgggatgaccttattgcgtcagtttcacacctacaaaatgggtatttctgcttcgtacaattaaatgcaataatatatgtaaagcacttagcagagtgcttggtacctagtactacttaaaaatggtaaccaactcttatgaggcatgattagtagtattactaagttaagaatttgtgtgagccacattgctagagaatgaactctacatgtgcatctcatacagggtttatgctttgatgcctgtggtatagacagcttatatgagagaattgattggctaaaggggtcaagaatctgtgggtttcttggaggtattgagttgcatctcttgggagtgtcaaggatctactgttgtggtttttatatttcacaattcacacataaggaatacaactgttgatatctataactatatctgtctaacatactcagtatttccacttcttcagttttagtcgtatactttagcgttttctgtgtgcacataaccataggaaatattaagtgctctatatttcataaagatgcttatttttctcgattttatatctccagagggaatgtgtatatttgtggctataagggggcttgtaggaattgcttttgaagcatgcttatcttgctgtttctttaacaaggctcacagctggattcatgcccagtaaagggacacctgaatggaactgagtcacttttagacttaatatgggatgttatgacaattcttaagttaaaaaatgcaggtacagtaataattttcctttcaatggaatttttttttgttttgagacacagtcttgctctgtctgcccagaagtacagtggcgcaatcttggttcactgcaacctccgccacctgggttcaagtgattctcctgcctcagcctcctgagtagctgggattacaggcgcgcaccaccatgcctggctaatttttgaagttttagtggagacagagtttcaccatgttggtcaggctggtctcgaactcctgacctcatgatcctcccacctcagcctcccaaaatgctgggattacagtcatgagccactgtgcccggctcaacaggattttgagcacaatgactgcacaaatctactactcagtgctaatggaatgaaagagtgaaagaacaaataaactatgaataaacctagttaatcagaaaacattcagaagttatggttactactgttgctcttaacaataaattaaaccactatagtcagtaaaatttggtgtgattctggttttttttgttgtcgttgttgtttttcgagacggggtcttgctctgttgcccaggctggattgcagtggcgcaatctcggctcactgcagcttccacctcccaggttcaagcgattctcttgcctcagcctcccaagtagctgggattacaggggcacaccaccatgcctcgctaattttttgcatttttagtagagatggggtttcaccatgttggccaggctggtctcgaactcctgaccttgtgatccgcccgcctcggcctcccaaagtgctgggattacaggtgtgagccaccacgcctggccctgaagagtcacttttatctagctcttcatatctgaaatttttgtctcattgtgttttcagtcatttcaatgtatttgttccccaggtggttctttataaaaagggtcattgagtttagcattttccccccaaaaagcatttaaattaacatgtcaactttatttatcttctatacagatctcagaaaaaatgaagataaattgaaccatcatcagcgaattgggctgaagtaagatggcagattttcttttgacacttgagatataaaagtaaattttttatagacattcttttatacaccagaaggactcttcaaacttagctaaaccacaaccattttcctattcagaagtgctaagatttgtggactcttacagagtatctgcctgtgttcacacaatgctttcacttttgctttctagtttacttgttttgaggatttcccttattcttttgactttagcagggaacttcctcttaaaatacctaggactgagtgtatcaggcagtcagcgggtgtttatttcatgctcacattgtacaaagcactacactaggtctagggtaaagatacagagaggttgagtgtagcttttaagaagtttatagtctacccgagaaggtaggacatgaatatgaaaaactaaatttaaaaaaaggacaaacctcatacctaaataaccatataggaataactactaggcatgtttctatatcagcatcaataattattttgtgtgccagatatagtctgggaaccccttttctaattatttacagttatagtgcataagcactatatgtatctcttctggcattatatagtgttgtgagtgattcagtcctaattaccttttgaattttcctgttgatgctttaccataatattttaaacttatactcccattccaaaatcttgagccagtgagagacctggatggtatggttcttgctctcctggcatttctgtagtaaatggaggtgttctgaagaactggtttgctgagaattggctgtgaataggtgcttcatcatgctgaagcatatgcttagttgctgtttcacactgaatttcctaacagccttattgagatgtaattcatatgtcctgtaattcatccatttaaaatatacaattcagtgacttttagtatattcacagagttgtgcacagtgtaggaaccatcactacagtcagttttaggacatttttgttatctcagaaagaaccctgtacctattactagtcattcccccattgcctccccttacccccacctcagacctaggcagctgctcatctactttctgtctctacggatttgcctattctggacacttaatgtaaatgaagtcatacagtatgtggtcttttgtgactgacttcttccacttagcatattgttgtctgagtttatgttgcaggatagtatttgaaaatataattttgcaggatataagagcggtaaactgtaaccccttgccttgtcagtagacagcagtttactttgaaaataatgccctaacttaaatatatttatttactcttgttacatgaacacatagtttatttacaaataagtttagatggagcctttgaaatattacaaagaatgacacttaaggatttttatccagtttaggaataaacctccccccattcactccacccccaattttgctgttgtcatctcagtgaattcattctagccttgatttgtgagaatgatctgctggtatggcacggacaattgttataaaaggcaatttaatttttaaggagatttaaattttacgaaaatcttttgtctacttattctgtctttatagatattttggggactttgaaaaaagaattcctcgtgaagagatgttacaaatgcaagtaagatgtgtcaaattatattctttgattagaattgagagtgtcacttggtgaaaagccattttgggaatactgacttaatttttcttctattaggatattgtactaaatgaagttaaaaaagtggattctgaatacattgctacagtctgtggcagtttcagaagaggtaacatacttcctaatcttgggttatttttgccctgatgttaaaattgcctaatatatgggaagaatttggattaaaaagatgtaatttgtggtacttcatagactcactaagacctagtagtattagttaagggtatttgtttatagatgggaatatgtaactaggggaaattcatcctgattttattataggatgatattttaatgactagttttaacgacgtttattaaatgactttaagtatattgaaatgctagtaatggttgtctttggccttttggctggatgatagtgaagttgtgggtagttttgttaatttacctttctttttcctttttttttttttttttgagacagagtctcactctctcgccacgctggagtgcagtggcaccatctcggctcactgcaacctccgcctcccgggttcaagtgattctcctgcctcagcctcctgagtagctgggactacaggcgtgtgccaccatgcccagctaatttttgtatttttagtagaaacggggtttcaccatgtttgccaggatggtctcaatctcttggcctcgtgatccacccacctcgacctcccaaagtgctgggattacaggcgtgagccactgtgcccaactgcccaagttttctataagagagctaagaataatgtcttagaagtaccagttcaaaaccaattcttacaacaaccgggttcatcagaagagttctgcttagtgtgtgaatgtgagcaaagtaagaaccatataatcctggtgtcttactggtttaaaatattgaaaagctcatacatgcttaaaaatattaacttttggccaggcgcggtggctcacgcctataatcccagcactttgggaggccgagccgggcggatcacaaggtcaggagatcgagactatcctggctaacacggtgaaaccccatctctactaaaaatacaaaaaattagccaagcgtagtggtgggcacctgtagtcccagctcctcgggcggctgaggcaggagaatggcatgaacctgggaggcggagcttgcagtgagccgagatcaagccgctgcactccagcctgggcgacagagcgagactccatctccaaaaaaaaaagaaattaacttttaaaattggaatagaaaaaccttatttaaaacattttagagtatgttagagtagatagagtagatacctgaactgaatctctggccacctgtggagttttgtctaggaagtaggtgatggcctatcaggaatactctgggtagctgctgtaagaatctagagttggagagagaaaactaaatccatactcactgatcagtagaaagaacattggactggggtcaaaagacctggggtctgaggccaaatctaccactattatgtctctcctgatcttagattccatactcgcaaaatgagagaactgaagttaaccagattttcaagtatgtctgcatcagaaatacctaggacttaaaaaaaaatacatattgttgtacccttctgcaaataagaatctccttaggtgggaactgggattctgtattttcaaaatgtagatttggaagcacagcaagccaaatgcatgctatgttggctatgacagccttcctggatttatttatttctattttaattttacttttttggggtatgttgtatggttatatgctttcacataaaaaggtatactctaagacatctcacttccacagtccctatgcactctttcctactccttctaagtcccattaagaaccacttccctatggattcttgtaacgtttcttcatgaaaatacaactaaatactagtataccatctttatttctttcttctctccctttctttcataaagttacataatatatatacaatactataccttgcttttttcacttacaaataacatcctagagatttttccatatcaatatatagaaaacttccttatttatttattttttgagatagggtccctctctgtcacccaggctggagtgtagtggcgtgatctcggctcactgcaacctccgcctcccgggctgaagtgatcctcccacttcagcctccagagtagctgggaccacaggcacgtgccaccacacccggctaatttttttttttttttttttttttggtagggacatggttttactatgttgcctgggctggtctcaaactcttggctcaagtgatccacccaccttagcctcccacagtgctgatattacaggcatgaaccaccatgcccggccccttattcttttttgtagctgtgtaacattcagttgcatgcatgtatcatacttcatttgtttatccagtccgctattaatggacccttgggttgtttctctttctttgctcatacactttgtttttgttttttttttaataaagtgaaacatttttgttggtaggcggacagtgaaagacatccagcttttaggaggaggaaatgagaacaagagaaggcaatagaattttcttgattaaaatagtttccatggatgtccagtacacattcagtctagtcttctttttttcttttttttttgaggcagagtctcgctttgtcgcccaggctggagtgcagtggtgtgatctcagctcactgcaacttccacttcccaggttcaagcaattctcctgcctcaacctcctgagtagctgaggttacaggcaaacaccaccatgcccggctaatttttgtatttttttttttttttagtagaaaaggggtttcaccatgttggccaggctggtcttgacctcctgacctcaagtgatccgcccaccttggcctcccaaagtgctaggattacacgtgtgagccaccttgcccggcctggccttctttatatttaaatatttggttaaggcactgtggctcatgcttgtaatcccagcactttgggaggctgaagtgggaggatcgcaaagacactgcaagctctttagttaccaaaagggtgtttggcctctgttgtacttatcaaaatgaaagggaggagatagattggattcttttatgctgtataccaggcactatagtggatgcttttacatatgttcttatttacttacacaatagcatatgaagtagtttttagtagtttacatataagaaaactgaggtctagaggaatgaagagtcctcacttgcaacactgaaaaaaaagtaaaatgaaaaaattccatctcagtggagacagaatttcatagaatataggaaaagaaaggtttaaatagctgtatataacttgcctgaagctatgtggttgtagagtatagacctattaattgagttcaaccataagaattgaaatgagttttctttttaaaaaaaaaaaaaagagagtgcctggatctctctgtgttgactgggttggtctcaaactcctgggctcagcgatcctctggcctcagcctctcaaagtgctgggattacaggcatgagccaccgtgcccggctgaaatgagttttctgattaacctttatagagttagagtatattgtttaatttgagatttttacatatagagttgttcataggtgtattttaaagctattttaaaatattgtttttattcattattgagtagttacttaggtgcatttttaatacattaaattaactcgttgtatgcaatgtatatctaatgccaattactgttgtcatcacagattctgctgtctacatcaatacacctgaatagttggacagaaaattgaaatcttttaactaattctaactatgaagcacagtgaaatagaaagttaggctgtaagaagtaaggctcttctgtgtgtcatcagcttggttccatttgcccaattgatacatttacatggacaatctcatatgtgtcttctgtcatcacaggtgcagagtccagtggtgacatggatgttctcctgacccatcccagcttcacttcagaatcaaccaaacaggtgcctcagagtttataatcaatggtgatcagtcttacacaacagtgaatttcactttttaagtgatagttgggtattttcagaataagttttgttttcgccttcctgaaaagtctgaagagctttgtactgattgaattctgcgaaaggcaaatttctcgaaaaggatacctattattcttccatgagttgctgggaggacagtctaacatttgaaagagaaaacattgaatacaatagttttagaacgatttactgtctgtgataaatactttagaaatactataatcagattttcattaaattttatcttaaaaaatgaaatattgagaaaccttctattagaaaacctgtgaaggcaaaacattttttattttagaatatatgcctttggaaggtgaaacagctgactctttgattgcttttttttcccatgagccatttcaagaacaggaaaactctttgatttaaggaaacagataaatacaactgatcattgtttttacaatcgtaataccttaaacagtggtttctaaaaatatgtttcatttgataagatgaattttctattagagggaaaaagtacttgctcagaacattagaaaacatagagatggccgggcacggtggctcatgcctgtaatcacaacactttgggaggccaaggcaggtggatcacgaggtcaggagatcaagaccatcctgcccaacatggtgaaaccccgtctccactaaaaatacaaaattaaccaggcgtggtggtgcgcgcctgtagtcccagctactcgggaggctgaggcaggagaatcgcttgaacccaggaggcaaaggttgcagtgagccgagattgtgccactgcactccagcctggcaacagaacgagactccatctaaaaataaaataaaataaaataaaataaaataaaataaaatagagatttctccataaataattagaaaactcatgttaaaaatgttttcttcccgggctcgattccctgccaaaaaaaaaaaaagttttcttattcaggcatgatgttgttcctggtactctggatgctgaggtgggaggatcacttgagtccaggagttcaaggctatagtttgccatgattgtacctgtgaatagcacagtctccagcctgtgcaatatagcaagactgtgtctctaaaaatattgttaaatattttcttgccattacaaagtaattactctttttcttattccctaattatgattctacagccaaaactgttacatcaggttgtggagcagttacaaaaggttcattttatcacagataccctgtcaaagggtgagacaaagttcatggtaagtacttgttagagttagcacatctaaaaaaaaacttggagactgttcagtagccattctgagtgtgtgacttcatggtagctttgaattacagtcaccaaatagagtatccatgagactttaaagaaaaataatagcaggggccgggcgcggtggctcacgcctgtgatcccagccctttgggaggccgaggcgggtggatcgcctgaggtcgggagctcaagaccatgctgaccaacatggagaaaccccgtctctgctaaaaacacaaaattggccgggcgtggtggcgcatgcctgtaatcctagctactcaggaggatgaggcgggaaaatcacttgaacccaggagacggaggtgcggtgagcatagatcgtgccactgcacttcagcctgggccacaagagagaaactccgccaaaaaaaaaaaaagaaagaaaaataatcagcaggatgcctgattctcatagctactctcagaatattttaggaaagaattttcttttaattctccacttgtaaataacacgtgtcatcagaatagttaattaggcctgggcatggtggtgtagtcccagctctttgggaggccgaggtcagcggattacaaggtcaggtgatcaagaccatcctggccaacacggtgaaactccgtctctactaaaaatacaaaaaattagctgggcgtggtggtgtgcgcctgtagtcccagcttttcgggaggctgaggcgggagaatcacttgaacccgggaggcagaggttgcactgagccgagatcgcaccactgcactccagcctgggtgacagaccgagactctgtctcaaaaaaaaaaaaaaaaaaaaaaaaaaaaagaatgggttaattaggcataatctgctttttgaaaataccagtaatgactttgacacacagtaagtttttccctaaaatagcaaatggttctcatcttctctgattcagaattcttcaataagtaacgtagttagaattgattgaaaaatattaatctatttcaacaccaaagaaagaaaagtcatcagggtctgtgatagaacactcaggggaagaaacgttacatggaatgataatgaggaaagttgattgggggggaattaagacttaataattcaagatgaatggctagtggattaaaagcagattaataaatgattctgtataaacaccaacaggaaggcagatagaaatctagaattacgattctttttttttttttttttgaaaaggagtttcactcttgtcacccgggctggagtgcaggagggcgatctcggctcactgtaacctccacctcccgggttcaagcagttctcctgcctcaccctcccgagtagctggaatttcaggtgcctgccaccacgcccagctaatttttgtatttttagtagagaccaggtttcaccatgttggctgggctggtctcaaactcctgacctcaggtgatccgcctgcctcagcctcccaaagtactgggattgcaggcatgaaccaccgtgcccagcctagaattaagattcttagttcctttttttttgaaacagggtcttgctctgtcacccaggctgtagtgcagtggcgaaacatggctcactgcagcctcaccttccagggttcaagcaatcctcccacctagtagctgggactgcaggtgcgcaccaccatacctggctaatttttgtattttttgtagaggtggggtttcaccatgttgctcagactggtctcgaactcctcagctcaagtgatccaccctccttggcctcccaaagtactgggattacatgtatgagccactgtgcccgggcctcttctttcttaaggtgacatttagtgttctgtcacttatatacatcattcgagtccattttctcaacaccccacttttcccgggtgatatgactgaaaggaaagagactgtgcttttggagagtggatgtgctaaaattagtaagagtctcagtgcatagatttgacaagagttttagccaaaactagaagatagttgagaaagataattaaattgtcatgtcattcagaaagtagagtggtgtttgccagggcctggaaggagggggtaatagggagttcctgtttaaatggcacagagtttcagttggggaagatgaaaacattctggagatggatggcggtgatggttgcacaacagtgtgaatgtacttaatgccacagaatggtacacttaaaaatggttaaaatagtaggcacagtggctcatgtctataatcccagtgacttgggaggctaaggtgggagaatggcttgagcccaggagttcgagggtatagtgagccatgatcgcactactgcactccagcctgggtgacagagcaagaccccatctcaaaaaagaaaaaaaaaatagatggccaatagatggtaaattgtatgttgtgtatatttaacccacacacatacaaaaaatcatgtcattaagttcagcatggtgatattagtgggctgtgaaagtgtattttctaaggtggtcacactttaacaatgcttccaaacgaactttggaaagataaaagtaaaggttctagtcagtcttggaaattaaatctctgatttgttctcttgactctgtcaagttttgaagtcttactctgttcccaaaagtatatacatacatgagatggtattaaaaatagggcttgtgtatgccccatgaacagccttttcaaatttaggtggattttaattcactcaaaatgaatgtgcatgaatcttacatttaagaatattcagtcagataaaatcctaaaaacagtatctgctagacaagttggatgttgtgcacagtagaaaagtatcttgctacgtctgggcatattttggggacctctctggcctaaatcttcctcaagtatcatccctgtgaaagtcactagaaatccttactgggaagtgtgccaactgttttcagagttaatgaccaggaaggtagttccacactaccatggcagaagctgtttttttataatcttaatggtgttctgctgtgctcgaagagagatccagaggaaaaaccaacagaagctataggaatccagctagcaagaatacaaggtaaaagggccaggcatggtggctcacgcctgtaatcccagcactttgggaggctgaggcaggtgaatcacctgaggtcaggagttcaagaccagcctggccaacatggtgaaaccccatctctactaaaaatacaaaaattagctgggcgtggtggcgggcgcctgtagtcccagctactggggaggctgaggtggaaggatcgcttgaaccaggaaggcagtggttgcagtgagctgagattgtgccagtgcattccagccctggcgacagagcaagactccctcccaaaggaaaaaaaaaaaaggaaaaagtataatctagtgggctggatgtaacctgaaaaggaaaggtgggtagccaagtctttgtgatcttgttgatagtgttggacttgggttatcccagtacatgtgccacaggaaagaatactaaggccactcacccatcctaggatagaccctatcttgacttccctgtctttcaatcatacatctggcagcacatctactggtattgccaggaaaggcatcccccagacatatttccagaagaaaacaggctaaaaaacaagaagactgggtctgtttatttgtttttaaagtatagaagattcaggtgacaataagaacaagaaactaaggcctttatgttgcgacataggaatccatctcagtgggtggtttttgacaaagtttggatgttatacctgtggttcatagtccctggaacttaaaaaaataccgtagttgagcatgctgttttgacatttgtaatcattgttaggaagagaagcactcgaggtcaactttcaaatcaattttagagacaggtaagaggtggtttgtatctttcattatagaagaataaatttggatacagaagatagagggtcttattctggctccattactaatactctgtatggcattgggaaggtggatttacttctaaaaggcctgagttttatctttaaaattgatatttgccctacgtcagaagaccgttatgcagatcaaaattaaatagtatatgtggaaactttgaagagtttgtacaaatatttgatgtacaaataagaatttgcacaacttcaaagataatggatcttccaagagttgtacaaagagagctgcacaaatataagatgtcatctgtgtggaaatgggtcagtagaggcaggtgacctggtaagggttagattggggaacaaaagaagggatagaaagagagaggatggtgccatgaaaggagaacagaatgaggagagtgagcacccccagggcagcagttgtattcagtcagttcagcaaatacatacaagcatgtcctccattccaggcactgttctcgaagcttgggatgtatccatgaatttaagtaaaactcatatttgaggactgtgggaagggactgatagttaacaatgaacataataaatatgtgaattatataataggttgggtagtaagtgttattttttaaaaaggaagaacagggtctaggggagaggagagtgcaggaggcagtattaaatagtgtggttggaggcagcctcattgagaacatgagacttagggaatgacatagggagttagctaagccggtatctgagggaagagatagccaggcaggagtccgagcaccaagcctatgggaatgagcatgagcaagatatctaatgaagatgagagctctaggcttctaaaaggaaattggctgcaaaatgaattcaacttaggtagtgaaataaaccattctcattccatatcccctttttttgcaaaacctcttcttgctatcaccacttactagtcttaaaggtatgcctcttcatgtgtttttcaagttatattcaagacacaaattcctttaagctaatagtaatcaaaccttaggaaagccatggttattccagatcatcttgtgcaatcatagtctttagataattgagctatactatattcctgtgaatatagtaacactcagaagaaaaaaagtttcctctgcattcaactattggttttatatacggtgagtgccattcagatttcagtattttgtgcaagtttggccttgggtgattttctgtgaaatatctgcagtaagaattcaagggacaataggagataccatggctaccccgaggaaatgaaagaggttttatttccgacactcagtatgaagctacccaaatgaaatgccaaacaaagctaatccactcaatctaatacagaatttacagtaaaacagagaaattctttaatattagcacttcagaaaaagtgcaggaaataaaattagccttgaggaaaggaacaaagccatgagataaaatcctattactgatgtgacaaacaggaacatcattccctgtggtatctagacatccgcatccgcaaggtaatacctcctggtaattccaggtggaaatgacttctgatccacttgaaggtggaagttgagttggaacttgttagtgcctaagaaggtaggtttcatattttgaaggtaaacatatttcattaatctttcttccataggaacagctaaagaattagtttagattttaatttttctattttgctgagtgaaaaagtatggcttttagtggcatgtgttaacttgaccactcttgaggaccagaagcttgtcacttgtgtatttttcttagaatgtagcatttgatacttttaattggaaatttggtggtgcttatatcttgttttacatatgtatgggttgctgaccagtccagattttttgtccatttttcaggaaagggaaaagataaaacagacttggataacttttgtttggaaattgtagaagtataatgaaaaattacctgtgaaggaagaaagtgatcccctcattttctgatctcatatttttcttattttccgtgtctttctcccttctagtgtctgagagatttcttcaatttcaaactcttttacttctgctacctatcattttaaattttgatttaaacctttccctgagggttttctatagtattctgttcttacttcatggatagagtatcttctgttattactggaagcttttttgtttgagactatactggtagcttttttgtttgttttcttcttcctgcataatcatcgtttcttccacgttgctctcttctgtttattttgatgtctgtgtttcgtgttcagggttttctttgattagtttcttgcttagaatcacacaaagaccaaatcctcataatgagaatccttatttgcagttttgtgtagttctctaattatcgtgaagtgtaatagaaaggtagggatagtgtattgctcacagaagctgctaagttaaaagtgctcagaattctagagctgctaacattaaaaacaaaaatggccttgtgttttacttgattaaaattaagccttaagtttagaacatctttaaacttggtttaaaatgttcattttagggtgtttgccagcttcccagtaaaaatgatgaaaaagaatatccacacagaagaattgatatcaggtattgttcagactttgttgctgacctgttaacttttccaaacttgtctcgttttctccctccctgtttgtatcttggagttcacattcatatctagagcctttttttactcccaagagccatatgttcttgccaaatgcaatgtttagctccaaagtatgtaaagaataatgactgtctacagactccaatttattttctctagatttgcacctcaccatgatgccttccacagctcaaaagtcatttcctgcctgggctaagttagttgtaataggtgataatgcaatttcatttctccacatctctttcagaacaaagttcacagaaacctaaacaaattacaaggttggggtgatttgagcagtctacctcatgatagtcttctcttcaaattattagaccacttaggcttatctttggtattttgttccttattgattttaggagtcctatatttgctaaacttgaaatgcatggtaaaaaaatgtatctactgtccattttttttaggttgatacccaaagatcagtattactgtggtgttctctatttcactgggagtgatattttcaataagaatatgagggctcatgccctagaaaagggtttcacaatcaatgagtacaccatccgtcccttgggagtcactggtgagtgtccatgtgtgtattagagatcatctctcatctggagagaaggttattttcaaagatactttggtttagcaaaccttctaataactatgccagttagtgtagtttctttgtatttttagtccttcaggcaacgagagaggatttaatgcataacatgctcctaggccctcagttgaaggccatcaaggcaagcgttagttccagctttgttaaaatggattaaatccttgcatgctcagtaaaatatcttattcatctaaaagggtttttttttttttttttttttttttgctgttgtttaatgtacctctaggacccctgaaaaactcaagtatcattgttttcagtgccacatactttgcttttagtgccatggtatctttggccccatgcttttaaagtttaaagaataaggattgctgaatctatgcttaatgggttctgttaacatttcacagtatactatgtggtttactgttctctactaggagaatgaatttttgtcattttgtcctcaaagtataaaatactttgtcctcaaagtataaaatacctcatccctggtagactagggcagtgcttctcacaattcagtgtgcataccagcaacatgggggcctcactaaattcagattctaattcctttggcttgcagtggggctcaggattctgcatttctagtaagcttctagatcagaggttaccaatcttttagcttccctgggtcacattggaagaagaataattgtcttgggctacacataaaatacactaacactcacgatagctgatgagctttaaagaaaaaaatcataaaaacatctcatcgtgttttaagacagtttacgaatttgtgttgggccacattcaaagtggagctgggccgcatgcagctggcgggccatggttggataagcttgttctagataatgccagtgctgctagtccaagaaccgagttgcaaaggaactcactagagtatataatacatagtggctccagcagaaaggacaatcatgagtgaggatgacttgagtggccctagctgggatccccaggttccctttgtggcactgatgactcacgagatgaagctccagcacagcctcctgggagaggatagaggtagtcagtgtctttttttttgaaatggagtttcgctcttgttgcccaggctggagtgcaatggcacattctcggctcactgcaacctctgcctcccaggttcaagcgattctcctgcctcaacctcccgagtagctgggattacaggcatgagctaccacgcctggctaattttgtatttttagtagagatggggtttctccatgttggtcaggctggtctcaaactcctgacctcaggtgatctacctgcctcggcctcccaaattgctgggattacaggcgtgagctaccacatccgccggtctttttttttttagtgacttggttaccattttcttttttcttctgaaagcaagtcccacacagctcttaatcttgaaccctctataactaaactataaaactggttcttacaataagtttttctctctgtacttgcaggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactattattggatgatgatgatcttattttcttagcaagtatgtttagtttaaattttcatattgtgttcatgatcatactttactatgggttttgtagagagaaatatgagatgatagcagatctttaatgggaatttttattttctcatattctgctctatgctataaaccacattacccctacttactgatcaaaaattgttaattaaggtacacccagagactagcctctggaagactgttcaatattttctagaaactgggggggggcggggcacggtggttcatgtctgtaatcccagtactttgggaggctggggcaggtgggtcgcctgaggtcagcggttggagaccagcctggccaacatggtgaaaccctgtctctaccaaaaatacaaaaattagctgagggtggtggcatatgcctgtaatcccagctacttaggaggctgaggtgggaaaattgcttgaacccgggaggcggaggttgcagtgaggcaagatcacaccagtgtactctagtctgggcgacagagtgagactccatctcaaaaaaataaactagggaccttcataaatttagttttttgttgggcccatatttgattgtgtcagtccattcttgcattgctctaaaagaatactggagactgggtagtttatgaaggaaaaaggtttaattggctcatggttctgctgactgtataggaagcatggcactggcatctgctaagcttcttgggaggcctcaggaaggttttactcatgctgggagatgaagtgggagcaggcacttcacatggtgaaagcaggagcgagagagagagaggaggtgccacacttttaaacaaccagatcttgtgtcaactaacagaactcactcatcaccaaggggatggtgctgagccattcaggaggaatccgcccccatggtccagtcacctcccaccaggccccacctccaatactggaggtcacatttcaagcatgagatacggaggggataaacgtccaaaccatatcattgaatcttgtaatataaacttataacctgaatagaaaaacaggtgtatgatttatctcttaaatctgtagcacttgcttgaaatccactagaaagagctcccctaagcacaaccacttctatgcacaaaatacagcccttttaaacttcaaacaaacaaaaatttcacttttttgcccgagttctcctctgggcttttaagcacaagtggtcaaaatgtgtaagtaaaaacactccttgaaagccctgcctttcaaatattaaaattatataaatataaaatatacaaagttatcaaatggtaagtaaagctactgaaaacgtgaaaatgctttataacttgcaaaggactatacaaacataagatatcttgaaacttctttattaaccaaattattttgtagtgaaatgccatttcccttctaagaaatgaatggaaataaacaatagagttattaaggaaaaatatagtatttgctgtgataattttcctggtaagatgtaagaattaatttacttttaacttcagatgctatcattttttaccccctaggatactgtcaggcaccaacccttcaccagaaattgtttaaagatttatttggagagagagatgtggctcggttatagtatatgtatttcaaaactcacacagtacactttaaatatatacaatttcaattctttgttgttgttgttgttgttgttgttgttgttgttttgagaccgagtctcgtactgtcacccgggctggagtgcaatggtgcgatcttggctcattgcaacctccgcctcccgggttcaagcaattcttctgcctcagcctcccgagtagctgggattacagacatctgccaccatgcccagctaattttttgtattttttagtagagacagggttttacagtgttggccagtctggtctcaaactcttgacctcgtgatccacccacctctgcctcccaaag

SEQ ID NO: 12134 - DNA, 37838 bp, Human
tcccaaagtgctgggattacaggcatgagccaccgcgcccggctgcaaatcttctgtattttaatcataaccatgtccactatatattccttcggataactaaaaattaaaatatttggtgtattatttgcaaggagtcaaagatgatgtcttttcccagaggcatgaaccttagaaatgctttcgatggggatgtttctgtaacactgtgttattctggatcttcaaataatagcaaagccagttactctaaatgtaaaatttttctattcccaaggttcacttttgtttggtaggttttcacgattttaaatactgtttaatggaagaaaaatacgtagccaggcgtggtggctcacacctgtagccccggaactttgggagactgaagcaggcagatcacgaggtcaggagattgagaccatcctggccaacaaggtgaaaccctgtctctactaaaaatacaaaaattagctgggcgtggtggtgcacgcctgcagtcccagctacttgggaggctgaggcaggagaattgcttgaacccgggaggtggaggttgcagtgagctgagatcacgcagttgtactccagcctggtgacagagtgagactctttctcaaaaaaaaaaaaagtgtgtgtgtgtgtgtagagagtttgtgtgtgtgtgtgtgtgtgtagagagtttatgtgtgtgtgtgtgtgtgtgtgtgtgtgtgtggagagagagtttatttgggccaaaatagaggactgcaacctgggaaacacatattcaagttgccctgaatatatgttcccaagttcaagaaacttgaaacttgtttctttctgatattttccacctatttggaccaaataatgagctgtgtttattttgtaattacaaaatttgcttatataaaactacagaggaaaacatttttatttggggcaacaatgaactgcttttataaattaatttaaaatatggttaatatggttattctccccacaccctaactatacacctgtattcacttgacatgaacaaactgctttgtgtttgggattcaggtaaaaggtgatttttgcattttctagtaatagtttagaaatcttttcatgtcagcatcttgaaatctacctcattatttatttatttatttatttatttgggagacagagtctcgctctgtctcacccaggctggagtgcagtggtgcgatcatggctcactgcagcctcaacctcccagactcaagcgatcatcccaccttagcctctggagtagctaggaccacaggtgcatgctaccactcccggctaatttttgtattttttgtagagatgagttttgccatgttgcctaggctggtctcgaacttctgggctcaaacaatccacctgccttggcctcctaaagtgctggaattataagcatgagccactgtgcccagcctaatttttttcataatttactttttctctggagcatagattcaaaatgccctgaatatatgctctctacttcattcttttaataactatacagtttgctaatgttacgctggagtatcccagtgcttaaaaatataatacacttggctgggtgcagtggctcacgcccgtaatcccagcactttggtaggccaaggtaggaggacagcttgaatccaggagttggagaccagcctggacaacaaagtgagacctgtatctacaaaaaatgtcaaatttttttttttgagacagagtctcactctgtcgaccaggctggactcactgcaatctccgcctcacgggttcacgtgattgcagttttagtagagacagggtttcactatgttggccaggctggtctcgaattcctgacctgaagtgatccacccaccttggcctcccaaagtgctggaattacaggcgttagctgccacaccaggccccaaaaatgtaaaaattagctgggcattatggcatgcacctgtagtcccaggtacccaggcacttgggggcacaggtggaggattgcttgagccagggaggtcaaggctgcagggggctatgagtgtgcgactgcattccagcctgggcaacaaagtgagaccctgtctcaaggcaaaaaaaagaaaaaaaggggggcgggggctgggtgtggtggtggctcacgcctgtaatcccagcactttgggaggccaaagcaggtggatcacttgagtgcagaagtttgaggccagcctgtgcaacagggcaaaaccctgtctctacaaaaaaatgcaaaacttagccgagagtggtggcatgttctgtggtcccagctactgtagaggctgaggcgggaggatcacttgagcctgggaggtcaaggctgcagcgagccgtgattatgccactgcactccagcctgggagacagagcaagactctgtctcaaaaacaaaatcaaacaaaaaaacacaccacttatttgaaataaaatactgtaattggctcttacctgcccaagaactaaaaggtcacacaaaatttgaatagatcttttcatgtatatttcttagccacctcattaggaaatgttttaaagctgaattatattttgtatctgggatcccatttatagccctagagatgatgttattcttctgaaatactaaaagaggccagctgtggttgctcacacctgtaatcccagccctttgggaggccagggcaggtggatagcttgaggtcaggagttcaagaccagtctggccaacatggtaaaaccccatctctaccaaaaatacaaaaattagtccggcatggtggcagtcgcctgtaatcccagctactcggtagtctggggcaggagaattgcttgaacctgggaggcggaggttgcagtgagccgagattgcaccactgcactccagcctgggcaacagagtgagactatgtctcaaaaaaacaaaacaaaagaaacaaaaaaagaaagaaaaatactaaaaggtcaggtttaatagacagaaaaagtaccaagacctctttcttttaggttctttttctatacgtttatgtttgttctcagtacaactcttattgctctgtacaataccaaacttaaatttttctaagacagctcataggaataacattaaaataaacattttaaaaagtgtaaccctgaacaatgtgagaatttttgtgagctgctttgagatacaactgttgtcaagtgggacttattaggcagaatattttttccctttttattttaggaaaggttatttgtcaatgaagaaaatgttaatgagtttcttgaagaggtcctgagctctccattcaaacagtctatgtccttgaccccaccattaattgaagttcttcaagttactgataataagattcaaattaatgcaaaggtaaggaagttgatgggctctatagaggagtaatgaagcacagagttaaaacctaacaaattattgatttcttaatatcataactttaaacaaaatttacataatggttgggcagagtgatgttaagagaagaaaagtttttcttttttttttttttgagatggagtctccctctgtcacccaggctgaagtgcagtagcgcgatctcatctcactgcaacctccgcctcctgggttcaagcgattctcctgcctcagcctcccaagtagctgggactacaggagcatgctaccatgcctggctaattttttgtatttttagtagagattgggtgtcaccgtgttagccaggatggtctcgatctcctgacctcatgatccacccgcctcggcctcccaaagtgctaggattacaggcatgagccaccgcgcccagccaagaaaagccttttgtctgtgtatgtattatgtgctaaacactttgctattcattttcacattatttaatcccaaaataaccctacaatgaggaacaaagagaaactaacacttaggaagtttgagtactagtccagggacatacaatcttttttgactctcaaaccatgagaactatgttatacaatttgtacgttctttctaattcaatcttaattttggtcatttttatagtcttcagtattgaagatgcaaatgatttagtaactaccacaatcgacagacatatgtattagaagggcggctctgaaaaattagaggaattcaagaaaatttaagaaattcaacaatgtgcttataactgttaaatagttttgtagaccatgttgaaaagtatggattattgttgtgaaaggatataatcaggatattagtgccaggtttacattgttaaaaaatgactggcagtaggctgggtgcagtggctcacacctgtaatcccagcactttgggagaccgaggcaggcggatcacccgaggtcaggagttcgagactagcctggccaacagtgaaaccccgtctgtactaaaaatataaaaattagccgggcgtcatggcaggcacctgtaatctcagctacttgggaggctgaagcaggagaatcgcttgaatctgggaggcaaagattgcagtaagccaagattgcgccactgcactccagcctgggcgacagagccagactcaatctcaaaaaaaaaaaaaaaaaaaaaaaagactggcagcagactagtcgtgatggctcatacctgtaatcccagcactttgtggatcatttgaggtcaggagttcgacaccagactgggcaacatggtgaaaccctgtgtctactaaaaatacaaaaattagccgggcgtggtggtgcatgcctgtaatcccctctacttgggaggctgaggcagaattgtttgaacctggaggcagaggttgtagtcagctgagattgtgccagcctgggcgacagagcaagactccgtctcaaaacaaaaaaagtcatccttcaaatgctgcctgtctttttctttttttgacagggtcttaccctgtcacccaggctggagtacagtggcactatctcggcccagtgcaacctccacctcccgggttcaagtgattcttctgcctcagcctctcaagtagaggggattatcaggtgtgctccaccacacccggctaatttttgtgtttttagtagagatggggtttcgccatgttggccaagctggtctcgaactcctgacctcaagtgatctgcctgccttggcatcccaaagtgctgggattacaggcatgagccactgtgcccagcctggaggatgaattttgacaggaaagcctggatgtatacctgcaggtctgtaagggctattacctcacaactgttaaaaattttatttccagagggtagtacaatttaattttgtattatttaaaataattattaatttgttgtttctcttgacacagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaagataacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaaattttgctttgtcattaataaaatttaaaaatattcactaattgtgtttgtcacacaaagtaattctcaagaatgcatttaactggaattataagtacatgtgtggggggtagaatttcaaaactgtttctcagtctcactaagtaggacatatttaagcttgaaatagagcttagaggggaaagaactttactaaccaatattaatctaaacaattacgatacaaattcaccagataaaatgtagtacttttcatcagctctatattttgtcacacaaactatatatatttttgttacataaagtatatataatagatttagttatttagtaatgattttcaaaattcaattttgaagtatttcttagaagttattgaaatattaaaacatcttgtggttttatagaaatttaagagtaaaactggaatttttaaaatctggcaatttgctctgataggaaaattgccttcattacattattacacagaaaaacaaaaaaaagccagtgtttcctaatcactttctttttttttaagagatgggtcttgctatgttgtccagactggattcaaactcttaggctcaagtgatcctctcatctcagcctcctgcataatcaatttcctttataacacctaaaatgtgaggcaaagagaagatcctaacaggtttttttcttacaaaaaattttagggcagccaaagaaaatgaaaggaaggaaatacagaaagggaaatatttgttgatttaatcactaaccccaaagccaggagctgatctatttgtttcaaaaacagctactacttcacactctggccttcttagctcagtcctggaaataacctaattttttagttctttgaactagtgatgtcaggtcagagtaccagaaataggtacaaagcctcctgattcacccttatttataacccccaggcaaaatcttgcaccagactgggccgtgggtaagtctaaaggtagctcgtaaagcaagagaactatttgcctcaccttagataagcatatgtgctcttaaactactatgaatcttaaattgatgcaataattttgagactgccatttaatagttacaagtttaagtaactttttttttttttctttagatggagccttgctctgttgctcaggctggcgtgcagtggcacgctctaggctcactgcaacctctgcctcgagactcaaaggatcctcccacctcagcctctcaagtagctgggactacagatgcaccactacacccggctaattttttgtatttttagtagagatgggttttcgccatgttgcccaggctggtctcaaactcttgagttcaagcaatctgcctgcctcaacctcccagagtgctgggattacagacatgagccaccacacccagcccgtaatatctttacacagaaattagtcttttatgagaaattctcggttgaatgcaattacaaattaagggaaacttctataaacgtctacattaaatatggagcaaaatttaagcctgtttcctataattttctgtatctgtccttttaaaacgtatgatttaagttaaagctggcactagaaagtatttcactttggcatgactgaactttgtatcatttctggctttcaaaaacaatttaggctgtatttcccttacacagcaactttttatcattcattttcaatgcctgggtaatttgaaagccaaacagtttcttgcacagggaatgcattgtcataagctgggttttatttcaaactcaattatacaatgtagcaatagtaaatattaaaatgtaatgctaactcaaaacttgtagaatgccttcactgaattttggtataaagagtaaacaaaacttattctgcaaaaggattaggaacctttttatgcaaaaatgagtattttattttgtcagcactaaaagaaaaaaaaaaacaaaaccactgtatttctacattgaggtgaaaacaatgtttaaactttcttatcaatcaaatacattccaaaagaaagtgtgttctatgaaggttccaaaacacactcaaaacacaatagtacaggaatctaatactgaaaatgactgttctgacagggtgtttaacaaacataacttttaaattattaaaccagtgaagcaatcccttcctaataagtgtgtcaagagagtgaaactgggtttgttccattaataccctaacaatttcatcgtaatactttttactgctatgacagttttaaataaattttgctgtacttaaaataggttttgaaagtggaaaagtgtacaaagtttcagataaaaagattaataaatgcaatttaaataaaatttcccctcttctctcatatcaacaataatcaattttagcagataacagattgagctttaaaaccctactcccaaaatgaaaccttcagttttaaatcttaatcagacataactggaaaagattactatgtatttggacaccttttacaagattttgtttttgtattaaagcagaaaccagttcctaaactcttttattcaattgtatgtcctgtttggacaaatatcaaaaatagaagactgtcgcttttgtaactgtgattttcactgcagtcttctataacttttacagagttcatggtccctaatatctccccaccctccattttttctaggtggggaaatggctaccacagtaaacttttcactgatagttagagtttctggaaacatgtattgtttgttattatttaagagtgactcaatttgggcactctgagtggatggtctacaggttttcttgtgatgcataccacagtctccagcatgaaagatcctaggaatttgaggaaccagcactttccagaattttggaagacaagatacagtcaagtattgaagagtccagtcccagttataatcatcataagtacagaaagtgtctgtgcactcgatcagcttctgataggcattccgggtcaaggctagacccatattgtgctctgtggatttccaagttttcacatctaccttgtcagccatgccatagaaactgcgactggcactataggtccccagggagagaacatcacattcagggcactcttgctgcttcagtttccacatctttttgaagacatggtaaaagtctggggctaagtagtgatcctcttctaggaaaagtataaggccagcataatctcgaagaattttcactctttcccacacaaaatgcagcttccaccaccagtgatgtttggtctgggagaatttggcctctctataatggccgaaggagtcgggatactcagcattgatgcaccccaatttcaaagcggcattcttcggcaggtctctgggacaatctctagggtcactacctggaaactcgttagggtacaactgaatgctgaaaggaaagaacacctgcagaaccggacagaaattcaccccggcgatcagctgattgatctcggtcgaccagaagtcatggctaaagatgacgaggacgttgtcaattccctgggcttttcgaagtgagtccagcagcagtctgaggtattcgggccggttatgcacctggaccaccagcaccagctcccggggggcccaggtgccagccttatctacattcctcagggtctgatcaaagttcagctggtacaccagggaccggtaccgcagcgtcaggttgtccgcctcgggctgggggaccgccgggaccagggaagccgccgacacgttggagaccctgcggatgcccacagccacagaggggtggtccccaccgcggccgccggcaccccgcgcgggttcggcgtccagcaacggtggggcgagggcctcgttcttcctttgtcgcccattgctgctccagaggacgaagccgcaggcggccaccacgagcgtcaggattagcaccttccgtttgtagatgcggaacctcatggtctccagggccgggagcgcaggcgggcgggcgcggaaaggagcagctgcttctgcacggaaggggcgggcgggcggcggccgtcgccttggcctgtcacggtcggaactggcccccgcggctgccctcgctaactcatcccgggccccgggggtcctggggcccgagacctctcatttaccccgcgccgcctgcgctccacacatcctcgcctggcagctacagctcgagcatcggcgccgccgctaggagccgcggctcggcttcgtctccgtcctctccattcagcaccacgggtcccggaaaaagctcagccgcggtcccaaccgcaccctagcttcgttacctgcgcctccagcggccctgcgtcctctgcgctctcatccttacaggggccctagacggccagaactgagcgacgcggcctcgcctcactccggcggggaccgttatgacaacccgcaactgccccgcggcacaccgcggccctccggcccacacccctccggcccgccccttagaccgttggttggtgctttccagacgcgaccgaaggcgcctgaccgccgtggccggctgcctattggtttgcagtactgtcgctcaggtgcagttcccacttccgcctctttcttccctttcctgttaggcgagagctgcgaaaggcgagagctgcgaagggccaggtgtcgggcgctgtttctcggtaagctaagaacgaggctgtagcggctccaataggagcctcccttgctcagaatcctgggtaggactaggccttcttaggaaagggaaggcgagacctatggccctcgccggccttagttcgagagcaggcttctcccttcaggaaaaaggtctcaggcatggcggctatagaatcgcggggcgcgccggcttgataaggacacgtcagccctcgaggctgctgacgggtgactgtgcttcggaggggaaaagtgatactacgctgatgtggttctcgtagaaggaacggggcgggtcgtaaccgtagctacaacgtcgcgcgctgccccagccattctctagagctggaaaatggaggaggtgggtggggggaagggggtcaaagaaactctggtccttaacttccttttcggaagaaaattagatgaaccgcacttttcttttggagcagtcacaataaattaaactcatttcgtacggaaaacggactgtattgggcctcctaaagctgctgctgtcggttttcgtgagtcttgttctatatgagaaaagaagaatggctcggagcattgttaattatttgagatgtgcaaaatttgccgggcccagagagacagcagtatgggacttcagacacctccccacttaatgcctggcattttattcctgactagctgcttcacccattatgtccgcgttcctggaatttgtcatgaaaagaatgatgtatagccaatcaatcgcttgtgttattttaatgtaaattcttggtagacaatttaggaactgccattttttcctctaaaaacccacttgcaactgctgctactcagggcattttgaatctgtgctctgggttgcaatcctcaaacttgccccaaataaacattctacttatatgaattgtgcctcagttcttttttttttttgagacgtaattccgctgttgttgcccaggctggagtgcaatggtgcgatctcggctcacggcaacctccgcccctccccaccccgcccaagcgattctccttacaggtatgcaccaccaccacgccaggctaattttgtatttttagtagagacggggtttctccatgttggtcaggctggtctcgaactccggacctcaggtgatccgcccttctcggcctcccaaagtgctgggattacaagcatgagccaccgtgctcggccttgcctcagttctttaggtcgacaaattagtcctccagtaatttaaacgaagtgtttcaaaaaggtatgtacttgtatgtgcgtttattcatatggaaaaagagtacgtggtggatttatatattactcatttatgtgtacggttttcctgtatatacttgtatagcactttcacttttcggaatgtttaacgtctgctatcttattttaaatattttactacagttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggctattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttaagcaaactttttgtggtttttacttataaatagaattccatgtttagtgtagtcccacctcaaactttactaacaagtttatatatgtatgaagggaaaatactactttactactttttgttttctggtcaatttcaaatgttgaatgaattcataaacattgagcagcttagaaggatctttaagattttgcaagagaaggaacaagataacgctaggcttgtgtatagcaggctgggttgggcaaaggatggaagttgggggatagtaagagctgaccaaatattctgtctagtaggggccgctagccaggtaatgtgtttcctgttacactagtcagatttagtactcaacagccacgtgtggctagtttattggacaacacagatgtaaaacatttccaccgcagaaagttcttttggacagtactgttagagactgtggccttgaatataaaaggatagttcaaaattgacttcacactaaagttctcaatctagtgaaagtccaagatagcataaactgttttttgaacctcttagaacactctgggaggtactcaaaaaaaattttttttttgagacaatctgtcactgtaacccgcactggagtgcagtggcacattcatggcttactgtggcctctcaggctctgtagctctgtaggtcctgccttagccttggagtagttgggtaccaccatgcctggcgaatttgcctggctaattttatttctttttttttttttttaaagatggggtctcactcctgggctcaagcaattcttgagcctaggctggtctcaactcctgggctcaagcaattctcccatctcagcctcccaaagggttgggattacagtgtgctactgtgcttggccagaacttgacagttaggaaggtttaggagttatgactgaaaacaagaaggttgaaattcacaatgaaaaaagttgagccttgtaattatgaaaggcaagaaaagttcagtatcaagtgaaaaactgggaaaaggtaggggttataagaggtcaaattctgccttttgtatatgaatttaagttgactaagatacatgggaatgacagtagttagaggaatgcaaagggctagggtgtgtaggagtaacagatggtttgcacataatcccaataactgactattatagctgcatttgattgtaaaaaaaaatgtaaaaatcatgtatacgagtttatttttaaatacatcaccatcactttttcctttttttggagacgggtctcgctctgttgcccaggctggagtgcagtggcatactcacagctcactgcagctttggcctcctaggctcaagctatcctctcacctcagccttcctagtagctgtagctaggactacaggcatgcagcactatgcttggctaatttttgtattttttatagagacggagttttgccttgttcctcaggctggtctcaaattcctgggctcaaaggttatctacccatttcagcctaaagtgttgggattacaggcatgagccacctcacctggcctaccatcactttttaaagaatgttttaattcagctattttgtaatatttatggacaatccctcaccaacctacaagtttagaaaatcctaaaatacttagggaattcttggttttaaagaccaaaagtaaattaactagaatacagtagcctgggcttaaaatctgatttgggttcatggtacttctctcgtagggtgatttttaaagattaaatgctgcttataaaacacctggaacggctgagtgcagtgggtcatgcctgtaatcccagcagtttgtgaggccgaggtgggcggatcacttgaggtcaggagttcaaaatcagcctgaccaacatggtgaaacactgtctctactatacaaaaattagatggccaggcgtggtggctcattgcctgtaatctcagcactttggaaggccgaggagggcggatcatgaggtcaggagttttgagaccggcctggtcaacatagtgaaaccctgtctctactaaaaatacaaaaattagccgggtgtggtgacacatgcctataatcccagctactcgggaggctgacgcaggagaatcacttgaatttgggaggcagagcggaggttgcagtgagccaagaccacgccattgcacaccagcctgggtgacagagcaagactccatctcaaaaaacaaaaaaaactgcatctactcaggagtatctgaactttcaaaaaagaaaaaaaaaatgccccaaataaacattttaggaagacaaacgcggtaaggtaattattttgtaagaaataatcttacagagaccctgctaacaagcccaaaacagcaattacattaacactggagagggcttttctccagtaacttttattctttcctttgttcacaaaaacgaggctgggattattgcaatgttctggtggagaggctgacttgaggtaggtcggtgggaatgaacagaatgaaaaagttaatactggttctattttccatgagtctttcaagttggttatttttccattccttatgccctagttcacgtcatctttttttgagacggtctccatctgtcacccaggattgagtgcagtggcatgatcttggctcactgtaatctcccatgctcaagtgatcctcccacttcagcctccagagtagccaggactacaggcgtacaccacaatgctcagttaagttttgcattttttgtagagataggattttgtcttcgtgcccaggctggtcttgaattcctgggcttgagcaatatgcccgcctcgacctcctgaagtgctgggattacaggcatgagccactgcactgggcccaaatcaccatttagctggtgtattgccactacttttaaaatcaaaaacattaaacattttgtcatttaatatgacaaaataataaacatttttgtcatattatgtgacaaaaataatttaaaaacccaccctaataatacaaaatgtaatcagcaaaaagtagcaatttttggccgggcatggtggctcactcctgtaatcccagcactttgggaggccaaggcgggcgtataatgaagtcaggagttcgagaccagcctggccatcatagtgaaaccctgtctctactaaaaatacataaaaattagccgggtgtggtggcacacacctatagtcccagctacttgggaggctgaggcaggagaatcgcttgaacctgggaggtggaggttgcagtgagccaagaccatgccgttgcactccagtctgggtgacagagtaagactctgtctaaaaaaaaaaaaaaaaaaagtagcaattttctgttccctttcccatcccacccaatcccaaggcacggtgactcaagcctgtaatcccagcactctgggatgcccagatgggtagatcatttgaggtcaggagttcaagaccagcctggccaacatggtgaaacaccgtgaaaaatacaaaaagttagctgaaaaatacaaaaaatacaaaaaattagctgggtatggtggcgtgcgcctgcaaccccagctactcaggaggctgaggtggaggttgcagtgagccgagattgcgccactacactccagcctgggagacagagactccatcttagaaaaacaaaaacaaaaaaagaaaccacaacaactactatgggaacatttttaaaaattataaaagctaaagtctttcctgaaacaattcctactttttgcttggtaaatgtaaattccacatgtagaataatgtatctgaaaaacacaaaaagtggtatgcttaaaaacttacatataatttcataataaacaagttttcactataatttaggacatattagtcctccaagagatattttctgcatacagaaactcagatgtgtttaactgggatcaatatctgtttaacattaaaagatatctccacaacccatgttggaaactttagggtgaaataaacacaagtgtaataaattaaaaaaaagttaacaccacagtaaaactaaaattggttttaataaaagttttggagtcatctaaatgagtaactatacacattcctcctctccagcaagtatacagaaatcttcccttactccaatttgacgctgcaaaatcatacatgcaccccaaactgatctgttattgaaatttctttttctggtctcacccattactttaacatatcagaggaattaacataacagcctagagaacagaaataagagataataggtgcttcagtaccacccaaattatctactaagaccacagtgtgggcaacagaatgcagattcatggtagtagttccttgaatgaaagagttcagacagaatcttccacaaacacaaatttttgcggtatccaaatcttggcagagatggaatggaatgatatgagagccatatggaatcctattggaaagaatgataaaaatattttataacatgttactagattcaggacatgaattattaggacatggaattttaacaatgaaaagtaaaattattaagcgattagtatatttaaaatatactaaaaaacaatatatgacatattgtaaacttcagataccacaccataaaatatcttccagcacaaccacttaatagcataactccctaaatggaatgaaaaagtcacctgtcctttaaataggctcttccagggatcaattgttcaaaagggaaacttaaactctctaagacaaatttaaaatacatgtcacttgggacatgagttttactttagtggctgggcaagtaaggctaaccttaccttgcttaaggcatttcactctcacacttaaaacccttcagtggtgcccaagtcaaacttttgatttttactttttgagacagagtctcgctttgacacccaggctagagtgcagtggtgcgcgctctcactgcaatctctgcctcctgggttcaagcaattcttctgcctcagcctcccaagtagctgggattacaggcgcctaccaccacgcccagataatttttttttgcattgtatttttagtagagacgaggtttcaccatgttggccaggctggtctcgaactcctgacgtcatgtgatctgcctgcctcagcctccaaaagtgctaggattaaaggtgtgagccaccgcacctggcctaaactttttttttttttttgagatggagtctcactctgttgcccagactggagtgcagtggtgcaatctcagctcattgcaacctccacctccagggttcaagctattctcctgcctcagcctcccgagtagctgggattacaggcacacgccaacattcccggctaatttttttttttttttttgagatggagtctcgctctgtctcccaggctggagcgcagtggcacaatctcggctcactgcaagctccgcctcccgggttcatgccattctcctgcctcagcctcccgagtagctgggactataggtgcccgccaccacgcctggctaattttttgtatttttagtagaggcagggtttcaccatgttagccaggatggtctcgatctcctgaccttgtgatctgtccgccttggcctcccaaagtgctgggattacaggcttgagccaccacgcctggcctggctaattttcgcatttttagtagagacgggggttaaccatgttggccaggctggtcttgaactcctgacctcaagtgatccgcccacctcggcctcccaaagtgctgagattacaggcaagagccactgcgctgggccttgaggtcaagtttttaaatcatctacaagacactaaaacacagtcttgagattgcctgcccactgcccaaacctccccgctaaacacaaccatgctccagccactttgcctcccacacggtgtcttgttctttgttgtttctctagtctctagcttaggctggcacataataggtgctcagatatttttcaacaaataaacaagcctagtcttacaacttaaaatgagagtttaaaaccctgtcagaaaagtctgaaaagatacacatttcaaataaaaaaacagcggttacctttggtacgggatctaggatggccctatttgcaatttttaaatttttcataaaaagacttattaatctgttgcttaagtaaccattttttaaaaaactctgccagggagtgtctcccacatgtttacattaatctctttcggatagatggttctagattgaggaaacagacaacagttaaaaactgtattttctatctgacataacttaaattcccacatattttcctaatagatcataactgtatgcttgtaaccagtagttagagccatttatcaacagctagataataggttttggtgtcacagctttaaatctatatactttttaaaacaagggagcttaaaacacgcaacattatacttcaacaaaggttcagtcatcttacaagaaagctatattaatagtggtaagatttaaaaagcaacataaatgctataacgcgaaatcattcagcactaataaattactattctgccaaattgtgccttgccaattatatcacattttgatcatctatttttttccttccaactttgtactttttcatgttggacttcagcatgttttcacctgatcatttagccaaacttgttataatcttttcaaatcaaaactataacatttctcatttggacataattttcaaatttgaataaatacaatgtacaatttctttcttttctttttttttttttgagacgcagtctcactctgcagcccaggctgtagtgtggtgctacaatctcagctcactacaacctcaacctcccgggttcaagcaatatatcctgcctcagcctccccagtagctgagactacaggtgcccgccacgacaccctgttaatttttgtatttttagtggagacagggtttcaccatattagccctgctggtctcaaactcctggcctcaagtgatccacccacctcgacctcccaaagtgctgggattacaggcgtgagccactgcgcccagccttacaattcttacaatttcttttatgtatgtcttagagaaacaatagcctcaggtgcacctcactgccaaaagatactgtttggagttccctcaaatcagtggatttaacctgaatcatcagtatcacctctggtgattttatttaattaactgattgactgattgagacggagtctcaatctgcactcccaagctggagtgcagtggtgccatctcggctcactgcaacctctgcctcctgggttcaagtgattctcctgcctcagcctcctgagtagctgggattacaggtgcgcaccaccatgcccggctaatttttgtatttttagtagagacgaggtttcaccatgttggtcagtgtggtctcgaactcccgaccttgtgatccgcctgcctcgatctcccaaagtgctggggttacaggcgtgagccaccgcacctggccttcagatgttttaaatgtttctcaggttattctaaatttgaagtaacgtctgagaaccattggtttagagtaagagttcttacattggggatggcaaggagagaggactggactgggtttcagtgggagccaggttccttttatgcaaaattctgtgtactcatgtgtacagttttccagttccttaactttggtcagttttaagagcccctctcccctaaaaaagttcagaatttcttatttgaaatatgatctttctaccattttataggttctcagtaatactttggtccacatcttagcttccagacatgcgttcaagaagcctgaacaggctgggtgtggtggctcatgtctgtaatctcagcactttgggaggctgaggcaggtggatcacaaggttaggagtttgagaccagcctggtcaacatagtgaaaccctgtctactaaaaatacaaaaatttagccggccatggtcatgggcacctgtaatcccagctacttgggaggctgaggcaggagaactgcttgaacctgggaggcagaggttgcagtgagctgagatcacgccattccactccagcccgggcaagagtgaaagagactgtctcaaaaaataaaaagcaacctgaacaatggctgggagtggtggctcatgcctgtaatcctagcactttgggaggccaagccaggtggattgcttgaggccaggagttcaaaaccagcctggccaacgtggtgaaaccccatctctactaaaaatacaaaaaaatagccagccgtggtggcgggagcctgtaatcccagctacttgggaggctgaggcaggagaatcacttgaacccaggaggcactccagcttgcgcactgcactccagccgcttgcgcactgcactccagcctgggcaacaagagcaaaactccatctcaaaaaaaaaaaaaaaccctcaacaaaatgaatctggtgctcagggtccatgaaaccaaatgcagttagtgttcagacaaggagaagagaaccaacagctactgaatcctactatatgccaaatgctttggcattacattagctcatttatcgtcacaactctataaggtgggtattattcttcctgtttcacagctgagaaaatgaaatcaaagaggttaaataggtcaggtgtggtggctcacgcctgtaatcccagcactttgagaggctcacacctgtaattccagcattttgagagaccaagacaggcagatcacctgaggtcaggagttgggagaccagcctggtcaacatggtgaaaccccatctctgctaaaaatacaaaaattagctgtgtgtggtggcacatgcttgtaatcccagctactcggaaggctgaggcaggagaactcctggaactcgggaggcagaggttatagttgagccgagatcatgccactgcactccaacctgggcgacagaacaagactccatctcaaaaattaaaaaaataaggccaggcgcggtggctcacacctgtaatcccggcactttgggaggccaaagtgggcagatcacaaggtcaggagttcaagaccagcctggacaacatagtaaaactccgtctctactaaaaatacaaaaaaaaattagccaggtgtggtggcgggtgcctgcagtttcagctacttaggaggctgaagcaggagaatcgctcgaactcgggaagcagaggttgcagtgagccgagatggcgccactgcactccagcctgggtgacacagtgagactctgtctcaaacaaataaataaaatgaaaatacaaaaatgagccaggcatggcggtgggcgcctgtaatcccagctactcaggaggctgaggcagaagagttgcttgattttgggaggcagaagttgcagtgggctgagattggaccactgcactcgagcctgggcaacagagtgagaccctttctcaaaaaaaaaaaaaaaaaaaaaaaaaagggccaggtgtggtggctcaagcctgtaattccagcactttgggaggccaagacgggcggatcacgaggtcaggagatcgagaccatcctggctaacacggtgaaaccccgtctctactaaaaatacaaaaaaaaaattagccaggcgtgttggcgggcgcctgtagtcccagctactcagtaggctgaggcacgagaatggcgtgaacctggaaggcggggcttgcagtgagccgagatccgttcgcaccactgcactccagcctgggcgacagagtgagactccatctcaaaaaaaaaaaaaaaaaaaaaaaaaaagaggttaaagtcatacaaagtggtgaagccaggaatcaaatccaagtctgactccaaagaccacccttcatcactatgcgaactctctaattttagagtacatcaaaatcacttggaagactcactaagacacagctggaccccactctcagtttctgattcagtaggtctggaatgttagaacctgcatctctaggaagttcctaggtaatgcagatcctgctggtcaggggagcacactttgagaaacaatgccattcattcatttaactacttattgagtgcttaatatatgctaggagcagggtatacatggtttagatcctagggaaatagtggagaataaaacaacatccatgtgctgatggatcttacattctagtggggaaaactgacagtaaacaaaaaaaaaagtttaaaaatatatataacaggcaatgagtcctatgaccaaaaaaaaaaaaaaaaaaaaaaaaaaaaaaaaaaaaaaaaatcaagcaatgtaaggagggaaggaataaaatttagatagaatggacaggtaagacctttctgggatgacacttcggcagaaaactgaatgaagtgagggagtgagcaatgagacttcctggagaaaaatcattctaagcagaggtaaggaacaagaagaccattatagcaaagggtcagactgtgcatagcactgtaagcaatgttagactttattactctgagtttgataagaatattagaatgctatcaaagacaccacattacatgactattaaaatcttacctattatgtaatatggttcgtgcagaagattccaataaagttaatggtgcttgcagctttattactggaaggacttttggttgttcaaaagtatttccaaaaagatccaagtattcaagggataaatttctaaattcactaggcaaaaatggaagcttatttcgagctgctgacaaaaagcgaaggtttattagttgtcctatcttgcaaggaaattgaatcaattcattatcgtcaagttttaaattcttaagttcctggagctggcaaaactgcacagggagtgccttgattttgttcttgctgaggtccaaactccgaagtgacttctggagtgtagaatgacacaaggctacactaaatgactccaagtgattgtcattcaggttaagttcttgaaggtgtatgaggtctccaattgtagctggaagcttttttatatggttgtgactcaagtctaatttcctaaggctttttaagcaaagcatacgcatatcaactcggacaagcccacagtaagaagtctgaagatgttccaaggaatatggaaaattcttacttagaggatagtcttttttggatgtgataaccattttagttttaaagttttcaaattctgaagtcttcactggtgtgagcgttgaaactggtgtatcaacattacagcctctatgagccagtctcatagctgaaaggaaaccttttaaactgctggaaatggcctgaataaataaaagttgtagaattataaattccactggagataatacatacatgctagttcttcccataacaaattctatggcattacttatgaatgtgatacaatgatttactgaaattgactgtaaaacttttttttagtactttattttgactaaatttcaagtttaaaagtttttgaaaaaaattacgtggagggacacattctaaataaaactgttcaaagggaagtcatgccaacactttgggaggctgaggtgggaggatcacctgagcctaggaagtagaggctgcagtaagccatgatatcactgccctccagcctgggcaacagagtgagactgtctcaaaaaaaaaaaaaaataacaaaaataaagggaaatcataagagtataaaataagataggaaatgattgactattccacttaagatttgagtttaggtggggcgcagtggctcacgcctgtaatcccagcactttgggaggccgaggcaggtggatcacttgaggtcaggagtttgagaccagcctggccaacatggtgaagccctgtttctactaaaaatacaaaaattagctgggcgtggtagtgcatgcctgtaatcccagctactttggaggctgagcaaggagaatcgcttgaacccgggaggcggaggttgcagtgagccgagattgtgccactgcactccaggctgggcaacagagcaagactctatctgaaaaattaaaaaaaaaaaaaaaaaatttgagtttaaggccaggtgtagtgactcacgcctataatcccataacattgggaggccaaggcaggcggattacttgaggtcaggagtttcagaccagcctggccaacatggtgaaaccccttctctactaataatacaaaaattagctgggcaatgtggcgcatgcctgtaatcccagctagtcaggaagctgaggcaggagaattgcttgaacctgggaggcagaggttgcagtgagccgagatcgcgccactgcactccagcctgggcgacacaagtgaaactcggtctcaaaacaaaacaaaacaaacaaacaaaaaaggctgggactggtggctcacgcctataatcctagcactttgggaggccaaggtgggtggatcacctgaggttaggagttcaaggccagcttggccaacatggtgaaaccccgtctctactaaaaatataaaaattagtggggcatggcggcaggcgcctgtaatcccagctgcttggtaggctgaggcaggagagttgcttgaaactgggaggcagaggttgcagtaagccaagatcgcaagactgcacggcagcctgggcgacagagcgactccatataaaaaaaaaaaaaagaaaaaaaaaaaagctaatttttgttggaacatggaagctatgtagagcaaaagattggaaatacagtatgaggacagattgtaaatgagctcagatgccaacgtaaagtggagggattttaagtatgaaagttacatgacaagaactaaatactattttggtagcactgtacacaatgaaccagagtagggaaaagtctggagaagacctgggtcaactaggtacaataaagcatactggttcacagacttgggattcacccatataacagctgaactatcaaatggaaggcaggtatgacagaaaacagcagaggactgaaataaagcctttattttggggatagaaaaaaatgttgctggaagcaagagacaaagaagtgactaagaaaactgaaggtaaaccatagtgccctatcatagataccaagaaaagaaagagttttattaagaaaagggtaattatcattgtcaaattctacagagtgcaaaaataatgagaaataatgatactgtgatagacaagtgaaaagatcagtgatctctgagacagtgttttcagtaaaccagtaaaggtcaaaagataaaaagtggagacaatgaattcagccttgtctttctagaaatttgttttctttttttaaaatcagtaagatctcagcttgtttttagatagaaaggaagaattagtgaaagaataagctgcaagtcaagaaaaaaaatgaaaaatcacaaggaggagatgggacaaaattattccattcaatccaaactccttagttatcgaacttttaatgttgcagagcactttgcttggagttaaaaataatgcacagttgggccagatgtggtggaccatgcctgtaatttcaccactttgggaggccaacgtggacagattgcttgagcccaggagtttgagaccagcctgtgcaacaaggtgaaaccctgtctctaccagtacaaaaaaattagcctggtatggtgttgtgcccctatagtcccagttacttgggaggctgagaaggaaggatcacctgagcctggaaggtcgagggtgcagtgagctgtgatggtgccactgcactccagcctaggtgagagtgagaccttgtctcatcaaaaagaaaaaaaaagcaaggttgaacaacgagacattgtttccacccatcaggaagggaaagaggaatagggcagagggcagaaggcagaaaaaaaccaccagttttaaaattctaatggtttataaattttttttgtttgagaaagggtcttgctctgtcacccatgctggagtacagtggcacaatcatagttcaccgaagccctgaacttttttttgagacagggtcttgctctatcaaccaggatggagtgcagtggctgcaatcacagttcactgcagccttgaccttccaggctcaggtgaccctccacctcagcctcccaagtagctgagattacaggtgcacaccactatgcctggctaatttttttgtagagatggggtttcaccatgtcacccaggctgatcttgaacacctggattcaagcaatccgcccaactagggctcccaaagtgctgggatcataggcgtgagccaccgtgtctggcctccaggttctaacttgtgggattaagtgatcctcctgcctcggcctcccaggtgtgagccactgcacccagccagtttatggtatttttgttttgttttgttttgttttgtttgagacagggtctggctctgtcgcccaggttggagtgcagtggtgcaatcttggctcattgtaacctgcacctcccaggctcaagtgatcctcccacctcaggctcccaagtagctggcaccacaggtgtgaaaaccacgcctggctaatttttttttttttttttgtggagacagggtttcaccatgttgcccaggctggtcttgaactcctgagatcaagtgatccaccagtcttggccttccaaagtgctgggattacaggtgtgagctatggcacccagcctcagtttatatttttataagaatgattacagtccgggcacggtggctcatgcctataatcccagcactttgggcggccaaggtgggcggatcacgaggtcaggagtttgagaccagccgggccaacatggtgaaacccgtctctactaaagatacaaaaaattagctgggcatggcggcacgtgcctgtaatcccagctactgggaggctggggcaggagaatcgcttgaacccgggaggtggaggttgcagtgagctgagatcacgccactgtaatccagcctgggtgacagggagagactctgtctcattaaaaaaaaaaaaaaaaaaaaaaaaaaaggaatgattacagtaagggccaggcacagtagacaaaaattcgccaggagtggtggcacccacctgtgggttgcagtgaaccaagctcttcccactgcactccaacctgggtgacagaatgagactccatctcaaaaaaaaaaaaaaaaaaaaaaaaagaagaagaagaaagaatgattacagtaaataaaatacaagatggttctaattgaattttttcctcttttattacaacaaacttagatttgtaacctgtggtttagctggcaaaatgtagacctgtgcagttgccttatagagttccagtcaaagaacaccctagggctccatcttgagcacagaagcaaacccagttttcttcccatcctgggaatcttactgaggcagactttgcccttttagaaggcacacaagcatatttgggaagctgcctcttgtgccattgcctcttcaaaaaacctgcaagagtctgtccctattcggctatatgggatagcagaatgtgcaaacagccttctttaaagaaaatacaggccaggctgagcacagtggctcacgcctgtaatcccagcattttggaaggctgaggtgggtggatcgcctgagttcaggagttcaagaccagcctggtcaacatggtgaaaccctgtctctactaaagataaaaaaaaaaaaaaaatcagccacgcatggtggtgggtgtctgtaatcccagctactcgggaggctgaggcaggagaattgtttgaacccgggagatggaggttgcagtgagctgagatcgtgccactacactccagcctgggcagcaagagcaaaactccgtctcaaaacaaacaaacaaacaaacaaaaaaagcaagcaagcaagcaaatacacgccaggccaagtatggtggctcatgcttataatcccaacactttgggaggctgaggcaagaggatcgcttgaggccaggagttcaaggccagtctgggcaacatcatatcaagactccgtctctacaaaaagttattttaaaaatttatccgggagtggtgaggtacacctttagtcccagatattcaggaggctcgcttgagcctaggtgtttgatgcagtgagctatgactatgcctctgtacttcagcttgggtgacagaacaagactctgtttctaaaaaataaagaaaatacagccaaatattaatcattaatgtttttaataccataccttacttagacagatatccacaggaggctcctttaaccgaacagtggctttcccctcatctacaaatttggtgaagaattgctcaatgttctcccttagctgcataaaaccaatagaaaaaaaagaagaaaactaattattgttactcagtaacatttattacaactagaatgtgccagttactttgccaggctttggtttggcttttagtccttgagtctgagtgttttcattttaagttttaaagctttttatcacgccactgcactccaggctgggcaacagaaagagactccttctcaaaaaaaaaaaaaaaaaaaaaaaaaaagttgtttttttttgagacagagtctcactcactctcacccaggatggagtgaagtggtgccatcactgcaacctccacttcccaggttcaagcaattcccatgactcagcctcctgagtagctcggattacaggtgcgtgccaccatgcccggctaatttttgtatttttagtagaaacacggtttcatcatgttggccaagctggtctagaactcctggcctcaagtgatctgcctgcctgggcctaccaaagtgctgggattacaggcatgagccacggcgcgtggccaagttttaaagtttttttttttttttttttttttagcagttgggaagttatactcctcatctagctggtggtggatgttactgctctgtctgtccagtaactctcctttgagaacaggatcaccatgttttgagagaatgctccttttctcccattccaactatgtaactgtaggaagagttgccaatagcagttacttgccttcataacttcagtccattagcctggggtgggcacacctcccagtaggttatatacaaactccatgagagcaggaatcttgtctcctttgctattctatcctgagtgctagaacgatgactgacacataatgagtgctcaaaaaaaatttaatgattatcatctatataaatggcatatttaaaatttaaaaaaaattaatgattgctgttgcatctgctttagatttcaacaactattgattcagaacccactatgtaccaggtactctaataggggcttgggacatagcaatgaataagactgacagggtaactacacttaaagagttgacaatctgatgagagatagttattaaacaagtacttataagcataacaaatatcaagacaaggcaagtgcaggatgctgtgacctgattttttttaagaaagcacattaagctttaatatagaaatatttaggttacacttgtgctcaagtaataaaacatttgttcttttttgatctcatacattctctcctcaggtatggcccatctcctgtacgcttggagcgacctttggctacgtggctggccttgttatttcaccactctgggtatgctggaatagaaagcaacttacatacaagaacaattaactggagaaaagggagatatttctttgtgcagattctgtaagggctgtgcagaaatgtgtatggtcaaagccaagcagttccatctacagctctgttttttatgtagttacaacatgatgtgattgtagctttttaaactatgaaacccctgagagattgtaccttctagttgaaataaagtatttataatagattgtggcttcagatgctgcttactgcttcttaaatctttaaggaacattcttaataaactttacagaattctgaggacaggttttgttttctttcaagttttgaactgcttcattacctataaaaggtctgggtatagctgcagcatttcatttgctttctgagagaaatggacagtttccttggccactgaagatgtttctcacgtaattaaacaacagtttatacatcttgatcctattctttttttttttacagtgtgtttctttggagttaaaatggctatgatagcctcatcaaaaacagtcttcaatcccttctgggttaaagctgaacattccacatagcagcatgctcctatctcttttgctagtttctgtccttgttccacacatataggtttttctttcatatcattcagtcttgctaaagttttggggtcatctcggagatcaatctgagttcttattaataaaaagggtacatttggtgcgtattccttaagttccggtacccactcctctttcacattttgaaatgaggctggatttaccaccgagaagcatataaggaagacgtcggtcactgggtaagataaaggcctcagacagtcatagtcttcctgtccggccgtgtcatagagtcctaggaggtactacttgccccccacggtgacgctgactgcttagtggtcgaagacggtgggcacgtactcctccgggaaggcttcgttggcacagctcatgagtgggcacgtcttgcccaccgccccgtcgccgaccaccacgcacttgagcatcagcgcgccgggcccgtgagccatgctgctgctgccggccggcctccgggcatggtccccccggagcccccgccccggccccgggctcagcctcagcccgcctggagggtccgccgccgtcgccgccgctccacgccgcggggccgcccccccggccccaagcagcaactcccctcgccggaggggagagggccgcagaggccccggcgctgccgccgccgcggtcgccgcccggatccccgccccggccccggtcgccgcgcccgcccgctgcccccgccactcggcgcccgcgccctctccccgtcccggcctccccaggaggatccgccggatcataagaccggccggccccgggggagacggcaactgtggggagggcggccgacctgcttttttaagctagggagaatattgtgggagaaagaattcactgaacagaactgcagttattttactgttccccaactggacagctgcttcatttgcgcttgtttcacgcaaaatttcagaaacttgaaacaggcgggattgccatccactactaaatagcaacactgtaaattcaaagtcgtaaaagtggggaggaaaaatagcgaaaaggtacactctcaaagctttcttctttcgggtccgtaggaagacgcacaggaccctggggtcgggctgatggtaggtctcaaggctgggagttcaggaacccccaaggcgggctttcgcctagggagcagccgggagcatgaggaccgagggtggcccgcgtctcggcttccaagaagaacgcgagactgacagggcctgcccacttcacgcacctcatagcgggtcccgcgcttgtccttcagggtggagatgagcaggaaggctcggaccggcggctgactcctggaagtctgctgacagaggctcaacacggctcggacgcccttgccccggttcctaagccccaaggcgggcaagtgccggctgatcacctccacctcacagtgtagcttcatctcgcccaacggccacaaccacgtcaagctggctttgaaacttcctccttcccgccacccggcgccgccatcggggtcctcgcgcacgcgggctgcccactgatctgcctgcctgttggactggtccgcgactcgggctgtcttagcaccgtgtctgtatgaagcccgcgggaaacggcttcccttctcccttagcagggccgggttctcgccgtggttgcgtaccgggactgaccacctggatccgggctcgcgcccgggaaaccggcagtcggcgggggcgcaacgtcttttcccccgagcgcgcagctggcagcggtggttgtttctgttcggggaggattccgagggtttcagctgttgacgctttacgcgttgccggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcgggtaggtggatggagtgtgactggcttaactgcacctgagacgtggaaagaccgtccagaccgcacaaggccttcgtactcttgattttcttgattgattgaactaggacggggcccggctggggagtgggaagcgcctggggagcaaatgttaagcaggcgctcacggtcggggtcgtggtcttgcctccttaaaatttgtgctctaggcgcctctctcaccttaacctaatcctagccgtatattaaacattttattgtgtctgagttatacttccgtaatggtaaaatgacgttcagaaataccgatttttcaatacaactgtgacaaaatgtgatttattctcaaatgagcgtccctatttacatgttgaacctgaagtgttgtcagttaattcctcattctttgaaacgtaatagttcctggaaaaaagtgattaagataaaattatggccgggcgcggtggctcacgcctgtaatcccagcactttgcggggctgaggcaggcaggtcgcttgagcccaggagttcaagaccagtttgggcaacatggcaaaacccagtctctaagaaaaatacaaaaaaattagccgggcgtggtggcgcgtgtctgtagtcccagctattggggaggctgaggtggcaggatcacttgagcctggggaggtcgagaggctccggtgagctgtaatcgcgcactggcactccagcctgagtgaccccgtctcaaaaaaaaaaaagaaattactttccctccatttagtattcttatatgtacatctagtagagcattaaaacgcgactcagcatttaagcaaaactttatggctaaagagaaaacggacactacaattttcagactattagactttataggagttacctgcttttgttctttgagagggtaataatgtagaaaagataataaaacaccagcctgaattattacaagtacattaaatggactctgaacttataggtacagttgggagctaggaaaactgtaaaaactgttataattttcattagagtagaaatgttccgccaggtgcggtggctcacgcctgtaagcccaacaatttgggaggctcgaggcaggaggatcgcttagcccagaagttcgagattagcctgggcaatagtgagacctcgtctccacaaaaaaattaaattaaaaaattaactaggccgggcgcggtggctcacgactgtaatcccagcactttgggaggccgaggcgggagaatcgcctgaggtcgggagttggagaccagcctggccagcatggtgaaaccccgtctctactaaaaatacaaaaattagacagagtgttggcgcgcacctgtagtcccagctacccgggaagctgaggcaggagaatcgcttgaacctgggagacggaggttgcagtgagccgagatagtgccactgcactccagcctgggcgacagagcgagactctcaaaaaaaaaaaaaaaaaagaagaagaaaaaattagttgggcggggcggcgcgcgtctgtagtcccagcttgagcctaggaggcagaggtagtgagcgaagaactgccctccagcctgggcgacagagcgagaccttgtctcaaaaaaaaaaaaaaaaagcctcaatctcagtcctttatttggtgttacttaggcttgggttgttgaagcatggattcagtaattaaataaatagatgaaagttacataacagttcaacggtgattttagagtgaaacagtggtatatactgccaaaaatgtatcttcctaattgtcagtcttaaaaaaggtagtttccaaactacctcttttttaaacatctatcagtttttggtatctcatttccctttccacatcctcccctttgtccacccaaatttaatggtttaaatacttggatgtgacactctagagtacacctaaagtttttggtcttagtggatcgattgtggagcaaagagccctttgaactttaccaccatacaaataaaatctgccccttgatctctatccttaattacctcgagtcagttttccttgtagacagactgaaaatggaaatacataaggagttaaaaataattggactacaagtttttgacaagagaaataaaagatataacatttagatttgtttttcttctataaaattagttcttcttctacctggcctacaaactacattcttttctctctttttgttcatattaattaatatgatcaaatcccagttcagtttccgctaaaccttctttagcatcttgaccttcctttttgcaagctccaattgcacttttcatttatttccctggctttctggcacatactaggcattcaacagataatggttccctccctccctccctccctccctccttcatttcttccttccttccgctctgttgcccaggctggagtgcagtggcacgatctcgcctcactgcaacctcagcctccccggctcaagcgattctcctgcctcagcctcctgagtagctgggattacaggtgcctgtcaccatgcccaggtaatttttgtatttttagtacagacggggtttcaccatattggtcaggctggtctcgaactcctgacctctggtgatccacccgccccagcctcccaaagtgctgggattacaggcgtgagccaccgcgccctgccgacaatggatttctttcaacttttcatttgtagtcatagtgaactttgctcactttgtagctcattatgtttgagctagtaaaatcacagtcacatcagaatttttttttttttagtttagcttagttttggagacagggtttcacccaggctggagtgcagtggcaacattcatagctcactgcaacctcaaactcctgggctcaagccatcctcctaccccagcctcccgagtagctgagactacaggtgcgtgccaccatggccagatgtgtgtggtttttttgtttgtttttttactttttgctagagatgggggttcttgctatgttgcctagtctggtcttgaactcctgacctcaagctgtcctcctgcctcagcctcccaaagtgctcggattacaggtatgagccaccatgccccacccacatcagattcttaaagaacgaggtcacaatctatggacagtgtagacttgcttgccctagcacatttgatccagatgttggagttagttttttttttagtggtaaacatcatctaagactcaatacagctaaatagttaaaaaatatgcacctaagcatcagacctctttcagtctcaaaaaagggaaaaaaaagactggagaaaaatatctccaaatatgttgaatttattcagaaatgggaagagaatattagaattcaggatgcacgaaatggcaagccaaaagtacgtccagtgagggaagggtaaaaggaagcttttattggcaaaaagggcaagttcaaataaagctgcttggaaacagaagcaagagttctgttcaatgaacagagttcattggttccagaggctcagagccagagctgtcatcagttcattggtggagatgctgttactgggcaagtgttcttttgagagcttcttatctaaattactgcagtcctaaagaatgataagccttgtcatagaaatatatgtatatgtctgaaacctgccaactgtgcaaaggaggacatgtgtgaaggatgtgaagtgatctcttgtggagtttttagaaagtcttcagaaacagttcttatctcagacatacaaacatgagccctttcctttttgcctttctggccctattttgtttggttctgacaaaagtgatttcatcctggtatctgcaactttcactcctctaagttctgcctttcatcagtgacactctttgaatgtcttatagattgtgtttccacgattatttactaatgaatgaccacctttccattcttagcactgccgtatcaattcagagctgcattactttgctacagagctgttgctaaatttaccaggtcttcttgcttcaatacatttattcattcatttaacacttaggattttttttttttttgagacaggttcacaccctgtcccccaggctctgaaagttctggaaaacctttgaaaaattttaagcgggataaaattcagacctgatcaggaaaggttcttgtggtcagtaaaaagatgattttggaggtagagcaagcctgaaagcagatgtatcagttaggaggctgttgtaataatccaccatccatactgcagccaaattaaatttgtagagggatatcctatcatagaatcctcaagttttagagctgaaatgtcgtttatagatattttacttcaattctctcattttgcacaagagggaatggaattaagagtaaaggtacactatttgaccatgacctcatagacagtcaatgttagaataaacaggactagaactcaagtctcagatgctgtatttaatttctcccaaaaaccttcatggatttctactcatcacaatttgattaaatacagttgcccaaaggcttgtctcttgctccctttggaatccaggttatatgtaatattacttaggaggacagattgccccaggacagcctctgttttttcagttcccacttagcacctgcccccagtatacccctttcttgtgagctcacctctgcattttaaaacgtcttttttttttttttttttttttttgagacagagtcttgctctgtcgcccaggctggagtgcgatgccgtgatctcggctcattgcaacttccacttcccaggttcaagcgattctcctgcctcagcctcctgagtagctgggattacactacacctggctaacttttgca

SEQ ID NO: 12135 - DNA, 87594 bp, Human
cttagttaacaattcaaaaaaaggaaagaaaaatacctttttggaatatttttaacacatcattttagaagtagaaattacatctcttactttcagttaatagtaagtattatttaaacagtcttcccattgtgcaattttatttttgtgtgtatgtgaagtaatgttttatttttgtgtgtatgtgagataattttgttaaatgcttttgaagctcttgacagttcagtagaagaatctgagatgattcacttaaaatacctgtgacatagtctttatagatgggaaaattagaatatgaattgtacaaagtcaggctcatgacttgttaagaattatgcttatttctgcggtgcccacatatgtgagaaaactgttactctttttatgaatgttaactgattgatcattttttccactttcctttaaaattcatttaaaggaagcatggagcagtatgtatgctaatggtatattctattacatttgttgtgatctctgttgactttcatgagattttggttgtcattcagaaagctgatttttcactaagttgtacacctgttcctttcaaaccttagtatgctttcagatgatatttaaatttctctggacagtgagaagaaggaagttgtagaactgccctcatttatgaccacaaacatatgaattttaaccctttgaacattagaagaccaaaccaaagttatgacagaactgcctaagcccataagacaagcatcagttacagaaacttttactgtattggaaaagctattacacatcttcttgttggaaatgaaacttataaaagaaagactcctgattttttttctcatctgttatgcatggggataattcgactgtaaagaacatggttgagaattctgtctagtgattgttttgattttctagttagatgtttaagcagatgaaaaaatgtgctctttggtcaaaaacagtatagtttaaatatttgttctctgttaataactaaagttaaatggttcttaacttatttaaccactaaataagttaatgtgggtaaaggcagaacttatttgacagtaaacttgtttgatcataaatattctaagtttgagtttacagtagtagaataagagatatatttatgtatattccgtttcttaccctttcaaagacttagaagaaaagcagagttcttgtctcttctcttaatgtattttctgggatacctaatattgcttgatgaaaacattttactgtggaaataaaccttcattaagtagataacccagaaatgataaactcaaattagcagtttcatttaggatattgaggtagtattactttaagtgggtgtggttgtaatgcagttttgaaattattagctatatctgttatgccttacggtacaacttcttgtgctggtttatagttgaggtatgaatttaatatgttctcactttgacttgtttagtttggttggggaggggagtaaatttagagataatttaccttagacgtgttttcttttagttcataggttgagttactgtcccatcttttatcaagattaccagtgggttgttttggttataatgaatgaatatcattgcatatagaaaaagatactttatttgggaataacattttattatgtgaggtgcttcccccctttccagttttacttcatgttaaaagcatttattccttttacatatcaggctttctaattttcttcaggttacagttctgctgtctttctttaaagaatcttaaaattatttaaaaagacagtttatttgtgaatcccttcagggtctggggaattttgaatttcttccagataaccttttattataatttctagtattttagccagacatgtatacactgggtcttcttaaactatatgactataacattagttaacccttttctctgccacagttttgcctcctcaatcccatctccatccccagttttttaaaaaccttattctcctctgatttattgcagactcaagaatgaacaatccgtcagaaaccagtaaaccatctatggagagtggagatggcaacacaggtaagagttttctgatctagctttttaattaactctagtagagcacaaagaagaaagtttccatgtaactaggacttgtatttggcaaatacagaccaatttgagtattgagttgtcaaatatgattcagtcctttaggaactgggagggattatgtttgtttaagattacttaactttcttctgcaggcagcttcgttgttttgcttctgtctatcagacaaactatgcagaagttaggaaaactgtcctttgggtcagatagttttggatatgaaatatgggtttaccacttactagcttgtgactttaggcaatttccccaatctttttgagacttaatttattcaattacaaaatgaggataatatatttcaggttattgtgagtattaaaggagatgatatatgtggcatgttaagcaaaatgccagctacacagtaactattcagtaaaatgttttttcttacagatgttaatcaaaatagtaaattttatctgccctacctttgctataaattatattaaaagttatgatagtaagtagttatagacacatacccatttctaatacattcttttatttggtaatttaaaaaaattatacttcattaaaccttttatcaagagaaaattatcatataaatgagaatactgaggccccatgagagaaaggtaaatctgtaaaggatggtttgtctccacggctcatactcttgagtcagtatattgcttagaggatgtaagactatgtatctttatcatctgccagagaggatacagggacttccctggtttctggtaaaggtataaatcaaaatatgaaaccaaataagaagacagttatgggcaaggatgaacagaaagtacttgcttctaaaaactaggtttttcgcttgcagagagggatcccttttgacttatcattttaaaaatgcttaaccatgggcaatggtaagagtgagaggcactcttaatttgtggtaaatggctgagttggactaatgtagcagttttcctgcctgtatgtcttttgctgtaaactctcctatacctggagatgcttatgttaatctctaaactgtacatacctctttatgtgaaactgagctgtggggcttccatgttcacccctgttgtatttaacacacttcatagtactcttactgaggctagccaagtagacttctgtagtatctcttaagaagggaaagggcagcattgtattctgtctgaattgtcagccagtctcctttttgttacttctctgtcccctgtttggactccatctttctttcttgttcagcactggttcctatgccagtgccggtgcttcagccacctagcttaggtgtgggaaatgtttgcagagagaaatagggcagctgatccccttaagagactagagggtggggcagtgggcaggacacctgtgcctaaagaacagcttcaaagaagaaacatactttttttttccctaagggaagataagcaaatgattggaaaacactgaaaatagccattacatcagactacatggaaatccctgtatctactttaatgctactactgtaatagcagtttcagcagttaccatttattgagcaactacaacacttttttttttttttttttttttgagatggaattttgctcttgtttcccaggcgggagtgcaatggtgcgacctcggctcactgcaacctctgcctcctgggttcaagcgattctcctgcctcagcctccggaatagctgggattgcaggtgccagccaccatgcccagctaattttttgtatttttagtagagacggggtttcaccatgttggccggctggtcttgaactctgtgggcattacctgatttcgagttaagttattttgacaagttagataccattatttcaaattataggaaattgaggcacaaaaccagccaggaaataaagtcaggtttaggattcgcagcccacatgtaagtttccccatgaagtgcaataaaataaaactgaaaatttaagcaacacattgtgtatgtccagacctgtataaggtaagttctgactggagcacttgttgtaaccgtcttgtgaatttcttgcctcgttttaatatagaatgtgtggcagactggttcctatcagacttgcatatttacttaccatgtttgatatattagatataaaattacagtttatttagataattgtatgcttacaaattgatttttatttaagcatataacaaatgagccttcagactcttgagttgttagttaactattctttttttggtagtttatgaaagcaagtaaaatgtttaaggggaagaacgcttaacattatagtaaaactgaagcctcacaatttctggattcagaatatgtttgtgtagatcattttttcctgaaatgtttacaattgtaataattttgatttgtgacactttaaggagaatgatattgtaaaattattttaagattgtgttgatacgttaattctataccttctgtcattgattcgagaggcaaaatcaaatgatgcactttttgtcaaatagtccttttatgtttgcagaaaatttatagtttaggtttttaaaaaatgtattcagtaagtgcccgttctatgtgtaaagtactataatcagtgttattaggatgtacaatgcaaatagatgaaataaccctcagtctttaaggagttaacaattcattaagagataagacagataaataactgattctggatagattatggtaaataattcaagaggaggtacagaaaagtgccatagtggtgttaattaggtgtttctttgaagaaatttgtgtatgtttataggtcaggtggaaggacccatcagggagcaagagagtggagaaagaaatacaattaattgaaccaaggtaggggtgaaggtctaggatcagaagtgcagaatgaagggttgactctgaacatgaaaaagactaccccatgtctctaaaactggggagaagaagcaaatattatacagtaacagagaattgaaatggaagggagaagcaaaactgagcaatcattcacatcagattgcttcatttttctcattaaagtagttgaggtggtcatctgagaggaaggcagggataatagtaataataatggcagcagctactgttctttgaattcttactgtaggtgtctggctagccactttattatatatactttatgtcgtaatttttaaaatactcttacaaggttaagtagatttataaaaaggattgatgagccttttgagggtcagtctcaaagaaaataaatgtgttagcttatccagccaacctagttatacagctgatcattgaataacatggatttgagctgcatggctccacttatatgcaaatatttttcattaaatatgttggaatttttttgagatttgcaacaatttggaaaaactcacaaatgaactgtgaaatattgagaaatattgaaaaaaattaaaagatatgtaatgaatgcataaactatatgtagatactattttatcatctattaccatgaaatatcacaaatgtattaaaattataaaaccttaaaatgtatcagaacttacgcacacactcgatcacatacatggcaccattcacagtctagataaatagaaacaaatgtaaacaatacagtataaatcgtaattggataaaattaactgcattacctactatactactgtaataattttgtaaccacctcttgttgctattgcaatgatctcaagtattgtgagtatccatttaaaatgccatgtgaccctaatcatgtcacagtgaacagttcatccagtaaattgtgtattgcagtaaaaagtgatctctctatgtccttgagtattttgcatcctgtttagtgcaataacctaaaccttaaataatgccataagacctatacgaagtaccactggtggtgccagaagtgttccccaaagcagaggcaagtcataatgttataggaaaaatttgaattgcttgatgtatactatagattgaggtctgcagttatagttgccatccatttcaagataaataaattaagtgtaaggacgattatttaaaaaaaaagaaaaggaaattcatgaagccttcactgcagctacaccagcagacatgaaaaacttgaactttttgctaaatacctttttatttcattgaaaataccggcctggtgcagtggctcatgcctgtaatcccagcactttgggaggttgaggtgggcagattgcttaagcccaggagttcgagaccagcatgggcaacatggtgaaaccctgcctctactaaaaatataaaaaactaagccaggcgccatggctcatgcttgtaatcccagcactttgggaggccaaggtgggcggatcacctgaggtcaggagtttgagaccagcctgaccaacatggtgaaaccccatctctactaaaaatacaaaaaaattagccgggcatggtatagctgtaatcccagctactctggaagctgaggtaggagaattgcttgacctcaggaggtggaggttgcagtgagccgagattgggccattgcactccagcctgggcaacaagagcgaaactccatctcaaaaaaaaaaaaaaaaagctaggtgtagtggtgcacacctgtagtcccagctgcttgggggaagaggtggaagaatcacctgagcttgggcagtcgaggctacagtgagctgagatcacgccactgcactccagcctgggtgacagtgagaccttgtctcaaaaaaaaaagaaagaaaaaagagaatgcagcttttatgtgggtgcaggattgctataagaaagacatacctttggactctaatgtgatttgagaggaagcacagttgttatacgacagcttaaaaggcaggtgaaggatctaaagctggagaatttaatgccagcaaaggatggtttgataattttagaaagatgtttggctttaaaaatgtcaggataacggaagaagcagcttctgccaacgaagaggcagcagacctcaagttctcagatgccatggagaaaatcagtgaaggccgtctgtggtggctcacacctgtaaccgcaccatagctggaccccatctctaccctcaccccaccccctgcaaaaaaaaaaaaaagataagacaaaagaaggaaaatcattgaagagaaaggatatctgcctgaacaggtttttaatgcagacaaaagcgccctattctgagagggaaaaaatgccacaaaggacattgattagtaaggaaagacatgaaagcacaccaagatttaaggcaggaaggaataggctaacagtactgttttgtgcagatgcaatcgggtttatgatcaggacagccctatctatatcctattaaagactgctttttgccttcttttacagcatggacccttttatgatatgggcactgaaactaaagcacatggtggaagaaggattggtagcatatagaaacatttttagacaaatgaaaaagcaaaaaagtcagaaattacagtgtatttccataaagttacaccaagtgtgcctgcctctcctgcctccccttccagctttttgtcttctgccatttctgagtcagcaagacccctcctgttcctccttctcagcctactcagcatgaagacaaggatgaagatctttgtgatgatccacttccacttaatgaatagtaaatatattttctctcacttaggattttctttagcttactttactgtaagaatacagtatataatacatatacaaatatgttttagtcaactgtttatgttatcagcaatgcttctggtcaacagtaggctattagtatttgagttttgtgggagtcagatgttacatgcagattttcaactgtttgtggggtcgacacccttgactccgttgttcagggttcgactgtatgacctttctgtagcctagatcagcagtccaaactcaggaatgaagaaaatggaacattggattattgtgccaaaatagtatactatcaccaaaaaagaaagagatagaagggagtggtaatattttttataacatagttgtttgcacaaggatgcttccctttggaaagatggtatttccccattcttccctctcctccacctttggtaaagtctattctatgttctcaagattattccgtattgtagcatgtatcagaactttattttttataagatattccattgtatgtatatactacattttgtttatgcattcatttgttaatgggcagctggattgtttttactgtttggctattatgagtaatgttgcagtgaactttggtgtacaagtatctgtttgagttccgtttttcaattctttggtttatatacctaggagtagaattgctgggtaaaacagaatacaaacttattatcttacagtttgggaggtcagagtcctaaaatgagagtgttgtaagtgctttatttcttctggaggtactatggaaagtccatttccttctcttttccagcttctagagaccacctgcactccttggcttatggccccttcctccatcttcaaagccagatgtatagcattgtcaaatctgtttccttccctccctttcctgtccccctcctcccctcaaccctgcttccatcatcatatttccttctctaactctcctgtccccatcttttctttaaacacttactatcctgaacttcattggatttgcaaaataccttttgccgtgtcaggtaacaaattcacagcttccaggaattaggatgattattaggcccatctttgatgggctgttgttctgctttcccacaagattttctcctaaattaaagctgatcatctctattttagatgatagttggaaaagtaaagaagttgtttgaagttttacaaggtttggtaggaaaaaactaaatcaactattttgatgtaaagaaatattgagggaaaaaggaatattggacaaacattaaagttttgctcacttttaactcaaagggcagacctctttcatcagtactcctgacagatggttatctgccctgtgcctgggttcatgcactgacacagaacacagtactttctagtgttatctgttctctggtattacaactctgttttctacattcttttgaattttgtccttaggagtttgtcatcttttaagaaattaaagctcttctgaaagtcattgtcacattttaactcttttccattcatttgacaatttattacaaattaatttactataaagtagtaatttattataaaacaatttgttataatcatttgtactagaatatgatgatagtggctagcattgattaagtatttactgggtgatttaaacattttacatagattatctcatttaatccttataaaaacctcatgaaacattatttttctctttttataaataagggtctctttttataaataaggaagttgaggctcagagaggttcagtcacttgatgaaggtcacacagatagctataaaggggagcagaaccattctttttttaagatggaatttcactgtcgttgcccaggctggagtgcaatggcacgatcctggctcactgcaacctccacctcccgaggtcaagcaattctcctgcctcagcctcccaagtagctgggattacaggcatgcaaccaccatgcctgactaattttgtattttcagtagagatggggtttcttcatgttggtcaggctggtctcgaactcctgacctcaggtgatccgcccaccttggcttcccaaagtgctgggattagaggtgtgagcaactgcacccagcccagaaccattcttttaccctttgagctatgttgtttcttttttctttttttctttttttttttttttttggagacagagtctcactctgttgcccaggctggagtgtagtggcacgatctcggctcactgcaacctccacctcctgcattcatgaagttctcccgcctcagcctctcaagtagccgggattacaggtgtgcgcccccacgcccagctaatttttgtgtttttaatagaaactgggtttcaccatgttgcccatgctgatcttgaactcctggcatcaagcgatccacctgcctcagcctcctgctgggattataggcatgagccaccatgcctgccctgttgtttctttttgtctccgatgcgcaagataacagtactaagtaacatcagtgaagttgaataaaagactgattttgttctcaataaatttatcttatagagaaaacatatatgaaaatgtaatataacagaaattgagacgattcatgagaagtatatgtgaacccatgagaattcagtgtaggggaaaagtgtttctagctgggaggatcagagaaggctttggagaaggtggaattgaaactgtatcttacaggctgggtagggtttaaatcatgatgatgctaggcaatatatgttcagcatgaagaaacagtcaaagctgagatgggggaagaaatctgtcctaaatgtctctaattccttcaaaagatttccattatgtcatctgatttctagatcttttatcttttagtcattcacagaattagacagtattccaattcttcagacttcattgcagccattaccattaccttttgcttattattatctttgaaaacttaccattggcttattataattatttttataatgcaggtaaaaaggatatttaaatatattttaatataaatgttaatatatttaatcagattttctgatacttgttttgtaatgtgaaaagttgttttaaagcagctgactcatctgttgtaatgaatttacagtcaattaactgtctttttttcatctgaattatgatagatagatccaaggcttccctatcctgtcctttttcacttgcttttttcatttgaattgaaaggggagagttccctgaccccccttgcaggacatgcgacagggagtggctcatatgtttggctgcccacactcaaacctcttagaggaagggaagcacacagactggcaggtgcaggagttatggtaagcactttctgggctctggccacatgatagtgtctaggggtgggtgtctgcaactcccaaagcccaagtgggcacatgtttcagtgcactcttttagccttgccatctacagacagcttaagtgttagctcagtgatcctcttggtacccaagtccttgtgcggcgtccaggaagaatcaggtcacacatggacttgaaggatgaattcaggggttttgttgagcggtggaggtggctcttagcgggatggatggggagctggaaagggaatggaatgggaagatgatcttcccctagagtttggccatccagcagctgatttcctctttgaccacccccagtcgaattcctctcaacattcagacattccttctcttctctctgccacaccattctgctgttcttctgctctactgttcatgtcttctggagcctggggtctgggggttatatggagccacgatagtggggtatggcaggccaaaaggcaacttttgggcgcaaaaacagaaatacctgttcccatttaggaccatgggtttccaggcttgagggtggggcctttgctggggaaccaccctcttctacccagtatttccctgtctcctgttcatatcaaaatgatttttccccaggatagtatcactatatttcaggcaaatgaaaagtcaaaagaaatttgttaatgtaacctaatatacataaatacaatagtatttttggaataatatttatgggcttgtattccaaaaatactgtcatccaaagttcctagtaaccagtgatgttattaattctttgggatttactagtgctatggctggtattaggacattatatgctcatttatattcataaaagagcatgatcagatatcattttctccaagatgaagagaaagaatcctgaaagaccagggtaccagtgaatagacttgctattcttcatagtaatttaacaacttgatgccttgaaccagcactagttttggaaataatttccagataaaataccagtgttttccagaaaagcctcaaaatagacctcaatatagttcttgttaaaccagaatggagcatttgcaaatttcagacacttaaggattattttccttttgaacttacgtttatccagaggccatttttaatattcttactgcttttattattattttaaaatttattacatattttattgtgtagactacattctgccctggccaagctgctcttataagcctgagagtagaaatactaattttgtttggagtacctttatagctaatttttaattagtgggtcattgaaagtggctgaagcatttccagagagcctcaggagctcagtgaaggatcttggtggtttagaagcaaataccaaacacctgtaggaaagatagacctccctctagtgtttgatttaatagatgtcagttacaggatatggcttctacaagattctgatcagtacgtattgagaaacttgccctggctctgcccactggtgcacatggggattttaaaactttaggtcaggggtgggggtcaagggggagaagggcgctataattactgaagctgtgcgaataggaagtgacatctgaattaagattatacttttgttaaatgactgaataagcaattgatctttttgccatgaggtaacccagtaacaaatttagaattttaaaggtagtatccatttttgttcattactaatagaaattgagaacattaaagagagggtttgtttctaaaatgctgttttcagtacagattattagagattgtctataattttctcccttagagagcagcttagttttatttcatgttacttttttcattttttttcctaacagatattaaagaatttttggtataaaagaattttccagccatgttatactttacatcttgcttgaagccaaaaactagactacattattctttcaattagatccattatataacatcctggcatagagcaatggcaatagaagccaggggtcaatttttttttttttttttttttttttttttgaagaaggaaggaaagggagtaatttaaaatgaatacttgtatttgcctcggggctgggagagatgtggtagcattctctgagtaggaactgtactgttggggagtagacttgacaatgagatgatgaaacatttcagcactgaaaatgttgtacttggggtgccttgtggtgcttgcaggtgaagatgtgggcaattgaagatagagataggttcctgaggagaggtgtaagagtctttaacagggaaatgctacggggaggagagtggaatcagccaagaggaccaaggacggagctcttctaaggtgttgaaagggctggtagaggaagaggagcccatgcctttgttgtcgaataggatggacactgactgcatgtggctctttaaatttaaattaaattaaattaaattaaaaattcaattcctcaatcatactaaccacatttctagtgttcagtagccacgtgtagttagtgactaccatattggccagtacatataatagaacatttccattatcacagaaagttctattggacagtgcttaagtagactaagaaataacaaccatggagatcagatgtgaatcagaccagtgagctcatggagttagcatttagtgtggtcaagtcctgccataggagccttaaaatgtgacccttgaatttgacaattagttactgtgggccttttaaagattttagttaagtggtttggaaagaaattgctgtggttaagaaagtgaatggttgtgtaaagggaatgataaatgtaagcaactcttttcatggaagctctatatggggctatatatatgtatcatagtggttaagagctcagaccctgaaatcaaaccccatggattcatatcttgctcctttcacttgctagttgtgttaccttaggcaagttacttttttcatgttagagtttttcttagctgtaagatggagataaataataatccatctcatagtcttgttgtatacacggaaagcaagtaggtatgtggcacagtccattcactatcagtgttagctatctattaggaggaaggggaggatgatagagaaggaaagaatgggaggggacgttagaagggcctcctagtgaagcaatttgaatatgtttagatgctaagggaaaagagccagtgtaggaggggagtggcaaagaaagaacagatgatgcagccataaaaaggaatgagatcgtgtcctttgcagggacattgatgaagttggaagccgtcatcctcagcaaactaacacagaaacagaaaacgaaacaccacattttctcactcataagtgggagttgaacagtgggaacacatggacacagggaggggaacatcacataccaggggtgagggtgaggggagggaacttagaggacgggtcaataggtgcagcaaaccaccgtggtacacgtgtacttatgtaacaagcctgcatgttctatgtatcccggaacttaaagtaaaataaataaataagaaagaacagatgagtcagggatccatttttgaggagaggggaggtgttgggtttcagagcacgtggtggctgaagtagcctaaagtagaagattcctttttttgttgttttttaggtgagaaatgggagagtaaaggagataaagacagattcagatagtaagttttcaggtagaagggaatgtaagaaagcagtctagagaggattaggaacagtcaattagggatttccttgtgatacagggaaaacaaaactgggaatagaatgcaataaacaagtctaggattaaaataaacactatcagcaggatttgtagcaaagtgtcataatccaagttaggaaggctgacatcagataaactcagaaggtaaagagcattcattgtgtttctgaggaaggcaggaagctgctaccgtttaactggctcacatcctacagggaaagatgagcaagggagcctctgactaggttgagaggcagaacagagatggagcaaggtcaatgtttggtaattttctccaccaacaaaaatattaataagattttaggatattaaaataaggtctgtctttctggttttcttggtcttcaaatatatttcatttatgttcaatatttaagttatttgaaaagtctcaacagctggtaagtcataagacacttatttttctacaattaagaataaagttaagagcctggaatagtggctcacacctgtaatcccaacactttgggacatcaaggcatgaggattcctggagcccaggagttgaagactagcctgggcaacatagtgagacccgcatgtctacaaaaaaaaaaaaaaaacttaaaaaaattaactgggcatggtggcacatgcctgtggtcccagctacttgggaggctaagggaggaagatcgcttgagtctaggaggtcaaggctgcagtgaaccatgattgcgccactgcactccagcctgggtgacagagtgagaccctggatttttttttaaaaaaagaataatgttaatgaaaacctgttttaactgagtctttcatccagatagacttaacaatttagcaaacagccacctatagaaatcttgtcatgcatcactgataatgcattcatctctaaggtgatgtataaaagtaattttaaaaatacacatactattattacttaggaagtaaaggatatacaatccaatcattacaatcaagtacaatcactgtggagatttttagcagataagtaatacctatccattctatagatcagcagcccccaacctttttggccccagtgactggtttcatggaagacagtttttccacagacagcgagtaggggatggtttgggggataaaactgttttttacctcacatcatcagtcattagttagattctcataaggaatgcaccacctagatccctcgcatacactgttcacattacggttcacgcgcctatgagaatctagtgccactgctgctctgacaggaggcagcgctcaggcaataacgctatcttgcccaccactcacctcctgctgtgcagcctgttcctagcaggccacagattggcaccagtcttcaacccaggagttggggacccctgctatagatattctgtgtcatgaattttgattatgcttcttacttttgtagtggcttagaatctttctgtggttttgtttctgtgataagtgattctctttcaggatttccattatcccagattcttcccattttatggcagctcagatggaagaaacgctctccacacaaacaatctaaaaaatgagcagtagctaagttttcctaaaagatcttttagctattatttatgtcctgtggttgcttgactttctgtgaacttcatttggaatttgtccttgcttatcaaggtgatgtagtgatgggcacagatattgtcattatttcctatagggtgtcggaaatttagtctattggtaattttgccttgactgccttaaatttacttataaatagaaatatgtgaataatgtatttttcctctttattatgtaggtttaattgaagtagtatattattttcattacacattaacatgtagtatagtactatctcaaatataactgctgggtgatgaaaaatagccttcacaaactcatgttccaaaatttctcaggcccttattcaagaaattgttaatcttattttcatgtgcacttctaacaggggtgcatttcataacagatcataagcagccatttatacagacgaggctggctgctctaggaaagtaagccagtagagcagaaactgtcagatttataccagaactgcagtcttttattttcttttttagattgaggtgaaatgcgtaacataaaattaactattttaaaatgaacaattcagtggcatttagtgtattcacagtgttgtgcagctaccaatctatccaggtccaaaacattttcatcacccccaaaggaaaccctataccccttaagtagttgctctccattttcccctctccccagcccctgacaaccaccaacctatagtttgtctctataaatttacctattctaggtatttcatgtaaatgaaatcatatggtatgtgaccttttgtgtatggcttctttaacttagtataatgttttcaaggttcattcatgtaatagcatattatcagtactcattccttttatggctgaatggtattccattatatggatataccacaatttgttggtgtccctttgtctcttgatggacatttgggttgtttccactctctttggctcttgtgaataatgctgctgtgaacatttatatacacggatttgtttgagtacttgttttcatttattttgggtatatagtcatgcataacgtcagggatacattctgagaaatgcaccattgtatgaacatcatagagtatgtttcacaaacgaagatggtatagcctatgacatacctaaactatatgatatagcctgtttctcctaggctacaaatctgtacagttagtatactgaatactgtatgcaattgtaacacagtggtatttgtgtatctaaacatagaaaaggtacagtaaaaatagggtattataatcatggttctattgttgctgatggaaatgtctttatatggtacgtgactgtatgtctagcagtgaagttgctgggtccactttttgatggtccttcaaatagttaaacatagaattaccgccaaacttttttccatagcagctgaaccattttatatttccacaatcaatgtacaaggattccaatttctctgcatccctgccaacacttatttcttctttaaaaaaattacagccattttaatgggattaaataatgtactttaaaaagtggcaactcttcattcattttccccaggaaataataataactgaaacctcctccttttttccaatgtttttgtgtattttcctctatcttatagtcaaaatatcttgtaataatgagatgagaatgggcaataataaattgtgtttacatctaaggcagttagatgtttgacttgtcaccttggttgtttgtgccttgctctcttaccctgaactacctgtatcacctcatctctcctacatcttagccacactaaacctctcaaaactctttgtacctttctaagagcaagtaagtgctctgctttgcatggcttgaggacagtgacagtaccttattcttttttgtgttctaccttccactttttttagataccacttttcatagatatcttattttttttaatagtgcttgtcttttgtattacttatttacttgtctgccacccaaacctaactgtgagctccttgtagtatgggaatatgactttgtaaccctaggacctaacagggtatttaaaattgttaaaattcttagattttattttttaacgtggccacggtgtcttctacttttggtatagaaatgcttggtattttcttccctcactcaaccttttccaattaattccatctcatcctcttaagattcatctgaaatgttgtctccaggaagcttccctgaccttgccttctccctttccccttaaagtcttcttttaatgttcttgtcagtagcctatgtggtatctgttttatactttccacattgtatatatatttttatgaatatggaattcataaatgcattacttgtgcaccccggccagactcgctatcccttttcctctttatttttccatagcatttatttgtatctgatattcaatattttttcatttttattatctatttcccaactagaatgtaagctccacgaaggacattatttttgtctctccactgctgcatctctgacacctggaacagtgcttgctatacagtatatgctcaatacgtattttttgaatgaattaatcagttaatgaataggcctgagaactacttaagagcagtgactgtggtgtattcatttttataacctcagcatctggaatatcaattctcaataaatatttattgaatacagcatttatttttacagcaggatcttttgctatgtgatattcctggttctcatttgttgttgtttttgtttgttcctaaataattatataaaaatagaaaatgcacataagcaaaaataattgtttcattcaaaataggagatgattcagtcatagtcttgtgtatatgggcgtaataattttatctaaagccatttcttataaaggtaaaactgttcattcaagggaagagaaatttctactgaactgtaaacatgaacacatcagttggctaagatttaagaaaacagctgaatatttttatattcatatttcaaagtaatcattgctttggagtagattaaaaataaaggttgtatagggtttcaggtgagttttgattaataagaaaagattacatacacatcaagttagattaagttcccaataagccaatgatactaagtattattgggaggcaaagtcatttcagaacaggtgtactatacttaatgtagtttcccttgccccctgcaagtaggatcatatcagatgagagaataaaaagagtaccttgcctttttacatattcaggattttggtctccgttgagaatgaatcttttttgttcttttgttggaaatgggctatttacaaatattttccagggttccagaaaactcagttctctgcaaccaactttcttactctgatttaattctattttgtcgtctgtgtgattctgatacttagtctgagacctatagtaacaaatgtatttccatgcatttagctaaagaacatggggaactgacattgcaaaagacagattttttttctttttaaagtgtcatgatttccttcagatgtagctaggtcctgaacagatgaggcaggagaattgcttgaacctgagaggtggaggttgcagtgagccaagatcttgccactgcacttcagcctgggcgacagagcaagactccatctcaaaaaaaaaaaaaaaaagaaaagaaaatgtattatctgtgttaggctgggcacggtggctcatgcctataatcccagcacttcaggaggctgaggcgggcagatcacctgaggtcgggagttcgagaccagcctgaccaacatggagaaaccccatctctactaaaaatacaaaattagccaggcgtggtggcgcatgcctgtaatcccagctactagggaggctgagacaggagaatcgcttgaacccgggaggccaaggttgcagtcagccgagatcatgccattgcactccagcctgggcaacaaaagcgaaactccatctcaaaaaaaaaagtattatctgtgttttaatttctgggctcaaaaggttgatctgttttgaaactattaatgttggccagtcatggtggctcacacctgtaatccaagcactttgggaggctgaggtgggtggatcacctaaggtcaggagttctagaccagcctggccgacatggtgaaaccccatccctactaaaaatacaaaaaattagctgggtgtggtggcacgtgcctgtaatctcagctcctcaggaagctgagacaggagaatcgcttgaaccagggagacggaagttgcagtgagctgaaactgtgccacttgcattccaacttgggcaacaagagcgaaactctgtctcaaaacaaacaaaattagctgggtatggtggcacatgcctgtaatcccaactacttgggaggctgaggcaggagaatcacttgaacctgggaggcgcagggttgcagtgagccgagatcgcgccactgcactccagcctggtcaggaagaatgaagcaccatctcaaaaaaaaaaaaaaaaaaaaaaaagaaagaaagaaaaaaaagaaaagaaactattaatgttatatcttaagtaatgattaaacgtcctaaggaaaactagattttataggagttaagattttggaaatattatttataattaggctggcccttaaagtcttcttgaaggaagtagattccaggctggatatttcataatgactaggattttcagagctagagaggagggtgaaggatatctgcattttcatcctatttgagggtttcaccttagctttctccctgactctcctctcctccctcccacctcttcttttctccttctttccctaatgtgtaatgtttcctctctcatttatacattttaaaattaatgttcataggatatagatttccattctcatttgtggaaaaatgacaacaggaataggataaaggagaggactgtcctcccaccgcaaaaatagatgcacacctgggcagaattcaaacagcagaagtgtgtctcttttaagagactggagactgattgctttggagatgacattgaaggataaattgaaaggatgcccattttaggaaaattttagcaataaaaattaaagctgttatcacaacttaatggtaatactcatcatggtagagaatttgaaaaatacagaataatgtattcactattaacattttgatgcatttcctatttgaagacgttttttgacaaagttgtcctttataaaatgtaatatttcttgtgggctataaaatttgatttgattcctttttaaaaactttattttaatgtaaaagaaatgtagttgaagtagctagctgtgagatagatagcaaaggccagaattctactactttgtcatcttatgtccccttatgagcctgatcatggcctcaattactgatttgtcacttagctaatatttgtgaatgagcattgaattggagtccttcgtcattggatggtttagtagaaagggcaattgggagagagttgaggcaggggtgctagacaaatcggtggaaggctcggaatttcagtctgagctcaattactatccagcttggttatttcagtggaagtatttctgtatattagaaaaaatttcttatttgtaaaacaaggagcttgattagttctttttaatgtccctttcagctttaccatttccaaaatatgaaataaatagaatcatgtggatgtaccctttgaatctggctgcttttacttagtatagcgggcttgagattcatattcatctgtgtcatatgtactttagctcaattttatttcttccctcactcccacaaaatgttgaggaagtaccaaatgtgttttcgtagtaagaaggtatagattattgcttttgggttagagagatgggaaacatgaaagaaaatagcatttgagctgagcgctgaaagacatttaaatgcctgaatcctgtgcaaagctgagtaatatgaactgttcatgaagggaagaaacctttgcctatttgatccttgactgctggctatgaagagaaaaacagaactttctgggagatgaggactctccagtgcttgaacttaatataaatccaactgtctctcagctgggtcttcactgtcactggtgctaaccttggattcacctctaatttattccctgtcacatttttcattgcatatttccagtcttctctatttctgttttgctctttcgttttctgaaaatatctgccttttgattactgaaaaaattgtagctgtctgatttgagcctcaccacctccctcttcaatactttacatttttctgtttttacctaccttctccttttttttttttttgcatctgacaaagaaatatctctctttacccccaccgcctccattatttgaattgtcttctcgtacccttcaggtttctgccctatctttcaaccgctattgttcttaccttttcagcatatcccttccacagactctttcagtcttttaagtttgctcaggttttatcaacctcaagtctttccttccaccctatctgcccctttgaattatcatcctcacgctgtcccgccagtacctgacttatgaaagaaacgatcatcactcaccaccttggcttcattattacctgcttttgcctttattccttgcaatctggatgtgtacccagaattttgttgcacttttttttattgttgattcttttacgattttatgcaaaagtaattgtaaaaacttgtatgtaaacatgaatgtagcgtttaagtactcatatctaccactgtggccataaagtagaatgttaccattcctcagaaggcttctgtaggcccaccctgaacatattccatttttctaccacaaaaataaccactatcccgaagttagcgttaatggtgacattgcttttcactcaaaatatttttccatctacatatttatcctcaaataacacattacttagatttgcctgtttccataatgaaattgaattatactgtaccatggatattttattactgatttcttttgctcaacattatgtgtttgagattcatccatgttagtacatatacctataattcattttcactggatataatatcccattgtatgactacattagaatgtttgtttattccattattgatggacatttgggttatttctaggcttttgctattacaaataatatggctataaatgactttgtacttatctcttgatacatattgtgaaaaagtccccagagtattttctttatttttatttatttatttattttttgacagagtctcactctgtcacccaggctggagtgcagtggcacaatctcagctcactgcaacctcggcctcccgggttcaagcaattctcctgcctcagcctccctagtggctgggattacaagcaccctccaccacgctcagctgatttttatatttttagtaaagacggggtttcaccatgttggccaggctggtctcagactcctgacctcaggtgatctgcccgtctcggcctcctgaagtgctgggattacaggtgtgagtacccagagtattttcttaatagtgttattgctgaacttgttctaatgttacttagtactgccagccagttttccagagcatttgtactggtttatactgctactaatagcaactgggattaaccgactttgcaattttagccaatttatcaggtgtaaaatggtatctcattggggttttaatttgcatttccatagtttccaagcagattgaacatcttttcctgtgtttatgggccatctgtgtttcttcctttgttaaattcctgttcatttatcttgcctattttttctgttgggttgactttttcttattgactcataggagttctttgtgtattctgaatactaatcctttgttgtttgtatggattgtaaatattttcttttttcaattcactttatgtagccctttgatgagcttttaattttaaagtagttaaatttatgtgttttcatcttttggttcttgataaagaaattcttcactttcccaaggttagaatgatattcttttatgttatcttctaagaatgttatagttttgcatttcacattttggcttttaatccttctgaaattttcatttttctttctttttttttttttagtatagtgtaatgtgtctagttttttgttttttgttttttaaatagatacccagctacccctttattaaaaactccaccctttcctcattgatctgtcatctttcatcccttcctcacctctgtcatgtttcaagtgttcataggtgtgtgtacctctgtctctagactctgcactggtatatgtgttgatccctatgctaataccacactgcctcaattattattgctctctaaatgttaatatcttgataatccacgtctccatgttttaaagaacatcttggccccatgccattctatgtaaattttagaatcaacttgttaagttctacccctctgctccaaaaaaaagacagagagaaaataatttattgagattttcatatgaatttactttgaatccataggtcagtttggggagaactgacatttttacaatattgagctggcatctgtctatacaactggcatactataataactgcacatttttaattactattttttttcactatgttgctcaagctggtgtcaaactcctggccttaagcgatcctcccacctctcaaatctctgggattataagtgcgagcctccatgcccagccatgtctttgtttttaaataaagttttataattttctgcctatggaacttgctgtattttgatagatttattttcaggactttgtatcttttaagtgtttataaataaaatctttaaaaattgttttcatttggaatatacaaagacaattttattattattattattttttgagacagggtctcactttgttgcccacactggagtgcagtggcaggatcatggctcactgcagcctcgacttccctcagatcaggtgatcctcccacctcagcctcctaagtatgttacttagtactgggactatactgttactaagtagctgggactataggcacgtcccaccacgcctagctaatttttctttttcttttttttttttttttttcttgtagaggcggggtttcaccatgttgcccaggctggtctctactcctgggctcaagggatctgcccgccctggctcacgcctgctaggattacaggcgtgagccaccctgcctggccacaaaggcagttttaaagtagattttgtgtgctgcatcctcattaaactctcttattctaataataaattattagattccttagaacattctgtacacacaaatcacctgcaaagggttttattttgttttttccaactcagatgttttcttttttgtcttgttttgctggataggccttggagtatgatagaagtagtagtagtgttaccagtggcaaatatccaagtttcacagcatcaaatgtgttaccggtagaaggtatttgagtcactggcggcaaatatatacgggtctgcagcaacttcaattcttgcctcctcagaagaaagaattcgactgaggggcataaggcagcagaagagaccaaggcaagtttcagagcatgggtggaagtttacttacaaaggctttagaacaggaaagaaaggaaagtacacttagaagagtcccaagcaggcaccgaggtcaagtgcagtgtttaaccttgatcctgggactttataggctggcccctttcccatgattcttcccttgaggtgggctgcccacatgtgtagtgccctccttacccttgggaggtgagcaggcgcagtgtgtttaggaagttgtagacatgcccatctgaggttttcttcccttttctggtggtgtgcccccagaaggtcatattccgccattttgtctcttaatgcacatgctcaagaaattacttctccctggtccctgccttcaattaacactttagcacaacaggtgtggaccattaggaaatggcctttccctgaagccggctgccaatttatcacttaggcaatatgaaaactgccagaccatcacccgacattcctagtgggcaagggaagagccctctgccctgctcatgcctgtctacctattgtaacagtaactggcccccttatcttcttcttaatcttaaaggaaatgcttttaatttttcaccataaactatgatgtttatttattttaatgcttattctttatcaagttaaagaaacttgtattcctatgccaagattgccccccctcccccacgcctccccccccaccccccccccacccccccccgcttctttgtgagacggggtctcactttgttccccaggcaggagtgtagtggtgtgacgtgggctcactgcggcctcaaccttctgggttcaagcagtccttcccctctcagcccaagttgctgggactacaggtgtgcaccatcacgcctggctgattttggtatttttggtagagatggggtttcatcatgttgcccaggctcatctcaaactccagagctcaaataatccacctgcctcagcctcccaaaatgctaggattacaggtgtgagccagcacacccagtccttatgccaagaatttttatcataagtggatattgtatttgtctaagagttttatgcatcttttgagatttctatatgattccaccccgccctttattgaacttggtgaatcttattaattgatttttttttttttttttttttgagacagagtctcactctgtcttcaggctggagtgcaatggcgctatctcggctcattgcaacctccgcttcctgggttcaagcaatccccctgcctcagcctcctgaatagctgggactacaggcgcacatcactacacccagctaatttttgtatttttagtagagatggggtttcaccgtgttggccaggatggtctcgatctcttgacctcgtgatctgcctgtctcgaccttccaaagtgctgggattacaggcatgagccaccgcatctggcctaattgatcttttttcttttctttttttttttttttttttttttgagacggtgtttcgctcttgttgcccaggcaggagtgcagtggcgcgatctcggctcactgcaacctctgcttcccaggttcaagtgattctcctgcctcagactccctagatctaccttagccataatattttatattagtagattaggtttgctattattatttagtattttttcatatatgtttatgaatgaaactggcttgtatttatatttttcacactttatcaggttatggtatcgaggttatgctggtctcataaaatgagttagaagtgtttctggttttgttgttctctggaaacgtttgtggaggattagaattatttgttccttgaatttttggaagcacttgggtaaaatcaacaaggctttttattctcttgggaagatttttacttacctactaattcagtttccttaaatgctgtgggactctatggattttctatttcttcttgagtcagtcttgataaattatattttctatagagttattcatttttaagttttaattgtattgacatgaaacgcttcacaatatattcttaatctttttattatctgcagcttttttttttttttttttttttttttttggagacaggttctgactgtgctgctcaggctggtcttgaactcctggcctcaagtaattcttctgcttcagcctgtctagagtgctgggatacaggcttgagctactgcacctgacctgcagcagtttttgataggcctttttgttacacttaaattgtttgtttgctccttctctcttattttcttgttccatcttaccagaagtttatacgttacaaagtgacaagattcttttgaaagaaccaagttggtgtttctattatgtggaagttttttttaatggtattcattattggtcttacctttattattacctttccctctattttctttggatttatttatttctcagtgctcttatccttatcttctctgtaccatttaatagtattaaaccactccatccttgtagctttctcatccctggctcctgaaacacactagactttttttaaaaaaaaaaaactatttttgttttagatgtagggggtaaacgcacaggtttgttacatgggtatatcgcctgatgctgaggtttgggattctaatgattctgtcacccaagtagcaaacctagtaccgtaggtagtttttcagcccttgccttctccttcccttcccccttttggaatccctagtttctgtttctgtctttgtgtcttatgtgtttaactcccacttaaatgtgagaatatgtggtatttggttttctgttcctgtgttaattcacttaggaaaatggcctccagctgcatccgtattactgcatggattttgttctgtttatggctgcatagtattccacggtgcatatgtaccatattttctttatctaatccactgttttgggcacttgggttgattccatgtctctgctgttgtgaatagtgctgtgataaacatgcaaatgcaggtgtcttttgggtagaacgatttatttttctttgggtatatatccagtaatgggattgctaggttgaatggtaattctgtttttagttctttgagaaattgccaaactgctttccacagggactgaactaatttgcattcctaccaacagtgtgtacgtggttttttttttttcagctttgtcaacatttgtgggtttgttttttttttttttactttttaataatagtctgcctagtgtgagatggtatctcattgttattttgatttgtatttctgatgattagtgatgttgagcattttttcatgtttgttgacttgcttgtatgtcttcttttgagacgtgtctgtctttgcctgctttttaatgaagttttttttcttgttgatttaagttccttatagattttggatattagtccttttttggatgcacagtttgctaatattttctcctattctgtaggttgtttattctgttgatagtttcttttgatagttggttttggccctcagtgtacctatctcctcagtcctgtctctttagtttaattaaatccaagttgtctgtttttatttttgttgcgtttgcttttgagtacttagtcataaattctttgcttaggccaatgtttacaagagtatctcctaggttttcttctggggtttttacagtttgtggtcttacatggaagtatttaatccatcttgagttaatttttgtatatagtgagacgtagcggtccagtttcattcttctgcatatggtcagccagttttcccagcaccgttatagggtgcctgttccccattgtttatttttcttgactgtgtcaaagatcagttgggtgtaggtgtggggctttattttagaggtctctactctgttatattggtctgtgtatctatttttgtaccagtaccatgctgtttcattaagtagccttgtagtatagcttgaagtcaggtaatgtgatgcttctggctttattcttttttgtttaggattgccttggctattcaggctctttttggttctatatgaattttagaatagtttttttctaattatgtaaaaaaaatgatgttggtaatttgataagactagtgttgaatctgtagattgctttgggcagtatagacattttaaaggtattgatttttccaaccctcgctcatggaattattttctatttgtttgtgtcgtctgtgatttcttttaacagtgttttatagtactcatagatatctttcacctccttgattagatgtattcctagctgtttttattttattttattttattttttatttttttcaattttgtggctaccgtaaatgggattgtattcttgatttggttttcaacttgaacgttattcatgtataggaatgctactgatttttgtacattgatttcgtatcctgagtctgctgaagtggtttatcaggtctaggagtctttgagcagaatctttatataattttacttctgcttttcctatttagatgctgtttatttgtttctcttgcctgattgctctggcaaggactttcagtactatgttgaatagcagtggtgagagtggacatccttgccttgttcttaggggaaatgctttcaacttttgactgttccatatgatattggctatgagtttatcatagatggctcttattattttgaggtatgttccttcaatgcctagtttattaggagtttttattataaagggatgttagattttattgaatgcttttttctggttctattgtgatgatcatatggtttttgttttaattctgtttgtgtagttaatcacgtactgatttgtatatgttgaaccacccttacatcccagaaataaagcccacttgatcatggggaattgactttttgatgtgctgctggatttggattactaatattttttgaggattttcgcatctatgttcatctggatgttggcctgtagtttcctttttttgttgtatcattgccagatttaggtatcaagatgatgctgctttcatagaagaagttagggaggagttcctcctacttgatttttgggggatagtttcagtagaattggtacgagctcttccttgtacggctggtaaaatttggctgtgaatctatctggtccagggattttttggttaagtttttcattactgatttcgtttaattactcattattgatctgttcaggatttctgtaaacacactaatcttgaatggttttttttctacttttccaactgctccttctgtttctctgtgtcttcatgtctcctaatgtaggtgctcctattatgtctcctaatgtagggtgctccttttctcccaggcacacaaaaccaagtgctatttggttttggcccgcaatgtacctacctccacatttctagctcatacttaacttccagttggggtatgtgtgtgtgtatctgtttctctctcctttccttgtagtccaatttaggtctttatgttttacaagaatgatttccatgtaataactactttcttctacttctcacctcccagtggagcctcagttgccacagtaaaagaggttaacctaccttagcaccttaaattcctctatttatctgagtagttgtctaagagtattctttttaccttactacctttgaatactgttttgtattctgttatgaggtggttagtccagtgtggccacaataggtgacataagaaaagctcaggaaaacaaagtttattatactcacaggtcctagagacaggaggcacagcacaccatgcagggtcacatggggaagacaccagagtggtgaggaggcagaatataggagtgagtggaaggtttaggccactacctttgctggagtttctaaaggggaatagttaggccatcacctttttgcagtggcatgatcgtagctggttgcagcctcgagctcctaggctcaaaggatccttcctgcctcagcctctgagtagctggaattagaggggaaagctacccactggctctaggccactacttttgttggggtttctgtgggaaagtcaggacagagtaaacagtttaggattggctaatttgaataattttagagggctttgggaccacctaggggtcgtctctagttgcccagtacctggccctaggatgaaggcagaatattgcctgtagagtctgattgaggaagtatagctctagattggttagtttgtgtatcaaagacatgctcctgactgggccctttgctgtctccaagaattgactaaacctgggaggggcagtctctccccagccagaaaggtttttatgatgtcaaaatatcataatacattaaaaatgtaagaacattttacaatacagagaccatgccttcagctcctcctcccccccaaggcagaaccagggcacttaaatactattaccagtagaccattgtaccagggatactagacatcaatgtctctgttacttagtgctttgtgacttataagaagctttgatagcatttttatggcaacttgaaagtggaaccagtatatagaattttcacaaactccatgagagtggaatatttggttctggaagacctcctattagtagtgtgttaatcttttaagtgcttgtctcggtttttcaaaatctcatattcttttagtcttgttgatttatttaatatatcttgagcatgtttctctaatggtgaacagtctctttttcctccagttttattgaggtatgattgacaaaataatataatgctgtactatcttaaaatctccacaaagggactgatatcctgcatagagatagagataacaactaatgacaaaacgcatgactttaaaatagtgaaacttctacatgtggcttatggaagtgactacttacttgactagaatgtctcgttgtggaaaaaaataaaaaataaaggaggtgattctaattacattttattttcacgcaagttttcaattacttgacacaagcatgcattcttaattttactaactgtatatgtctaagtagttctgtagttttctatttgtggaagactttaggaaaaaatagaagcgattttatgatttttagaaagtgaaatattcatacatatcttttataattatctcaaggaaacaaatagggctctgcttcatgttctatacctaattattcattcttatttaagtaatacatctgccagaaattaggatgtgtatattggcagacgttagcactgtcttacaaacactgctgtaaggttctaactttgtgctcttctgactggtttgctctggatgtgtgtgcacatgtaagtgtaaggatgggaagaatgggatgtttgagtggtaggaaatggaagtgtagaaccatatccatggtctagacaattcttagagattcctgtggcctattatattttattcagtacataatgttctggctttttaaaataataactggatatagtaatttgaaaacaatgtattataatcccttagaaaatatttctgggtgttagggtggcatgtctttccataaattagccctattctaatatcagatcacagcagaagtggttaaaaagctcttgcatggctcacgcctgtaatcccagcactttgggaggccgaggcgggcggatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagctccgtctcaaaaaaaaaaaaaaaaagctcttgcataacatttttttttctttctttctttcttttttttttttttgagacaagttttagctctattacccaggctggagtgcagtggcgtgatctcggctcactgcaacctccacctcctgggctcaagccattctccctcagcctctggagtagctgggacttcaggcgcacaccaccacacacctggccgattttttatagagacagggtttcaccatgctgcccaagctgacctcgaactcatgagctcaagccatctacccaccttggcctcccaaagtgctgggtttacaggcataagccattacacccagcctcgcataacattttgaaaaatataattacagcagggcccttgctaatgagatacatgcagcaatctgttgtttaggattaaaggaattagtacagctattgttttctttatgcttatcatggagaaggttgctttttgccatcagattgctattcattaaagtgttcagagttaataataagtctttcttgctcttggcaaagtcgccagtgaatttcttctgtctaagccacatatcaagtaagctgaaaaatagaagagagcctcagggtgtctttgaactctgttcctgtgctagctgctccagttgctgcattcacatctgaattttcacataccatcttatgattgtaatttattatttatatttttgtttctgtttcttaagctttatcagtgtttgtgtacttgtcatgcagtcctgcttttagaagataaaccagtttactgtttcctttcttttgaatcccttctccttggaggtacttagaaaagtacttatgcaaaataggtgcctgatgaatgttggtaactgaaatctagtgctttatttcatttatttcttttaatagttgaaattattttgcttgctttctaggcacacaaaccaatggtctggactttcagaagcagcctgtgcctgtaggaggagcaatctcaacagcccaggcgcaggctttccttggacatctccatcaggtaggaatgttctgctcaaccatcagtgagagtgaaagatagaggcgtaaagtactggggcctgaggaagttatttcagaatgtgggaccttttaaattatttaaagcctagtgctaattgtgtaattgtgtcattctatttggttagtatgaaatcctatggtttagttgagtgtatagtcattgaccccacaggtgtgtgggaaacaaaagaattccttgttgtgaatggaatgtgtataacaactggtttattgtttttataagtgggtatctgtggtggctatctgatggtagcaaattatcaaaatcatccagaaagatgtagctaccattgcctgagacctgctgtgtaaggctctgagctccaagctcatttctgtcctctaaaacagttccagaccatgacagttgatttgggcaactactcagaggcttttgcttgactgtgacccccgcaccctagtttgaggttcaaaagactctgcctcaactttattaccctatgtcacaacatttttttccctgggtctaaaacagaccatgaattctgttcattcatgctttagctataatgtagagggaatgggaataaaaaaacaaacactggctactcaatagttttggaatatggaagctggttgaaaatggaaaacagtgaaaacagttgggagctagattatcagagtgtctcaacctcttgacttatgttcacaattatatattagaccaatattttggtggtctatatgtgttgatagtaatggtgctagtgatggtgcctaatgatggtagtggtagtgattcagtgaaaaacccatatgtacataagacaggttacatattaatatactgagttactgagcactgaatatatacatcttactaaagtcttttcatcaaaatatgtcatcagaccacctaaactataaaagaaattcttctacttgaaaacaggtaaaatcctggaagctgttctaaagcccatttatttgttcacagactcaaatggatatcatgtaggcagcagttattatctgttacagtgaggcctaatggaacacttttgctcaggcacatagcttcgtttatatctttgaaatggaaaaactttgacattaacttccagataaaatattaaaatgaattaacatctaaaatgaattttaaaatatattttaaatatatcctagaagaaaaaaatgttttcatgttgattttttttctaagaacatattcaagcctccagtaatttttctgggttcctaagaggaatagcatttttgacagaatttagtcaattatttgtcacctagtaagcatctttatctggcttaaatatgtgatggtccaaatgtattaaaaaatcactgagggtgcacagatgatgtgcagttttctctgcaggatccttctggatccaaattccaagatgattgcaactctccctgtaccagctccaagacctctagatctagccactgattaccaaaatcacagacccttcaataccacccagaccaaaggactgcaaacaaaagaattttatttgaaattgcgacaccattgaatctcccatcaagacacaagtccttgcatctgattagctacataattaacagtgtgacacttgccttctatttccaagccccttattgacagaattagcaccttgaacctttccttaccataattataatatacatacacaaaatcgatggctttaggtctgttgccccattaactataagttccatgaaaatggaaaccttttgttgtttacctgtgtcccagcatttaccaaagaaccccataatacaataggtgttcagtaattatttgttgaataaagtcatagatgactaaatggtcaagtatgagactactgaggaagaaatgattagcttaccctgtacaatctaagacatttctctcagggtgatttttgagctgagtcttgaggggtgttggaaactagctaaatggagttggtaaaggaatgctctcttctttttatttttaacttcctattttaaaaaaactttcaaatttgtaagagttacaacaatagaacagtgttcatctgaaagcccttcacctagaatcaccagttgttactattttaccatatttgctttataccatatgtgtatatgtatgtatgtacacatacaaaatacattttgcttttaccatatgtgtatatgtatgtatgtacacgtacaaattttttttttttgaaatgaggtcttattatgttgcccaggttgatctgcaactcctgagctcaagggatcttcttgccttgcatctaactgtgattataggcgtacaccatggcaccgagccaaaaaaaattgttttttgctaacccctttgaaagttgcagacattataaccatttacttctaaatacttcagcatgtttttcctaaaaacagcattctcttataaaactgcagtgcaaatttcaaattccagaaatttaacattgatacgatatcattttccaatattggcccatatttatatacttcctgcccacaatccagtccatactttgcgtttagctgtcatgtctgttaagtcttcttcaatccagaacaattcctcagcatgtctttgtctttcatgatattggcatttttgaagaatagaggccagctgtttgatagaatgcccatttaacttgaatatgattgttccctcaacggctgaacccaagttatgcatttttgaaaggaatacagcagaaatgatgctgagtccctctcggtgcattcagaagccgtatcatattgctttgtcccattattgtgatattaagtttgattattttattaaggtagtgtttattagatttgtccactgtaaatatgtctttttgcctcctggtaagtaatactctgtgaggcagtactttaaagactgtgtaaatatcccattcctcaacagacttttaccctgaaacgtaataagtaaaaatcacataaaatttttatcttcttcaaatctttgtacctgaagttctttccttgggctctttgacttcttagcctttaggccttaaacatattatctgttcagataggcctctcctgattacactgtattttaaatgtgttctacatatgtcttcagattttggttttttgtttttgtgtttgagggttctcatctactaacaggactagcagtttcaaataaaggacatagtagtcaattcattttagctcttaactcttcactgagctccataccaacatttatatttaatctcaggacatcttgatgctatctggtgtatacaaaatggaactcattatcttctctgtccctgttagtggtactaccattttccagttgcccagatttgaaccctggaataatgcatgactctctttttttaatctaaatccagtcaggatccttatgtagtgcattgcagagactttcatgtttcctactttttattcccactgccaccattctagtttagttttccatttattctagcctagtttatagtctctttctccctcctcagtctttctttgtttcaggacattgactgttttgaacagtgtacactggttattttgtagtgtttctcagtttgggtttgtctgattttcatcatgattagattcagattctacacttttgttagggatgcagcataagcaatgctgtattcctctcagtgcatcttagcagaaggcctgtgtctccttcctggtgactcttgtttgtgctcacttgattatttgtctgccaggtttctccactgaaaagatactattttaccctttgtgagtatcaagtatcattggagacatagctgagaatatgtaaatatcctgttactcctcagatttctcacccattagttatccattgatgactctgcctaaatcatagttattatcatagttgccaaatgatggtcttaattccatgtgtatccttattttcacataaccatgatttgaactttctgaatgtatgaaatgtattaaatgttttgacagacttttatgtgtggtttatagggtagattttctatttcagctaagagttttaagttatgattataaatgttttaaggacttggctgtgtgggtgtgtaaatatatttctactctggtgtatacatggaacattcaaaattaaaataagtagatggttctgattgtttctaataataaagaatgtatatagatagcttatatgttctttaacacaatgtggaaggttaattaaatttttagaatcttaagcattctgtgaatacaaacaatgttatgtaaggagcattcaatacaagtgtggcatggctgataatgttcatttagtgtgggaaaacatcttcaaaaaaagattaacagcatttttctgtgggacccgttggggtggggtagggtgggttgagaagggactgagcttgttcataaagttttaactccgtaagacaaacttctttgtcttctcagttctagctcggtgacacatagtagactttatttagtgatgacaaccccttgtgatgaatgtcaacagtattaaactagaacttcccctgattacttataggtccaactcgctggaacaagtttacaggctgctgctcagtctttaaatgtacaggtaagctgggacctgggattatgggtcaatcttttatttattttttcttatatttttctgtagtgagcatatattttataataggaaatgcttagaagtattaccttttcaaaattagtgaatctcgtgaagattcaaataatgataattattaccattaatgaaaatcagttttatattatgctactgtgcatgaaccaaaaatggacaggaaaagtctactttcaaagttgtatgtgtaagttcagtaaaaatgtttctaagttatactgctataacacatacctaaacacacagcctgaaagttctcttaaatgccagtttgtttccaaaagacttgttatttatcatttttgatgtcttagggagaccttatagggaagaggaaagaacactggactgagacacaagggtcttaggtttgcattctcattctgccactgactagctgtgtgacctttggcaagtcacataacctccttgggttcagtttttctcatctgtacttaagtggggacatttataagattgccagggttcctctccatcctaaaatgttaggcttctaataattgtaattaaacctgtttgtagatgttggtggatagacaatcaaaatcttaaaacttaaatctggccactttccttctttgaaccatatggcacaacatgcaaagttcaagtgttagacattgccctcttaatatttctatcaacctgctggttcctttcattatagtgtttaggtaactagcagtcaagagggaaagacagtattatggaagattgatttcagtgttgctaatgactaaagaccttgggttgagcatttcatgaaacccagttgaatatggacctagtaacacgtaggaacaaggagagaaaagaaaaagagataatgtgaccttactttctgagggagaggaggcggaaaattgccttggttgccatggtaaactttcatcccttagagagatgttggcaaacaggctgtatctccagtgcagaatgtttacagtcctgcactgtaattatctctcaatgactggcagaattaatcagagcatttatgttaattagccttgctgcagtccccaaaacaggtggtgagaaatatgcaaatctatgcagaattttaatgctttgcataaccagttttaattaccgtaaaattttctcttcgtgcccctctctcttgactgcagcattttctctctgagcttgtgtgttagttgatgggagttgctagatttaccgttctgtaaaatattaggtggaaagttctgtggatcaagtgatcattctctgagatggtatatggagaagtttcagactgaccaccaggtgtatgttaaaatattggtttggaaggtctaatgtagaggtgaattgaaaatatattcttccctttaccccctatttctagagttgaggaattgggggctatgaaaaaaatctataaatttgtgggggatgactttatttttaaaaattgtaatagcagctttgctggcattagaattaacaagtttaaaaacttggtatgtgaaactaggaaaatacaaataaaagaaaggaggtaaaccagaactcatgactgaataagctcatgttttaaatgattcctaaaagatggggttttaagtacatttcttttaatcaaccatttgcaatcttttatttcctacccaccccacctcagtctaaatctaatgaagaatcgggggattcgcagcagccaagccagccttcccagcagccttcagtgcaggcagccattccccagacccagcttatgctagctggaggacagataactggggtaagtgttcactgagagaattataacaaactttttctgtgtcagaactgccattggccaatagctgattagaattgttcaccatagctggtagtaacatggctatgcctggcactattgtgtctttaaggaacttcctacactgtaggtagtaagttgctctgaaaaaggaattatctttgtcgtaagttttcaggatatcttttattagaattgtggatgctctggataaattaaaaaccttattaaacccctgtttcaggtgttgcttcatcatgcaatggagtaattatcatatggttgagatcattacactgaaaatggcagttatccatttggcattaagacatcactgcagggtagaagttaaagaatggattagtacctgcaaaagaaaaacatttttctttaagttactgtgtaatgatctaaaataaagcatgtggcttcatatcctagctctgcaacttaccgtatggcctaattacttcatttccctctacctgttttccttctgttaaatggagatactaataatacctatctcacattactgttgtaaagattggagataatacatgtaaaacttatagaacggtgcttggcatgtagcattcaacaaatattgtttatttttgtacttgatcttagccaaaaggctgagacgttctgtcatttattttttatggttaataaattggcctgtttggctatattaagcttttaagttttcagctgtcttttctctaaggcaccattcaaaatatttttccaatgttgaaaatttgtgtattaaattatctttgtgggggttggtttagggcaatggtaaggaatagtttttattcaattcacatcacattaactcccaagaatttcctagggttttttgttttctttctttctttctttttttcccagttaagtgtgttttgtcagtggacaactgttttaagaactgttgcaaaattgttcacaaaatcccatgagtagagatgtatgtatatatatattatgtaaaaattaaaaatatatctatactttatatacacacatatcccttgaagggtattgagtttttgaatggtttggttttgagccttatgtttctaatgcacaaattgtgtttgattcttttagaggaggttgtggcactaagtgactgtacatatacttcagaaaattatggttccatcttgtttgatcaatcagaacttgtcaccaaaagaaaagtagaacacatttactactttaagtgtgtttgaaataagttgcattatgaaaacaactttaaatatgctctaaatacatttcctactttactatttgggtcttgtttttggtgactagtgtctacaatagtaagagggagttgggattctaggttcctttggctggagcttctgttaaacctgggcattagggttcatttgcatgtaaagagaacggctatcaccacctgtttcatagagataatgtgttggaaaggagatgtaaagttgcagagactcagtgctttcaataacagaaaagattgtgttagggaggggcctgtagggagacttggaaaagaaacaaatggagctcatattctttagtcatatctttggacttaatggaaatgatggaatatggcagggattcatgctaatgggaagcagctgggccttatcagttctttccttggttatatccagcatccttgttcctcattcatctgactaatcacttgctgtttggttgtgtgtaaatgtattttcatatcttgtcagtggtgattcttttttttttttcttgcttactagttaattacttttttgcccaaaccctagggccctggacaagcttgaatgattaagtccatagtggggaccaccattttaatttaaatgttctgctagtaatggtagtttgatcactgatgaacattttagctgtctgctaagcaagtgaagttgggtagctggggactgatatcatttgagttacctattttaaagcagttggcttgcattaggagactttctccttcaacactttcccataatgtgttctggttttgtttagcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggtgagtgaggaactccaatagctggggcagcaagtgaggaataaagtggcaggttttatttaatgttagattaactttttgattgttagtgtggggccttaactgcctgaggagctctagatcagtgaggtaagcggtacccttccttaccactgaattagaaataatgtttgtttgcttattgtagttgatattgtaaacatatagctgattatttgaataactgactttatattaagtgacaattcttgaataattagctggcatatttttgaagcaggggattactgtatttattttaattagctaattacagcagacatggattttttttcatgtgctctgcggtgaatgttgccacccatgtgtgagacagtgagtcatctctgctatggagtgattaacattattgcattagaatgttgtttggtttcaattttcacattttagggcaaagtatctagagataataaaaatttatttaagaagcgccaggcgcggtggctcacgcctgtaatcccagcactttgggaggccgaggcgggcggatcactaggtcaggagttcgagaccatactggctaacacggtgaaaccccatctctactaaaaatacaaaaaattagccaggtgtggtggcaggtgcctgtaatcccagctacgcgggaggttgaggcaggagaatagcgtgaacccaggaggtggagcttgcagtgagccgagatcgcgccactaaaaaaaaaaaaaattaagaagcatacacaatagtaccaaggaggaaaataaataaaatctttaatctcaagaagaggaaaaaggtataagtagatatatcagtaaaatatatgaagagttattatgagtctaattgttagacagctgtctttatccgtctcagaaaagactcagaaatggacttaacttgtagcaagagtttgactaaccatttaaaaagaactaattaactgtaagagtagagaataaatatcagactagtctttatacaatctttatcaagataatgttttgattttggccactttctcatcaccaaataaatgtttttagtgcctaagctgtgagaccctatattaacattagtctaaataagataacgttcatgaaaacactttgaaaattataaaacagtaggccaatgtaaggtgctattgttgttagggattaaatttttatatggatagctatttttggttttaaaaaattgaatactttagaacatgtggaaaagggcaaaaaaattgaatactgatttttcagttgagttagataagctgttgtcaaatgtcataagtcattataggccctttattgatggaaattcagacataacacgatcaatttttatttaagagaaagatcaatcaaatatttaaaaactgttttctcacttgatttttaaaacccatattggtctttacatgataaaaaacagaagtatatttgttctgagggaattttaaagaaacattgaaaattaggcttatcataacaatatatgtcagtccacaaaaatagtcagttgcagaggctccaggttgcttcacgtgctttgtcaagcacacacagagcataccctgtttggaatatgaaagcatgcgaagtatttactcttctttatttggatgtgacagaagtcatcagctggaagccttataattaagcgaacttttatttcagaatctccaatccatgttttaattccaatttttcaggatcttcaacaactgcaacagcttcaacagcagaatctcaacctgcaacagtttgtgttggtgcatccaaccaccaatttgcagccagcgcagtttatcatctcacagacgccccagggccagcagggtgagctcctccttagagcttattagtggtataccaaggctgttcgctgaatgttacacatgcatgaactactatcattttggccctgaaactattagaccaatgtttttattaaattttatttgattataaactttcgtttaaaaaaagttttgttttgttttttgtcataaataccacattattgaaggttgccctgaactgccattcatctgcttaatcactaaggaagaaccaagagtttggccaaaagtctaagtgaaattattcaacatgccaaacataaattggataagttgctgctagtgttttgattgtttttcatggaagtgtattcaaagaatatagactgagtgttgaaagtatgtgcttctaaccattgtttttttaatttaaggagggaagactgctataatagaaactacaaatttcgtgagttataaaaaacatctttgagtcatttgagtggtaaatgttatataattaatatatcaaacaaccactcgtctgtaaggtcagttaatgtaatcagggtgaagaatgtcagagtatcaaggcttcaacccaaggaacattagtgcatcactaatgattctttattatttctgagtgggtttttttgccttttttcttcttgatcattcattccaaaatcttttgtcatgaaataattattctagcatatattcaagattcagagataagtaattcagtatttacttgcagagggctcacaatttagtggcagggaaacagacctaaattatgttagatttgatatgcacacaatgctatgggaaccaagcaaagagacccctgtaactttgtgctcagataagtcttcacagtgaatttgggaaaatacattcataggcttacaaaagagagaatgtcagtcttggaaaatgaacagcatttgcaaaccttagaaacatggaagaaaaatcaataagctgtgtttgagaactataagtagtgccttacaactgcagaataagtttgcatatgcaggtaatagtgaaatttgaacccagaaagattagcagagaccagatcattaaagaaccttagattaagtttccaggagtttgaccttaaatcctatagcttagtgcttcctaagatttgatttatttaagagtcattaatggccaggcgtggtggctgacgcctgtaatcccagcactttgtgaggccgaggcaggcagatcacgaggtcaggagatcgagaccatcctagctaacacagtgaaaccccatctctactaaaaatacaaaaaaaatagccaggcgtggtggcaggcgcctgtagtcccagctactcaggaggctgaggcaggagaatggtgtgaactgggaaggcagagcttgcagtgagccaagattgaaccactgcactccagcctgggtgacagagtgagactccgtctaaaaaataaaaaaattaaaaaatcacttgaggaattagaaaagtttcctgagccctaaccccaacctcccaattactttttttcttatttttaaactattaggttcagggttacactcaggtttgttatgtagataaactacatgtcatagggatttgatgtacagataatttcatcacccaggtaataggcataatacctgataggtagttttttcgattctcatcctcctcccaccctctaccctcaagtaggccctggtggctgttgttcccttctttgtgtacatatgtactgaaagttttatggctgtatagtattccgttgtgtatatgcaccacattttttttaatccagtctagtgttgatggatatttaggttgattccatgtctttgctattgtgaatagtgctgcaattaacatacgcatgggtatgtgtctttatggcagaaaaatttatattcttttgggtatatacccaataatgggattgctgtatcaaatggcaattctaagttctttgagaaatcgccaaactgctttccgcaatggcttaactaatttacattcccaccagcagtgtataagtgttcccttttctccacaacctcgccagcatctgttattttttgagtttttttgttctttgttttttgggattttaagagatggagtttcactcttgttgcccaggctggagtgcaatggcacgatctcggcccaccgcaacctccgcctcccaggttcaagcaattctcctgcctcggcctcccaagtagctgggattacaggcatgcgccaccatgcccagctaatttttttttttttttttttttgagacatagtttcactcttgttgcccaggctggagtgcagcagcacaatttcagctcactgcaacctctacctcctgtgttcaagcgattctcctgtctcagcctcctgagtagctgggattataggcgcccgccactatgctgggctaatttttggtttttagtagagatgaggtttcactatgttggccaggctggtctcaaactcctgatctcgggtgatccgcccacctcggcctcccagagtgctgggattacaggcgttagccactgcatcaggcctttttgtttttttgtgtttttttgagatggaataaataggaaatggattcacaggctcctcgttcttgctctatttgtttgtttgtttttgagatggagttaaatggcatgatcttggctcactgcaacctctgcctcgcgagttcaagcgattatcctgactcagcctcccaaggagctgggattacaggcatgcgccaccacacccagctaattttgactttttttttttttttgagacagagtcttgctctgtcacccaggctggagtgcagtggcacaatcatggctcactgcagtcccagcctcttgggatcaagcagtcctcccaccttagccttcaaagcagctgggagtacagtgtgtactacctcacctggctaattgagaaaaaaaaaaaagttttttatagagacatgtcttgctgtggttgcgcaggctggtcttgaactcctgggttcaagcgatcctcttgcatcagcctcccaaagtgctgggattataggcatgagccactgtatctggactcacttagaggagtctaatgtgaatggcccaatatcttccaataagaaagtcttctgtcaactctactaaaccacagatttaatcagaaaagtggcatttccaagtttttatttaataaagttcatgttgaaacttgggtagggaaaattggtaaataagtaggtagatggacaggacctggtggccagttatatttgattaatgataggaaagaggtatctaggtataatgcctgggtttttaggaaactacgagggttgatagggtcagagaaaatatatatgtagtgttagaagaaccttggtgaaaccaaccttttaggtgtaaaggattaagtagattcaaaagatactgcattttcagaagtcaaaaactagtggagagtggtaatcgcaatggaagaaaatgccaagagggaaggagaaagtgacctagatcagaaagacttaggaaggtcaatgcaaagtgtgtttattagatttgttaattgccaaagccttaagatagaatgagattgccttcattcactttcagcaaagccaagggcgttgtctttcccttttcatatctgggacctcattttatttcaattttatttgtctcaaatcaagatagtaggaataatgaattactgttcattctgattttttggtacttgcaaaagtatgtgtatgtttttaaacactcccccaacttccagacttttataagattgggaaaatagcacagataatgtaatactgattggccttagagccagtgaccctggacaactcacctaacctttctgagtttcccatatttccctttttatcttccccttcacttacatgggtgaattacaaaaaaagttttactaccctaacatcaggaaggtcattataatgtagtagcaaagagcatagactctaaagccaaactgtctctttgtgaatcttggctctgccacttacctgtgtgtcctggggaaagttaactttatgggcccctgtttcctcaactgtgatattaggatactttcagtgttcacctctaagagttgtagggagtcaacgagtaaacacatgtaaggcaccttttagaaagctgcctcctacatagtaacctttctaaatctttgctgctgttatcattatgacattatcatgataccagtatcatcctcagtcaacaaacgatagataactcagagaatgaaaaggttgttcctttatatagtttccctagaatcaccttgtaccactgctgctgagttgcaatcattcgttagtcgtatgtgacctagattccattttctaagattattcaacaatgtagaggatcagcgtagtggaaatacgtctataaacatttctaagaattgaattcattgtaattaatagcatcagagaagctgaaaatccaaagagctaatctcttaacttcatgatggaggacaaagattttatcttttggaattttaataatgtttccagcatgagattagccttcaatattgatttctggaattctgttttcccttgtttttcattgattaacctaaaacttttgagatgtagttcatatttttggtaatattgctatgattatataactgtaactgtctagaatttaatttctagcaagggaaatttaagccttttcctcagaattatttttcatgggaaaattcttactgatagattactggacttgagtcataatttattggttatcttattctgccctatctactctcagcactaattataaaaataatcaaagaaatgtttttggttagaaaactgttgttcatttgagttttgtttgggttttcattgtttaggtaagggaaagtggcaagcgttttttttttgttgttgtttttgagatggagtcttgctctgtcgcccaggctggagtgcagtggtgtgatcttggctcactgcaacctccgtctcccaggttagaaggattcttctgcctcagcctcctgagtagctgggactacaggcgcatgccaccacgcctggctaatttttttgtatttttagtagagactgggtttcaccgtgttagccaggatggtctcgatttcctgacctcatgatccacatgcctcggcctcccaaagtgctgggattacaggcgtgagccatggcgcctggccaagcattggttttttaaaaagttctaaacctctatgggccctttcagccttttcagctgaccttgtttgggggtaaaacctaaggtttgaatttgtttacttatctgcttttgtctcttacagattaaactaactttcattgttaaactttaaagaaactcctatgttgaaatagcctatgtttaatggaacttcatttctgacctttgtgctctcttctctttttttttttttttttttttttttgagacagagtcttgttttttcacccaggctggagtacagtggcgcagtcttgtcttaacacaacctctgcctcctgggttcaagcaattctcttgcctcgcctcccgagtagctgggattataggtgtgtgccaccacacccggttaatttttgtatttttagtagagatggggtttcaccatgttggccaggctggtcttgaactcctgacctcaagtgatctgcctgcctcggcctcccaaagtgctgggattacacacatgagccaccgcgcctggccctctctttttttattattgtttttgaatattctttagtcttttcaaaacaattttatttaattagttttaatagttaacatagttttgttcctctagactacccttcagtatttttcaaaccagtaaagtttgatattttaattaattcactcaaaaattagttgagtgcctgctgtgtcatatagtgctctgatagttagggatgtattttgaacaagatgcaggccctgccctcattaagagacgtcaaatagtaaacatgtaaacaaatggtttagataccaataagtactagtcaggtagcggatcatagtaatctggtaatggttaacctaaagaagaatgggcccatggtctggaaaagtctctctggagaagcaatatttgaattgggaactggtgaggaaggatgagggagaggttaccacacctagaatctgaagacaagagtcttgtaggcaaaggaatgtgaaacacctgagatgggaacagcttgacctgatccaggaaaagaaaagccaaagtagctggagttcagtgagtcaaaggaagtggtagaagttgagatacgatagctagacagggccagatacctagggctgcatagattttgttctaattctaatataaggccatgacagcattttaattgggaaataataagattataaagatcaccctaactattatatggagattgaactatagggagacacttggggaaggaggatggtcatttaaacttccataaacctgccttttaagaaatgtttgtagtaatatatgctgaattttatttaatcatatttgcttcaatatatatttcacttgtcccagatcagcaaaagtcagggttctttagaaaaattcaaatctatttaatatatttatcttatttgtgacctacattatgaaataaatattagtatcttttgatagcttaaatttaggcagtgcttagttacttataaataagtgataaattctatggctaatctctggcaggcttaagtgttctggctgttgtcctacatattacaacatttaatatatccaaatttagtaacctaatgaaatcataattaggaagctattgcctcagataatcttatcacatattcaaaagaaaatggtaaaatcccttttgtttggtgtgctttgtcgaatactttctaccattgctcttatcacagcaaacataatcttgtatttagtattttagcaacagcattttatctgaaactctttacttaaactctttactctgtatttaagattaaatccttaaatacagacattctgggttggtcctgtctatcagtttctgaaaataaaaagccatgtattcaagtaattgagcatcttctacaaacaaagagtttgtatttctactttgaatgtcagtttgtcatcatgaagcattggtggcattacattatcaattatttgaaactaagacagttcagtgttcatgcagatattaatagaatattttacatttcaactttattatcaccaacaggcaaatgtttgataaagagaacttgaaaatgcttcttttcctctggtccaacatacgctggcagtttctaatggattctaggttaagaagttgagctctttttggaatttccagctgtttctatttagaatagttttttaactttcatcccattctttcctaaaataaaggattgacctatcacagagcttattcagattatgccaaagacatatcagttttaatttaatgttgtatatcttctcttccaagttgtaaaacaagattgaatgtaaggcaaataagataaataagagttttgataccagtaagactaccagagatcaactggaaattttcagctcattttctgattctttctttcttttgccatgtgttcgaagaaatctttaatgtttctggataacatgtttttcttctacaggtctcctgcaagcgcaaaatcttctaacgcaactacctcagcaaagccaagccaacctcctacagtcgcagccaagcatcaccctcacctcccaggtcagttttcttctatgggggctgctttctcttatcatattgtttggggagacttttggactttatttaatttttttttaaatctaataaaaataattcggtcttcgaaaactgaccagaaaatcaaagctaggcttatcagctcaatgctaccaaatcaatatagtctttgaaaatcttcagagttcctgtttcttatatgttcttaaagaataactgcattagcagtaaatgagtaatgagttctagctatgtgacatctcccctcaccatacttggcggtagatattaccacttaaactggaaacctagtgagcctcagttaaaaatccattgttaccctttaccctttctcagaaactgctaagagattttgatctctatattttcttttttctcaatgcttttatggtgctttagctcatttctactagaccatataaacactataattatattaaaaaaatttagacatataaaggtttaaattatagacctgattccacttcttatctagctgttgctttgaacatgtcattttatctctctggacctcagtcttctcatctataaattaggtgactgaactggctgatcctgaatctccttccagctctgactttctttgtctgcagtatggaagttatcacttaatactaacacattaccagatttgacagaattcagcatccatttatgataagaactcttgcaaactagatatagaaggtaactttcttaacctggtaaagagcatgtattaagaaaaaaaaaagaaaagaaaaaaaccaacatcatacttcacgaaaaactgaatactttccccctaagatcagaaacaaggcaaagtgaccagttgccacttttattccacattatactcaaggtgccagtaatgcaataagacaataaaataaaatattaataaatgacatacagattagaaaggaagaagtaaaactatcttagttgctagatgacatgattgtctatgtagaaaatcttaaggaatctaccaaaaaaagctactggaataagtgagcttagcaagtatgatacaaactcaatatataaaaatcatttacatttctatacactagcagtgagcatttggaaattgaaattaagaaaaagaaatttacagtacttaggggtaaacaacaaaatatttgtaaggcctatacaaatagttctatagttgaaaactatagaacattgctgcataaaattaaagacctataaaatagaaagaagtaatatgttcatgaatcagaagacttaagttaaatgttaaaatgtcagtttttcccaaattgacctctagattcaacagtctcaaccaatacctagcaggcttttttgtagaaatttgcatactgtttctaacatttatatagaactgtagaaaacacagaataaccaaacgattttgagaagaaaattgaaggactactgatgtcaagaataattataaaactcaagtaatgaagacagtgtaatactggcatatggatagaaatagagatcagtggaacagaatagaaggtccagtagatccacatgtatatggccaactgatttgccaaaggtgccaaaggatttcaatgggaaaaaaaaagtcattcaaaaaatgcagctgaaacaatagggaaaaaaaataaaaaaccttgactattatttcacaccatgtacaaagatttgtttgatgggtcatagacctaaacttagagaaaaaagcttggaaaaaaatctttgtgtccttgggttaggcaaggatttcttaaataggacacaaaaagcaccataaaataatggataaatttaatttcataaaaatcaaaagcttctctcaagtgaatgaaaagaaaaccacagatggggagaaaatatttatgaaacatatctgataaaacatttgtgttcagaatgtctaaagaactcattcaagttaataataagacaatctgatttaaaggaatgggcagcaaaaaaattggagatatgtcaccaaagatgatatgtaaatgtccagcaggcatatgaaaagatgctcaaaaaccgttagtgatcaggaaaatttaaatgaaatatcactacacagtcactagaataagcaaaatttaaaaggctatgacaaaaccaagtgttggcaagaaggtaaagcgactagagttctcatacattgcttagtggtgttgcaaaatggtatacacactttggaaattattttggcagtttctttttgggggggtgagggggaggcaaggtcttgctctgtcacccaggctggagtgcagtggcacaatcacagcccactctagcagcctgacctcccaagctcaagcaatcctcccgcatcagcctcctgagtagctgggactacaggcgtgcatcaccatgcccagctattttttgtagagatggggtttcgccatgttgcctaggctggtcttgaacccctgggctcaagcaatctgcgtgtcttggcctcccaaagtgttgagatgacaggcgtgagccaccgcaccaggctggcagtttcttataaaattaaatgtgcatgtaccttgtgacccagcagttctgtccctagaaatgaaagcatacgtccacacaaagacttgtatgtgaatgtttctagcagctttattcacctcaaactggaaacaacctaaatatacatcagctggtgactaggtaacataagctttagcatatccatatgatggaatgctactttgcagtaaaaagaaacgtgcttctgatacatgcatctcctgtgaatctcaaaagcattatactacatgaaagaagacataaaagactgcatacagtatgattcaatgcacatggcattttagaaaagacaaaactaaggtacataaaacatattagtggttgccagggacggggggctaatggtggggattaactgcaaagggaacaagggaacttttgggagtgatgagaatgttctgtatctactactatctgtagtaactgctactgcaattagtagcagttgtatgactgtagttgctgaaacatatactttgcccttttaaatggtgaatttgtgaatatgctgaatgcaagagtgaggttgggattttgaaaaaagcctataccagagacttcttcctggcctccgttctctgcatatggtggcagggccgttgtggcttcatcctgactcctgctcactgaattctactctgccatttctagatctggcccagtccagcctgaggtttctggagctggggtaacttatctgtaaccaccccatctaaaggtacccaagcgatttttagtcctttattatttgagaatggggctacttcaggcccggagatgaagtaacaatgtgatagttaagactcacctgtaactgtcaaccagtttcgctgtgagaaatgtacagctacataggggtctgctatggttggtgctcgttttggctcctccaaaatggtcaggttgaaaattacgcagtgtcagcatgacatagaaatgaactttgttattgtcattgaaacaggataagagaggaacttaactccagttgtcgcctgtgtaatgcttattctgtagttttctgggacagttagttcctttggaggaagccttgactcataaggtaaaggtcaggcttatataactcatctaaatttgaagaagaaaaattcacagccacagactttatctgtaattctggtttataatcgctcacctgggctactcttcacaggaggagtcaactgagcaactaagatgcagtcaggcagtgcctcccactagtgaggtgtgttccactcagggcttgtgaatagaacagaataaccttaagtttgtgtgataagaaagttgagtattttatttttaaaaagagactataccctcatgtcccaaaataaactatacatggatttaaataatcaaatattcaacaaagaagaagctagcagattaaaaggaattttatcaatgttagaaataagtgaagctttctcagatttgaagtaacaggatatattagaaaggaaaattaaaagctcacccaaatgacaatttaaaggtttatgtaccctgaaaaataaaaggaagaaagcaaattggaaaagcatttgcattaatatgacaaagcttcctttataaaatttgaggatctctctaaggataaggatgagaataaatatcattaatatataaattggttaaggacgtaaatccaattcacattcaaagaaatacagataataattgacacatgggaaaattttgacattgagtagtaagagaaatacaaattaaagcagcagggaactaccatttacttcttgaattagcaaaacattttttaaaactgctaacgtaagtcatgtggaagagtgttgcatagtgggaaccaacgttatgatatgtatcaaaaaccatgaaattgtttatctagttaccagaaaagcccttgagaatttatctcaaaagaactaattacacacataggtggaaaaaataactaatatgcataaagtttttcattgtgttatctatgttagtgaaaacataaaaactgtctagcaattaagaactggttaagtaaattatgagaatattgccttagtttttaaaaaggataactatgaaaactgaaatactcctgatttcagtagtccaagctatcaaagagtaagtcagtggtagtgcttaaaacaaataaaaatgctatatatccagacaactatttaaaccattaaatatattcactcttctttaaaagtcctcggttagctgacaaattccagaaaattaatttggattttggttaatttggggttttcatcttctatagattcttgctcgattaactggtgttagcataggcttagagagtatgtgtgcctgtgcttgcatgcctgtctccatcaccctctctcttccaaaaagttatttttatttttaatttttattaatttttattttttagagacagtgtcttgctctgttaaaacaacgttaaataagaaaagcagagagtaaaattttgtataccataattacagtgaaggtttaaagatataggtccttggggaaaaaactggaacagatatacaaaagcgaaacctgttataagctatttaaactgcaggtggtttacttttcccccttaatgattttgaattatgatcttgaatactatttttataatactgtgtcacaggttggagatgtaatagtggtaaacaagacagatatgctgtctactgttttgacagttgaagtgctagacttatgaaatagattttttgaaataaagagtaatttattaaaagacataagatatatgtattcagaccatttgaaaacccagttataataggtttcatttttgtgtattcatttcatttttgtgtattcatgttttttctatagaattacataattacttgtaattacagtatacataatttcactgtctgctttgctcactgaacattatgttgtacattctgtagtgttacatggtcttcatcgttatccataaatgtggctctttccttcagttgtttacttggagtaaacctaaatatctcttcacgtgtttttcctcattgttttattctttctccaacagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcaggtagggtgaattggccttacattgattcccctccttggctgggtccaaatacagttggctctctgtattcatggattccacatctgtggattcaactagtccaaaatatttgggacgggggacgaaaaaggatggtcatgtctgtactgaacatgtatagacttttttcttgccattatttcctaaacaatacaacaatttacatagcatttacattatattaagtattataagtaacgtagagatgatttagagtatatgggaggatacacgtatgttatatacaaatatacattttataatttggaggacttgagcatcagtggattttggtatccaagggaggtcccgaaaccaatcccctgtgcatactgagggacaactgtatttgctttacatgtccaaagaggcttctaagatacaatatgttcctcagccatgttgttttttggttttaaactgcacctttttgttagccttttcctgcatttttaatgtatggtttaatgttagtctagaagctttatgatttctttcagaacacaggcctctgaaatcataattatatcactaaattgtgaagactttaaaagattgtatggaggattttgttatttgaagaatatctggtggtagacctcagtacttcatatgtaagattgagagagtaaagattacggggtgtattatattagctaaaaggggaaaagtttagaaggcttatttaaaaacagttttttgtagtgggggcagtagctctaatctgtaatcccagcactttgggagactgaggtgggaggattgcttgagcccaggagatggagaccagcctgatctctggtgggaccctgtctctccaaaaagtaaataaataaaaaatttaactgggtgtggtgacgcatgcctgtagtccaagctatcaggaggctgaggtgggaggattgcttgagcccgggaggtcgaggctgcagtgagccatgattgctccattgcactccagcctgggtgacagagcaagacactgtctctaaaaagtaaaaattaataaaaattaaaaataaaaataactttttggaagagagagggtgatggagacaggcatgcaagcacaggcacgcatactctctaagcctatgctaaaaccagttaatcgagcaagaatctatagaagatgaaaaccccaaattaaccaaaatccaaattaatttcctggaatttgtcagctaaccgaggacttttaaagaagggtgaatatatttaatggtttaaacagttgtctggatatgtagcatttttgtttgttttaagcactaccactgacttactctttgattaacctgtcataaataatatatttttttagagacagggtctcgctatgttggccaggttggtcttgaactcttggcctcaatcaaccctcccgccttggcctcccaaagtgctaggattacaggtgtgagccactgcgcccagcctgcaaataatacttttaaagcaggcaaggaattaaactgaatgaaatttatgtaaaatggtataagatcattaggtaaaaaaaaactgaagtatggattagactgggtgcctttatggaatcaggagaaatctgttattttctttccagggaatataatttaaagtttttaagccactagttaaatattactcaaattattttgtgttgaaagtacggtaatgctccacctggcctggtaggtcaaaatccaagggtagcatccccaaatgtactatgggtgtttttaagaacacatttatatatatctttatatatatcttttttttttttttttttttttttttttgagacagggccttggtctgtcacccaggctggagtacagtggcatgatcacggctcactgcagccttgacctccaggggtcaagggattctcccacttccgtctcctgagtagctgggactcaggcacaccaccacacccggctaatttttgtagagacgaggtcttgtcatgttgcccaagctggtctcgaactcctgggctcaaccaaatccacccacgtcagcttcccaaagtgctaagattacaggtgtgagccaccaggcccagcccaggcttatatttctttgggaattcatttttgctcaaagaaatcaattgtgttggggaatatgtaatgattttttaaataggcatgattttagaggaaatacagttacatttgtgaggagtttgacttgtgaagaagcaaattatccagaaacattttaatactttcaaagcatcttaaatgatctgacctgttttaaaaagaaagctaggccgggcacagtggctcacacctgtaatcccagcactttgggaggccgaggcaggtggatcacctgaggtcaggagttcaagaccagcctggccaacatggcgaaaccccgtctctactaaaaaatacaaaaattagccgggcgtgctggcgggcgcctgtaatcccagctaatcaggaggctgaggcagggacagtggcttcaacctgggaggtggaggttgcagtgagccaagatcacgccactgcacaccagctttgggggtgacagagccagactctgtctcaaaaaaaaaaaaaaagaaagaaagaaagctaaacatagaactagattgatatgagtaagttacaaagctgaaataagtataaggttagcatatttagcagtgcctcaagttttaaactattagcacagcatactctggggttccctgagagattgttgcgtaagtgatatgccaaagatgttaaggcttttaaaaatccttatcttttactcaaatagtggtttgcctttctgcatttgacccaacatattgccagtgttatgtttttctctccctccgcacatctctccaggtaaaggagcttccctatggtctggtgttttgttttgtggttttatcctattttttggcatgaccattccttatttttcgaaatgactttgagacagcagtggcaatggttcacaaacttggactatgtgggttaaagtacatactactgctgcagaatggaaaatcagtctatcaacctctgtttttaagtcagatacttcaattttagttattcaaaggttgctctgtgtccaatttatttatatacacacacaaagttttagccattaaagttatttgctgaaacaaaaaaagctctattctctgtgtaaatatacacattattagatgttttaaagttattttctaatttcataattgcttattaaaggattaccatggctgtctttgcataattagaaaacatgtcatagcataatacatttatcacatgtggtacattcattatttcccagtctcagtttttgttccttttttgttatgttctttttaaaaatatcaaagggatataatatagttaagattatatatgaatcgactacttaaaacatttacttttgtgagtgataacccaagatggttgtgagttggattatcacgaaagagcattaaaccaagcctgtaccgaattaatgaaaattagtatgttaactgaggagtctgttgctttttattcaattaagcaatttaaatgtgaaataaaacatattaataaatgataaagtgagtttattatttattatcatggttctagttagtgaatggcatagctttatttccagccaccaccttaaagtatcatttcttataattactgtcatgattttttaatatatattttatttacttatttatttattttttttagagagagggtctcactctcttggctctggctggagtgcagtggcacaattatagctcactgcagcctcaaacttctggggtcaagtgatcctcccacctcagccttccaagtatctgggactacaggcacatgcaccacacacagctaatttttttgtgtttggtagagatggggccttctgtttccaaggctgttgacttattttttgcttgttaaattgttacttttataataagacagaagtttgtgaaaatttgtagcttattgtgcagttactatgccagaaaacacttattgccatctaactgctacataagtttatatactcaaagaattgcaaggtttagttggcaccagctgtaatctaaacaagctgaccatgacatgaatatatgtgatacacaatgcataagttcaatgcttgacatatagtaggcacttagtgaatatttgattgaatgaagtaacattttattttattttattttattttattttattttattttatttatttttttgagacagagtctcactttgtcacccaggctggagtgcagtggcatgatctcggctcactgcaacctctgcctcccaggtttcaagcagttctcgtgcctcagccttctgagtagctgggattacaggggtgtgccaccacacccaactaatttttgtatttttaacagagacgggggttttgccatgttggccaggctggtctcgaactcctgacctcaaataatccacccgcctgggcctcttaaagtgctgggattacagttgtgagccaccgtgccctgcctgaatgaagtaacattttaataaatatatagagatacaggtatagataaacataatcatctgtgtctttagacatatttgtatacagtataatggatagcatttatgccctgctcaccactgattctgattcttgcagttttatggtaattggaatgaaatcaataaacagtctacttcagtatattcagaactgtcattaaaactttctgtgatgatggggtgttctgtacattggacatgggatgtccaatacaatagccactgtctacttatggctattgagcacttggaagggctagtgatgctgaagaactgaatttttaatttattgggttttaattaatttaaatagccacttgtggctggtggctatatgggaaggcagaggatatcaatcacttgaagttcaggtattctgggtgcctcattttgtcttacatttcaatatttctcatctgttaaactttttatcagaagttgctcaccaaaaagaaaatggggttttaaaaatatgttacttttttaacccaactaccacctaataaaaaatgtagtattcaatgtgctaataaaaaatgtagtgttcaaaagatggatttaggggtaggggggaatcaaaagactgggataatcccagttcaaacaagtgttgccaggatagttgagagttggctgtctcatagtaggattagttgtatagtactttggaccagaaatgatgttgcctttctgccctgtcactaaactaattgaaatgaatgggtgaatcatttaaactccgtgagcctctgtttcctgtatataaagcaactatcttacgcttttttcccagtttgatcaagagagattcagcaagaagaaaagctctgtatacatttcaaaggttataggcttatagagaaagacatcttttgtaatatattcagggcatcattgttctattgctataaggttactaagtttccattgcccatgaaggtttgactaaatgggtcaaacctctctactgtgaatttctatttctatgatggttacaaaagtagtcttttagaatacctgttttttgtaactaactttgaaatccaaactaggagtgaaaatagatttttttttcactgcgtccagaaatacttgatagggaaaagaagaaaagagatgatttctaatttttaaagtgatttttgggaagtttgattagttcgtaaatatcttgggttatctagagagttatacataatatctgtaggtgatacagataaatttatttttatttttcttttttaaatttttttctttttttgagacaggatctcgctctgtcacccagactggagtgcggtgccatgatcacggcttgctaccgccttgacctcctgggctcaagcgatccttccacctcagcctcccaaatggctaggactacaggcacacgccaccatacctgcctaatatttgtattttttgtagatgttttgccatgttctccaggctggtctggaaatcctgggctcaagcattccacccatgtaggcctaggcttcccaaaatgctgggattaaaggtgtgagccactgtgcccagaccagataaatacatttttaaaaattacttaaatcactttggttgtatcaattaaggggcttgttagaatattagcactatttttgatacctagttgaaattttggtatctccatgattacataaggtggcaagaagagattcaaaatgggaaagtatgtgggacagtattgaacattgtaacgatcaggcctaaaagagtcctcacagtaacactgtgactggcttagggatggagtttatgtgggaccccgtaagtggaataattactgactccttgtctaaagcagttattggagcaacaccccagagtgaaggctttaagcactggtgagataactctgtctttcctctcctcttctcctgctctgtattgtgtgtagggtgatgttgggctcgctatggggaaactatatggaaatgacttcagccaaactaccatctctcgatttgaagccttgaacctcagctttaagaacatgtgcaagttgaagccacttttagagaagtggctaaatgatgcaggtaagtgactgtataagacatttctttgtcattcattggaattttacatggggattgttatataaattggggtttatatttcttactctatttttgttgttacagaaccttgaagcttactaatcctgggaggatcattataaattatggtgatataaatcagaaagctgattcatttaaatattctagtaattacagtataaataattagccgtaatttttagcctgaaatactcttgtatttgagccaggattaggaacacacacacacacacacacacagttgaaggaataggataagtaaggcttttgtatttagataagcttgaagtagaagcttattgtttcttccttgatgaattatcatagaacttgttcttgcaatagttctgcttttgttatttcaaatgaccacacatttcattcagaaaagttggactactagctttgtcttacgtttttttgtgctgagagttccttttggaagattggaattttgagtcacaggatcatagactatgaaagctgtaggagtcatgtagatcccttaaactatggttcttattgtagatatgaacaaaaattaggcctttggaaaagacaaacctgaaacacgcatccttggacagttttattcagtagctatgggtgaggcctaggcatctgtttcccaagtccacagataagaaccactggtttactgtttccatcttattttacgtgtagcagaaacaaactcagatgtgtatgacatgcccaaggttattaaactgtgaaattatagaaccctgtgatttaacttcagagaatttataaatatttcatttgtttcttttctttttaccctagattataccaataaaatgagaggccatttacaagataaatattaaacgttcagtaatttctaagaaactttcttccttttatccccagaacttataaacaaacagaactggagacatagagctgagtttaaggataggaatagtaaacctcttctgtctcagaaacagaaatccaaacatagtggtaatattgtcaaccatcctagcagaaagaatgccaataagggcagcagaaatatccatggtagtaaatatatatatattggggggatgggtggtgggtagggggagacatggtctcactctgttgtccaggctggagtgcagtggcaccatctcaggtcactgcagcctccacctcccaggttcaagtgattctcctgcctcagcctcccaagtaactgggaccacaggcgcacgccactgtgcccagctaatttttgtatttttggtagagatggggtttcaccatttagccaggctggtcttgaactcctgacctcaagtgatcctcccgcctcagcctcccaaagtgctgggattacaggtgtgaaccaccatgcccggccaataagcaatattgtaatgtaggttatgtgaaaaccttttcatacttggatgtagcttattttgtcagttttgttgttaatatgcatattatgcacatgaatcactgtgctcagctaattttatttctgtattttcttcattcttacagagaacctctcatctgattcgtccctctccagcccaagtgccctgaattctccaggaattgagggcttgagccgtaggaggaagaaacgcaccagcatagagaccaacatccgtgtggccttagagaagagtttcttggaggtcagtgaggattttacttttctgtacatgggattgtctgtgtagtacttaacattagtacttagtagaaactgtaggtggtaaaagatgacatgtcagcctctgctcttatggatgattataaataggtgaagtaagtaagttactaacataggagacagaaccagagttctgcagggttcaggagagactagaatcacatccatgcaagcactcagtatgagagaggtggcagcttaccataggatacataggaattaattccacagactagaaaaggtggggggaaagtactttaagcagaggaaatgcatgagcgtttccccctcagagtgggggagaaacactggagtgagggaaaccatagggtgtatgaggagacactctagtagattagttggttaaattgtagtgtctgtatgcctggaatagtagtttgggactggaacactagagaccttgagtgttaggctatggagcttaagttaatgcaagagatatttggcaattatttttttgtaccaggtaatatcataacaaagcttttaagaaaattttgacttctctaattcagaaaagacttgagcacattgggaggactctgaattaggagtttttgtcagctctgccacttaaactgtgtgattgggcaaatcatgtgatttctttaagctaaaggtccttcatctgtgaaatacctgcctttcttactgtgagatccaaattagatagcatgaagcatggagaaaggttaaattcctactaatacatgtggttgtactggtattttgttaatttcattcacaattaatagatcttaaaaatgaaaaactatagatatttaaggataacttatcctaagttaatatgaataagtttaataggtgtatgttcattagaacttctatctacacaatctctttgttgaaagtggcctaatgtggatggtcatatgtatcccagcttcattttctaacctgacgtgattatgccagtagttcaaaaagttattgcaaaggatagcttttggaattacatcttttcaccctgcagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtaagaataaaaaatagggagtgcaagctcaagggctaatttttgcaattttacaaatgacctgttaaatcagtttatttcataatagtaatttaatgaataaatacatcaaataaatgcatgtaaatttgtattttagacattaccaaggtaatgaaattctcattctctctttccttgtctctcgtgctctctctctctctctgctgaggtcactggtcttgaggtgcccctgcatggagggtgaaatctcgtgttgttattaacccaagaacttattggtcttgcttattttttatttatttttctatttattttatttttttgagacagagtctcattccatcacccaggctggagtgcattggtgcgatcttggctcactgcaacctccgcctcctgggttcaagcgattcttgtgccttggcctcccgagtagctgggattatagacgtgtaccaccattcccggctaattttttgtactcttagcagaagcagggtttcaccatgttggccaggctggtcttgaactcctgacctcaagtgatcccttggcctcccaaagtgctgggattacgggtgtgagccaccattcccagtctttttttttttttttttttttttttttttgttgagacagagtttcactcttgttgcccaggctggagtgcaatggtacgatttcagctcactgcaacctccgcctcctgggttcaagcgattctcctgcctcagcctcccaaagtagctgggattacaggcgcccgccaccagacccagctaatttttttgtatttttagttgagaccagggtttcatcatgttctccaggctggtcttgaactcctgacctcaggtgatccacctgcctcagcctcccaaagtcccaacgtgctgggattacaggtgtgagccactgcgcccagcccacctatcttattttttaaagtgaacaattttaattctttcatcacatttccatcatactcttctctggtatagttcattagattactctgtaaccatgggagtaaatttgctgctgatcccagttatctcagaaaatcttgttactttttattcatgttgagtcctaaagcccagtttattaaacttacactcacgtgattaagtgacaataagttaccagataaccttcagttctgaacttgtattaaaacaatcatctcaggtcttttactttgaaacaacatatgatcctttcctgtgaagcctcattgagtaacttctgctgtttgcattattcctagactgaagagacatacagtggtcgtatgactcccttggtttttaggatgattatgaatttgacttctacattgtcaggattcaaaagatgggaatattgttgagtttgcatttctgttctttttaaatttggttttattttatttgaatgtcattccatactggcaggctttttaaactaaggtcagcattaaaagcacatgttagtttatgtgaaggttgtagttgttaaatggtgggcctgtagtcataaagttatgagatagttatgaaaaagataattattaatcaacaattttgttttgtaaaggtgatgtttgtgttttagatttgtactaaaagaaagacagtatttcttgcaaaactagaattttttgttatttcaaaactaatccgttttttttaaaagtttgcttcacattattttcataattttattttattaaaaccaaacctaaggcaatactgcccccctacagagtcaaaagtaaaagtaatacatgtaccccagattccctgatcctgtcaaatagttttcttatttaggtaaagttgataattagtataatgtttcttaccgacttagagtatatctgtctcaacgctattgaaatttacgaactttttattatttatttttaaaacccaggcaaagctatctgtgatatcagtgaacaaccatcttcgaatagcagctttccaacataggatgtcaggtgtctcaattccaagatcaaagaaagactgtaaaatcatttcctctttaagttttgattttaagtgctttgtccatgttttcatttctgacctcaaggtggcgaccacaccaagccttgtgactagcagtgcagcaactaccctcacagtcagccctgtcctccctctgaccagtgctgctgtgacgaatctttcagttacaggtaagcagctgccaggccatgcacctgctgagcacatgggaggcccgttttgggttattataagagtctaccattaaattgtgaattaaggccctaactaaagataggtgttgctcataaatatcaattttctttaaagtaactcctttccttaaaagccttcaatagccgtggctttttgcattcagaaaaacatccaagtttgtcaattcgtgaaggttatttccggtctgaacctgatctcccactagtcttttgcctacgcaccctcaacacacaggaggcctccatccatacctttgtaaacatccctacaatggaaatgtccatcttagcctgcagttcttgatctgttactgataaaactataccagcttgtatgtcaattttcttggaaatattctttagctttcccaggaaactattcatttccatgtacctgtattataaatgattttatttttacacacctgtctttcccaatagactgcacttctcaaaagatttgattattctttttgaactcttgatgcctagctcagtgcatgacatactcactataaaatgaatgtttttttttcctttggcctcttttaaatagcaaattttccagataaatttaaaatcacttagcattgtcatcagatgttttttagtgatacatagtgcataagacatgctgtaattattcaccaggttggttatttgctagtacatcattgggtagattaatgatatttcataatgaagcttgatttaacctagaggtagggacttttatttttctcacccatgttttaagtttacaatgcctccttggctctatgacctacccatgatgtaaaaattgaataaatggctttatattatattaaatttctacattattagaacattttgtttattgttttctgcatccaatcatccattaatttttgcttatgttaaacagtacttcttgacctcttctggatgttggacctttttaagaatttgaaagctacagacttttcctcacacaaaatagacatatacacaatttttagtaaaatttaaggagatttataaatgacagctcccatcaacctcccactccaaggctatttgtggatacctacaggttccagttttaataaccttggttcaagaatatacttaagaaccttggttaagaatatatataatattgagcacttccacttaataagcaaactgttagtgattgattggcattgtgttgggcaccaagaatgtgaagaaccatctctgaggaccttgttgtccaaattgactgccagtcacctggtaaattatgaactgaatcctaccttcccaacaaattatattgctttaggtctaaaaatacctgtctcttacagaaattttgttaatagtttacacattaagaacaaatagctttgcagttttcttaaaatatggggaaaatcaaagtaattttagagagattttaatactcaaaactagctaaaaatttgcatcagtttttgatacttcttaccactcacattttcttgaactcttactcagcctatttatgtggatctatttgtgatttttttctgacacgttgataatttttcctggagtgaattttttttaattattaaaaacattattaggaaattcaaacaggaaaaacaatcacaagtaccatttttattttctctttaaatcctttttatatgtacatgtatgtacagtttcagtagtatttgtgcagtacagtatttgattgcagccttgtgatactctaagcagaggactcaggctctgcctggacacctgacccacaaaaactatgagataataaattgtgatgatttaagctgccgaatttgtgtcattgctccttgaaagagaagaagagtcagtgtcaagtgggttttcttttcttactcttttatcagccgttgctcaaaaccatgcccctttttaatttgtttttcctctttggactgtaactttcttgtacagcctcttttcctctgatatttttatactgccttctttttttctctgttgagaaaagtagcatgtttctttatcatgttatttattaaagacggccattgtcttaatcatacaacttatgtaatgcaatctgctttcttcctgaagactttcttcttgggatttctatgattgcttattttaaattgttttccttgttttcctgagttagatccaatgtttctcagatgccctgtcatcctctttgattcctttttgtctggagcacgttctcaagtaattttatttagaaaggttacatgggaggtaaaacttctaaatacatgtataactgagaagtatttattttgccttcacagttttttttggagtttgtccagttacaaaagtatttttcctttgaattttgttgtgttttagcatctagtgttgctagtgaaaagtctgatttcaatctctttttccttgttttttctctctgtaaaccttaagggttttttaaaatcttatactgttctaaaatttcactacaaggtttcaaagaaggggccttttaaaacttgccctcattggccttcagcaagcattttcaatgtgaattaatgtatttcttgcactctggtaatttatctttttttttttttaagttaggattttttggcattcactctgtttattcattttgtgtcatttgtaatgtgctgttggcttttttcattgtctggtgatttttgtagtgatgaatgcaagattacattacttattatcagtagcctgtaagggtttttcctgacattgtgtagcttctgttactcaagagtcccctcccctgaatggaagggctcgcggtgagctgtgaatgtgaataaagaactgccaaactttatttcagcctatgaacaggaagcaggcaggcaagcgaggctttctgtcatacttttccaaaatgaggggtatctttcctcatgcatgcaagtacctacactagaatccttagcgttccatagtcagattttattttctttcaagagtaggtgactttggttctgttcatttgagaggtctggtagaaggagggaaaggcccactgtgagagctattatgtgaatagcccttgaatcaccctgttctctgaccctatttccatctacctcagtatctgacaaataactctgagctgggactctctgtgaggctccatcagagtgaataatttcctcctctatcatagtcttctcctgtgcccttctggattatggttgatttctccaccatccagttttatcctttttctcatttctgcaaatctgtctaaatctcaaaacctctgatacctgtcaccagagctctttttcccttttgtatctctttactattatttggaataggattttagaaatgaagggaaaaaccatatccttagcactatcttctaagaaaaatcatgtttgattgatgtggtcatcttattttcccataggtacgtttgacacataataggtccttggtaaacattctaaaatagatgcaagtgagcattgccatactcctccagaaagacgagtgttccattgtgtctcaaaaacttgtaaaaattccacagcccttaataatctcaaccaaacatgccccgcccccaattcattttccaaaatatttttcatagtgacaaaattgttgattcctcaggaagatatagcaactataattatatagccaccttaacaacaaaggcccaagatacaggaaacaaaaaggaataaaattcaaagaagaaatagacaattcaacaataacagttgcagacatagtatttatttgagccacgttaaaaaaaaaaaaattcaggccatgtgcagtggcttatgcctataatcccagcactttggtaggccaaggtgaaaggatcgcttgggtccaggagttcaaaacctgcctgggcaacatagtaagaccttgtctctacaaaaaaaaaaaaaaatgagcaaaattagccaggcgtggtggcacgtgcctatagtcctagctgctcgggaggctgaggtgggagggtcacttgagcctggaaagttgaggctgcaataagctgagattgtaccactgaactccagcttgagaacagagcgagaccctgtttgggggaaaataaaaaaaagccgtgaaggatatacaacatttgagcactatcaaccaacttgttctaactgccatctgcagaacacttggtccagcaacagcagaaaacacatcctttttatgtacacatggaacatccatctcccaggatacttttagccataaaacaagtttcagtaaattaaaaaggattaaaatcatacaaagtgtgttgtctgatgacaactgagataaactagaaattaacaatagaaagaaatttgggaagtccccatgtatttgaaaattaaaacatgcatcaaagaagaaataacatttctcctctattttcctatcaggccggtattacccagatacctaagcttagataaatagcacaagaaaaaaaaattacaaactcatattcctcgagaaaatataaaccaaaactctcaaaagaatcttagcaagtcaaatccagcaacatactgaaaaaatcgaacgattatatacatcatggccaaggaggatttatctcccaggaatgtatggttagtacaataactgaacatcaattaatgtaacacattataatagtagaagaaaggacaaaaaccacataatcatctcagtggatacagaaaagatatttgtaaaaatccaaaacccattcatgatgaaagctgaaatacaaaggaactgcctcacctgataaagagcacttactaaaactctccagcaaatagaatacttaatggcaaaagactgaatactttccccactaagattgagaattaggtaagagtgtttgtttgctcttgtggacttctgattaacatcgtcctggaggttatagcctccagtaagggggagaaaaaaaacggaagacaatttggaaaggaagaagttaaactgcttgtatttgcattattctatatgtataaaaatactaaggaattcaccaaaaaaaggtatctaggactaatcaataaattcagtattgttgcagaatacaagattgatatataaaaaataaattacatttgtatgtactatcaatggacagttcaaaaatgaaatttaggaaataacttgtatgtaacagtatcaaaagaataaaatacttaggaataaacttaaaagaagtgtaagacttgaacaatgaaaactacaatttgctgaaagaagttaaaagaagtctaaataaagagacatttcatattccatgttcatgttttggaagactaagcattcttaagatgacagtttttctccagcttgagatatatgtgcatctctctttctctctgatttcaaggtttatccacattatagcataaatatatatttttttattttatttattttatatattttattattattattatttgttttcgagacagggtattgccctatcacagtggcgcaatcacatttcactgcagcctcaacttcccaggctcaagcagtcctcccacttcagcctccccggtagctgggactatagccacatgccacccgcccagctaatatttgtattttttgtagagacgaggttttgccatattgcccaggctggtctcgaactcctgggctcaagcaattcacccaccttggcctcccaaagtgctgggattacaggcatgagccaccatgctcagtcttccagcttgatttatagattcaacaaaatcatagtaaaaattccaacaggttttttctttgttttgttttaaagaaatcgataaactcttggaagggaccaagaatagccaaaacaattttgagaaagagtgaaatcagaggattttcatgtcctgctttcaaagtttactgtaaagcaacaataatcaaagcagtgtattactggtatacatatagatatatagattaaatggaacaaaattaagagtccagaagcaaaactttaaatttatgctttattgatttttgacagaggtgccaaggcaattcaatagggaaaggacagtcttcaacaaatggttctaggacaactggatatccatatgcagaaagaggaatagaggaatttagatccttaccttacaccgtgcataaaaattaactgaaatggatcaaaggcctaaatataagagctgaaactataaagttgctagtaaataaagtaggacaaaatctttgtgaccttgggttaagcacagagttcatatacacagcaccaagagaacgatccataaaagaaaaaaaaattagtaaattcagcttcatcaaaagtaaaatcttttgtgcttcaaaagccacagactgagagaaaacatttgcagatcacatatccaataaagaaattgtgtctagaatgtataaacaactcttacaactcaatagtaagaatataaacaactcagatttttaaatggacaaatgttagtagacattttaccaaggaagatataggagtgactagtaagcacatggagagatatgtgacattagcattactcattagggaagtgcagattaaaactgtaatgagatactactttgtactcactagaatggctataatcaaaaagacccaagatgataaatgttgggaaggatgtggagaaactggaactttcatgcattgcttgtaggaatgtagaatgatacagcttcggaaaacatcttggcagttcttttaaacataaatttaccgtcctacccagcaatttccccaagagaaatgaagacatttctacacaaaaacttcaatgtgaatgtttatatagcagccttatttataatatccaagaactggaaacaaaccagtgctcatcaactggtgaatgaataaacaaaatgtgttatatctacacagtggaatattattcagccataaaaattaatgaggtgttgattcgtgctacaatgtggatgaaccttgaaaacagaatgttaagtaaaagaagccagatgcaagagactacatattgtatgattccatttgtgtgaaatgtccacaaaaatctagagacaaaaagcagataactaggtaggagtgtgacatgattacaaacaggcacaagggatcttttttgggagtggaaatgtcataatctggattgtgatgatggttgtataactgtaagttgattaaaagtcatcaaattttaaagctggatgaattttcatgtgcttactagtcactcctatatcttccttgttaaaatgtctactaacatttgtccatttaaaaatctaagttgtttatattcttactattgagttgtaagaattgtttatacattctgacacaattccagttcctttattggatatgtgatctgcaaatgttttctctcagtctgtggcttttgaagcgcaaaagattttacttttgatgaagttgagttcactgatttttcttttcttttatggatcattctcttggtgctgtgtctgtgaactctttgcttaacccagggtcacaaagattttgtcctactttatttactagaagctttatagtttcagctcttatatttaggcctttgatctgttttagttaatttttatgcacagtgtaaggtaaagatctaaattcctctttctgcatatggatatccagtttataagttgtatctcaataaaagctgtttgagaaaagacaagacagggcgggaagcacagggaagtgccaggtactatatacacaccttgactatagcttcctactgcccctgtgaggtggttggtggtatcttattttgctgttgaggacattgaggctcagcaacaataagttcactagtcaaagttacccaagtaattaaattgccaagttgccaagaatttacagtcatgaaatacatatattgatgaaaacatgactcactgactgggataattaatttgaagataattttaagttgttataccataatgcttatttatataacatttatattggagacgcctagaacaattttgaatgcttctggagtcatcatcttctggcctaggttaaattcactgataaaatttgactgggattttctttgtaaacttaagggatttaagaaaacagttggtgaatgatttgaaggtggctggagagtaaagaaataactattttaagccttttgagctcaagatattaggacttataaaaataggcaattcaatttcagaactttgaaagggaagtagtacccataggtaaaatcaggttagataaggtgagaaattggtcaaaaaaagattgaaagtacattgaaattgcttagcatggaagagaaataaaagatgttcaccttactatgtgacagggggcatgtcttaagagaagattaaagcgaaaaagggtatatgaatctgcctaacacaggaccctacacagcatccagtgttcagtggttgattgttctgagagatttagaaccaaagaagtaatgaacgaaaataggattcatagtatctacaaagatgtaatgatatttaggggcagtggcaataaaaataaatcacttatatttttcagaagggtagacagaggaagaaagccttcctttttatttaacaataagaacattatgtttacctcattcatttggcagccacttttgcacagctttataggaggtgaagaaagtagtcagtgctgaaataaatgatgtctgagtctctcccaaccctgtgacatgtgataaaaactgaagagtggaagtgagagttcaattctagatgttcttagtacagaccagaagaaggttttaaaacagatttttggaaggacaaaattgcctgaatttgtaacaagattgttatgaaagaagagcatgttctgaagcttggtaaaagatttcatcaccaaaaaatgttattattattattattattttttttaacggagtcttacttcgtcacccagactggagtgtaatggcgtcatctcggctcactgcaacctccacctcttgggctcaagcagttctcctgcctcagcctcctgagtagctgggattacaggcgcccaccaccatgcctggctaatttttgtatttttaatagagacggggtttcaccacattggccaggctggtttcgagctcctgacctcaaatgatccactcacctcagcctcccaaagtgctgggatcacaagcgtgagccaccacacctggccttgtcttaccattttcagtggggctactagaaatttttaaattacatatgtcttgtatttctgttagacaacactgatctcaaacattaaataatcccagcaaatgtgttttagtgtttagtaatgatatatttaatgtcagttagtcatttatatccaaatgttcattctccttaaaccaaaagcatattcaggcacttttttctaagacctcacaaataatttcttttttttttttttcttgagatggagtcttgctctgtcgccaggctggagtgcagtggcgcaatcttggctcactgcaacctccgcctcccaggttcaagcgattctcctgccttagcctcccgagtagctggaactacaggcgcgtgccaccacgcccagctaatttttgtatttttattagaggcagggtttcaccatgttggccaggatggtctcaatctcttgacctcttgatctgcccacctcagcctcccaaagtgctgagattacaggtgtgagccaccatacccggcctacaaataataatttcttagatcttaatttttatgcttttatgagattcatagtatcattgtatgttgttttttttttttaccacaatggactttttgagagctaatttttattacagaatagttgtttgaatgtagagaaggcatgtagtcatttttatactatgttgttgttgatactgaattcttagaaaagcatataactttctgtttttcttctccttgttttgatttttctgaggagacccctaaggagatttctgaatgaaaagagctttacagaagtttttcttcttttgctttctttttcttccccagagcagttgtattccataattagagcttctatgattcttttgtttcttgaataggaaacaggcaatggaaaacttctctgtttctttcattgctcatatctcttaaagtagggttcctagctgtgatcctaaaatgtttggttttgtagttaatttccataaaagcactaaactaggttattaaaggacagctttactaggtggtaggttaattattccattgattatagagtttggctgagtaaagccaccattcttccaaaaccatttacaaaaggtcatcttctaatctgtttgtcttttcaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctgggtaaggcgctttctcatctcattcacgtctgaggtggaggtcatccctggaattactcacaggggagactttacatcactgacttagatggggaaaaaaatgtctttaaagcagtaatctctttgaagtgggctgttttgtgatcatacaaggactttgattatagttgagtttatgtttcttaacaccctgggaagggcagtagtcatacctttgtttccagatgaagacccaaaataccaggtcactaattaccttagtgacggggccaggaagaaagcctagaattcttgactcttattttccccattaaactctctcaactgcctacttcctaattctcaagcatagataagagatgtaataggagtctcaattttatactgttattgtcacacattataagaattatcttgtaaatatatctttttctctagaatgtttctttcattttggaaagaaagagaaataagtctttcaaagaagggtcaaaatgactataaaagttttacattttgtgctgatcataacctcgtttgtatgagtaagcatccaggaaagcagtaactgagaagcacaaaccatagaagagtaaagaaaaataaatatttccacctatttccccagctggattttcgttttgtaagttccttttggtgtgttgtcaaaatgagacctgcgtctgcatggtaataaagtgactcctcttttggacttgcagaggtgccttactcagtctgaatccagggaccctgagcggtgctctcagcccagctctaatgagcaacagtacactggcaactattcaaggtcagtagaagcctttttcttactttggtggcatgcacgtgtgtgtgagtgtgtgtgtgtgtgtgtgtgtgcttgagacagagatagaggaagtctgctttgctagaggtaaaagtgatgggaaagagtcaaatgctgactaacttgttcttgagaactaagaaaatgtcctcgtaaaaaagctttgtaagaaaagtataggtgttagtatgtgagtaaaagcaggaaatatacttagtttggtatatggtaaaaaaccagaactttcatgctaatattgatcttatgtgagtagacttgaagccagatttttttcccctgataagtttatcccaagtattaatctaaaacccgtctctaggcaaacttgaccaagtaagactctccagttcccagctgcactcctgagaaagctgtgcatgggaaagtcctgtaatgaacaaacattggaacacatcaggtggacctcaggagtgcttttaattctcattaagttctgctctttttatatcgccgttagtgtagaacatatattctcttggattataatgtctcttttccaagctcagctgggttccttttgccttttagcatgttacccagggcaatattcattccatatactgaagggttccacttgtttagtacctaagctttctgtctaaaaatgtttactgttatgtgattcagggagacaatttgagagacatcactaattaattagaatttttttcttaaaatagttttgctaagaggctgaggcaggaggatcacttgaggccatgagttcaagactgcagtgtgctatgatcatgcctgtgaataaccattgcaccccagcgtgggtaacacagtaagaccctgtttctaaaaaaaaaaaaaaaaaattaaagtgttttgtgcataaatgagaattctcagggccaaaaataactattagccaacctaaattaagattaatatttcacaggtaatatctctaacagtgtactagagaatgttaattacagacaaaaccaaaccatggcctagattaccttacattatattgactttctgattgactaaatcatacctgaattggttagctctaaagcttttgttatataataatttttttttgcaatagaatttgtgataaatcactttttcttctgctttattgaatgtttctgtgctgtgttgatactacaaaggcaaaatgtcttccctagggcatgattgacactctgaaaagatactaagtttggaatctcagaaaaacttcaagctgcactgtctcactgttctgtactatttgtatgagcaaggccaaagtcagaggcattcccttcagctatattttatgtaagaaatcaaatgtgtaatgccgttagaaaatccctcaaatctacatgtaggagtgaggttatatggctagagagatttaggaatgttgccagacaacaggttgagatactaaatgagagtctcgattattttaaataaaatgttgatgatgccttctttggggaagcaacagcatcatagaaaatttctcacccattaaagcacatcctagacttagatcacccacctacatcattatgtctaatttcctgctacaatagattcatcattctcctttgcacaagtcatagaaatcaagtatttagcctcaggaagtgagaaattaattataccttttaactttatttggtgatacataatttattttagaactaaagcctttttgcaagatgattttcatcttgtatatcataatataaagcagtggtccccaacctttttggcaccagggactggttttctggaagacagtttttccatagccacattgtggtggcgtggtttctggatgacactgtttccacctcagatcgtgctctatgagaatctaatgccgccactgatctaacaggaggcaggcctcaggctgtaatgcccaccactcacctcctgttgttaatgctttaatcacttcagctagtttgtcctttgaacagaggtagtttaaaatcagcagtcttcattaaagacaaaattattggatttatcaaatatgtctaggtaaatgaaataaactggtgatttcaagacacgaacatgactctaattcattagacagttattagctgtcttctacccctgcttgtgcccattaaattagacatttcagtcttttaggctcttcaaaattaaaaataaactacaattggtatcaatatagcactgtgtttgaggaaaaaaattcagtgaagggctatactttttcctggtgggttgtaggaaaatgatagacttttgatgtgttatttggcttctccaggatgatgttaatgttttcattcctgcctgttttggggggtttttgtctgtagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttga

SEQ ID NO: 12136 - DNA, 32065 bp, Human
  misc_feature (1)...(32065): n = A,T,C or G
gcctgccttagcctcccaagtagctgggattacaggagcgcaccactacgcctggctaatttttgtatttttagtagagacgggtttcacatgttggccaggctggtctcgaacttctggcctcaagtgatccaccacccccccttggcctcccaaagtgctgggattacaagtgtgagccactgtgcccggctgaaaagaatcaattttgtcatagtttggagaatttctccttttctctccatcccttgaatgcaatttattaccaaatctgtcttatttgttattgtctaatttgtcctttcatctggattcccattgccaccctgcgtggtaccaccttactcccagctcttctcatctcctgcttagagtaagagctctctaactagtagcagtgccccaggccaggcgcggtggctcacgcctgtaatcccagcactttgggaggctgaggcgggtagatcacgaggtcaggagttcgagaccagcctggccaacatggtgaaaccccgtctctactaaaaatacaaaaattagccaggcgtggaatcctagctactcgggaggctgaggcaggagaatcgcttgaacctgggaggcggaggttgcagtgagccaagatagcgccactgcactgcagcctgggcaacaagagcgaaactctgtcttaaaaaaaaaacaatagtaggcggggtgcggtggctcacgcctgtaatcccaacactttgggaggccgaggcgggcggatcacgaggtcaggagatggagaccatcctggctaacacggtgaaacctcgtctctactaaaaatacaaaaaattagccaggcgtggtggcgggcgcctgtagtcccagctactcgggaggctgaggcaggagaatggcgtgaacccgggaggcggagcttgtagcctgggcgacagagcgagactctgtctcaaaaacaaacaaaaaacaacaacacaacagtgccccagactctctccctccaatgtacactgcatacaaagactagacaaacgatgccaaaggttacaccaggacgacaatgaagtccaagtcactcatcttggcgcttctttttatcaagctagctagttaatattaccacttacaatcattctccgagtccagccagcttcctcagaaatcctccccaaatgcagttcacattcttccctcactcctccaaaccttataacattattcccttttcctgtggcataatgcaatccagaggcatcctctctgagagcctacatcctttcaatcctccaagaaacagctcctcctcccatccttgagcttttcccacccagaataggctgtaccaaacatttctacattgtattaactcgaattatatcacagatcgaggtcttcgctttcagaaaagactcacattcttctcatataggcctcgcatggcctggccaagtacttcctaagctcggaacaaatactggtcaactttaattgaaccaaatcgggcggggtttgcggagtctgagagtgcaacgttggggagagggggatgaaaacactggaggacgggctgaaagcgtcgagtccgacacaaaagaggcgtcagacaaaacgccaagaggctggggactgggaacgaaggaagaggttctgccagaggcgacctgccacctgcgcgaggaagcggagtaggacggcggccgttggtgggcgtggtcgcgctagtctcgcgggagcggccgttgggcgggccgttgtccctgcgggcggggcgagttgctaaggaaatgactgcccgcagcgcctggccccgccgcgcaggccgggcggggttctggagcggcgccgtttccgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggtgaggaggcaggggcccataggctggccgctgcggggcgggaatctgacggagaaagagagcgggggatggggtcctcccctgggaagggtcccaattgggagcctgcggccgcagcggccgtttgcggggcgacagagaccgcggggtcagggccgagagggagctcccgatgcttggggaccgtgtgccggtggccagtggcggcgagggctcggccatgtgggaagaggcaccttccgcccactgaccgccctctccccgagctttggcgccatcctctcgtgccaacctagccctccaggctcatcaacggtgtgaggtttagtgtgggagtaaagacgcaaataggggctatttattcatttgtttttcaagggagaggtgaatagatgtgaataactttttaaattttaatatttaaaatatctgatgtgggaagcctcttttggctaggagtttgacagtgaaaggaaccccgggcagagtctgtttcacattttggttgcctggccttgggctcttgcatgttaatttcagaggctggacccgacctccaggagttgtcactcatttgcactcttttcagggccttttactaacttcggaaaacttgaattatgtcagtccctaggttttcctttttattatgcttcgttttctttctctcttaggatttctctaaaacttaatcagtaattctcatttgcctgtaattgtagtttatagtttctttgattgtaagtcatttcatcaatttttttcatcacaacctacctacaaagggcttttctagaaaattttactctggacaaaaggggaaaagaaaaatattggggggaaagtagtagtattaggtaaaacttgatgtgaaactacaaaagagaagagggaaaactgcggtagggaggaaagggaggaagacgggttaaccgtggctttgtgaagagcattctgaagtctaggcaaaagggccagggaaatactctgtctggtattgagggtttctccacctaccgggtgggcttcaggtaacagcgaaatactgtctcccttgggaattgtttcagatccctcgctcctccctgtggttagctctggaatgacagtatgaacttaaatgttttgttttccgattcaaattttatattcataactgaccttaataacaattttataattaggtataaaatttcaggattggagtgtatcctatagttcatctcatctgctttggctccctttttttttttttgagacagaatttcgctcttgttgcccaggctggaatgcaatggcgcgatctcggctcaccgcaacctccgcctcccaggttcgagcaattctcctgcctcagcctccctagtagttgggatcacaggcatgtgccaccacgcctggcttattttgtatttttagtagagacagggtttcttcatgtgggtcaggctggtgttgaactcctgacttaggtgatctgcctgcctcggtctcccaaagtgctaccaccacaggcatgaaccaccacaccctgcggctcccacattttatagctaagaaattgaggcccagaaaggttaggacactgttttggtggaaagaatttgtaggatcagatcgttgaagacactagacattgttaatcatctagtcaaagtatgcaagcattcaattcaccaccaacacagtataaggggggggtctccagcaggacgggcgggtttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggattacagacatgagccactgcgcccagccttatttagaaatttctttagtgaaagatgataaattttcagtttttcattatctgaacatgtttttatctagcctttgttctgaaaagatgcttggactcagtacccagttctagattgacagttaatttttcttaatttgtaaatgttgtttcattgattgacttccattgttgttcggaaaaatttatcatcagccatttctgacttttgatctgtgttttctctttggtttctctttttttttttctttttttttttttgagacggagtgtcgctctgttgcccaggctggagtgcagtggcgtgatctcagctcactgcaacctctgcctcctgggttcatgccattctcctgcctcagcttcccgagtagctgggattacaggcgcctgccaccatgcccggctaattttttgtattttcaatagagacagggtttcactatgttggccgggttggtctccaactcctgacctcttaatccgcccgcctcggcctcccaaagtgctggcattacaggcgtgagccaccatgcctggcccatcagttgatgtagtcttaaggggacaagagtacatttaatatttggttgtgaggttctctggaagtgacaaaactgctttctatggagagttaggaattttttttttttttgaaacggagtctcgcattgtcacccgggctggagtgtagtggcttgatctcggctcactgaaacttccgcctcttgggttcaagtgattctcctgcctcagccttccaaatagctgggattacaggagtctgccaccaggccagctaatttttttttgtatttttagtggagacaggatttcactatgttggccaggctggtctcaagactcctgacgttgtgatccacctgcctcggcctcccaaagtgctgggattacagatgtgagctaccgtgcccggccaggaattttttgtgctataaatcatattttccttttattaaaggcagtgtcaatatctatagtataattttgaggaggctggctatttattgctgtgtagaagctggcttattagtggtcaaggggtcatctagaattgactataaagatagtattgagcagaaaattcttaaaatacctgcatatttgtttcagtcattaaattaatggaaaaaatataaaaagaaatatcacaagtatgctatggggttctaccttagggcattgaaggttgaaaaacatttattttcttatcttcagattagcatctcatatcaatagccaatagcttaaagcgctttttacttactaaaccaggtcagaatttctctctctctctcttttttttttttagacagagtctctgtcacccagtctagagtgcagtggtgtgatctcggctcactggcctttctgtttaagtgattctccggcctcagcctcctgagtagctgggattacaggcatgtgccacgacacttggcttattttttgtatttttagtagagatggggtttctctgtgttggtcaggcaggtcttgaactcctgacctcaggtgatctgcccgcctccgcctcccaaagtgctgggattacagacgtgagctactgcgcctggccagaatttctttgtctagaatgtggttagcaacttttataaaaacgcattatttgcatttgattagcatgcagtacccattcacagttcaaagctagtatagaattatatcacatgtatgcccatgagcatggagaaactattttctttttatttttttaagttggagttttgctcttgttgcccaggctggagtgcaatggtgccatctcggctcactgcagcttctgcctcctgggttctagcaatttgcctaccccagcctcccaagtagctgggattacaggcactcgccaccatgcccagctaacttttttgtatttttagtagagaaggggttttcccatgctggcgagtctggtcttgaacttctggcctcaagtgatctgcccgcctcagcctcccaaagtgctggaattacaggcatgagccactgtgcccggcctttttattttttaaattatttatgtatttattttgagacaggatctcactcttgcccatgcttgagtggtaaggagtatgggatttcttgtgccggttccttcacatcctcactacacttatctgcctttacagtggctcgatcatagttcactgcatagccttctgggctcaaggggtcttccagcctcagcctaatataggcacatgccaccatgactggctaattttttttttttaagtttttttttgtagagatagggccttgcagtgttgcccaggctgaggaattttatttatgtttattttatttatttatttatttatttatttatttatttatttatttatttattgagatggagtcttacactgtcacccaggctggagtgcagttgcgcggtctcagctactgcaagctccgcctcccgggttcatgccattctcctgcctcagcctcccgcgtagctggactacaggcgcccgccaccacgcctggctaattttttgtgtgtgtttttagtagaggcggggtttcaccatgttagccaggatggtctcgattcctgacctcgtgatccacccacatcggcctcccaaagtgctgggattacaggtgtgagccaccatgcctggtctagaaattattttatattttataccattgccttataagttctcaagcaactggaaaatacaatcagaacgtattcctcaagatttcaaggatattttacacaaagttctattgtctgattccttagcagttgttactactgtttccctaacctctaatcttctattgggttattagtcttagaattgaattttgagaggtaagggcttgaatttgaacatagaaatttatacaggtctgatcagtagttcttgacattgtattatctggaaacaaatctttagaactgagcttaagatgtttaatgacattttgtagacagagtatgatttcagtgtagttgtttttgtttctttctagatctagttcagagatgaagtatatcaacttttttttcctttttgacccaatgctagcagaaaaacaacaccttttaatcatatttagtatttgaaaatgtgtatacaggttcctttttattttatttatttcttacaggttcctttttaatcagctttattgagatagagttcatatactgtatggttcataccacatatggttcatataccatacagtatatgaactcactttaagagtataattcagtgggtttaagggtataattcattcattttaagggtataattcagtggcttttagtatattttcttttttttcttctttttttcttttttcgagacagggtcttgctctgttacccaggctggagtgcagtgacgcagcctcagctcactgcaacctccacctcccaggttcaagcgaattctcttgcctcagcatcctgagtagctggaactacaggctcacgccaccacacccagctaatttttatattttcagtagaaacagggtttcaccatgttgcccaggctggtctcgaactcctggcctcaagtgatctgcctgcctcagcctcccaaagtgctgggattacaggcatgagccaccgtgcctgcctgttttgtagtgtattcaaacagagttgtacaactgtcaccacaatcagttttagaaccccaaaaagaaaccctgtactctttaccagtcactccctatcttccgtccactaacccctggcatccactaatttacatgacctctatgaatttgcctattctgaacattttataaatggaattctaaatacactaccttttatatctggatgcttttactaagcatgtgtatttttgaaattgactttaaagcttgttggcccctggaagagtaaattactctccaccccaagtattccctctacccctcagctttgcctgtaagtttctttttaaaaaaatcacacatacattgttgtagtagatttaagaataagtattttgctgacccaaggttcttttgcttctttctagatcagtgccttgcaggttttattttacagagcttaatagaatcagaaatctctttaaaactccagtctcatatccagttatcactcaccatctctgtgtttgcagcaatagccaggcctggcccagagggacttgatctccacttttggtttttagacttttctgtggcttttaccacctgctgtgtatccttgacctcatactgctggactcctttggatggataccagcaggatggttcaggctccagtgggcactttttaaaattctctccttctgttcagatagacagagctcaggcagatcaccaagtctgttgcctgtgtaaccaggaaagagatgctagttttcttttaggcactcccatttgtttctgttggaaccttcctcacttagttgatggaagggaagcaaaagacccagaactccatctcaaattaatgacttaacaattcttgaattttctcttatctcctagttaactctttttcttatctccaggaggtcagttttaattattgttgtttattcatttattttcatggagacagggtcttactgtgttgtccaggctggccttgaacccctggcctcaaggaatcttttcacctcagcctcccaaagtgctggaattacaggcatgagtcaccacacccagcctgatatttttcagttgatgtatcatagttgtgcctaagcataattttttaattttaattttttatttttggggacagggtctccctctgtcgcccaggctggagtgcagtgatgcgatctcagctcactgcaacctccaccttctgggttaaagcgattctcctgcctcagcctcccgagtagctgggactacaggtacccaccatcacacccggctaaattttttgtgtgtattttagtagagacgagatttcgctgtgttgcccagggcggtctcgaactcctgagctcaggcaatccgcctgcctcggcctcccaaagtgctgggattacaggcatgaaccaccacgcccggccaagcgtaatatttttaagggtcatcaatgttgtgtcatgaatcaatcagtgtttcgttcttttttatggttgaataatattccatggtatggatttgtcacattttgtttatccattcattagttgatagacattttggatttccactttttttttttttttttgctattataaatagtgatactatgtacaaatttttgtgtggaaatatgtcctcatatctcttggttatataccaaagagtggaagtgctgggtcatatggtaactacgtgtttaacattttgagaaactgctaaactgttttccaaagttgctgtaccgtcgtacattcctgccagcaatatatgaggatgccagttccttcacatgttcactacacttatccaccttttttataataactaatggtgggtgtgagatggtatctcattgtagttttgatttgtatttctctgatggctaaatggctaatgatgtttgaactttttgtttgagacagaatctcactctgtccagattcaagcgattctcctgcctcagcctccctagcagctgggattacaggcacatgccaccacacccagctaattttttgtatttctagtagagacagggcattaccatgttgttcaggctggtgtcgaactcctgacctcaaaggatccgcctccctgggcctcccaaagtgctggattacaggctagagccaccatgccaggccttatgtttgaacatcttttatgtgcttattggacatttgtgtatcttctttggagaaatgtctgttcaaagtctttgtccatttttaattggattgtctttttgtcttttgatgtgtaagagttctttatgtgttttggatacaagtttgttagatatatgatttgcaaatcttttctccaatttttgtggacttttgctttctttttttgttttgtttttgttgttgttgttgttgttgttgttttggtcgggggacagtcttgctctgaccacccaggctggaatggagtggcgcgatcttggttcactgcaacctctgcctcctgagttcaagctatcctgcttcagcctcccgagtagctgggacccaggtgtgtgccaccactcccagctaattttttatttttagtagagaccgggtttcaccatgttggccaggctggtcttgaactactgacctcaggtgatctgcctgcctcagcctcccaaagtgctgggattacagtcatgagccactacaccctgattctttttgctggctttctttctttttttttctttttttttttgagacggagtctcgctctgttgccaggctggagtgcagtggcatgatctcggctcactgcaacctctgcctcccgggttcaagccattctcctgcctcagcctcccgagtagctaggactataggcacatgccaccatgcgcagctaatttttgtatttttagtagagacggggtttcaccatgttggccaggatagtctcgatctcttgacctcgtgatccgtccgcctgggcctcccaaagtgctaggattacagacgtgagccaccacactcagcctctttttgctttcttgatggtgtcttttgaaacaaaagtttttacttttgataaagtccaatttgtctattttgtttgtttgtttttgttaagaagctttgcctaacccaaagtcacgagaattttctcttaggttttcttctaagagttttatagttttagctgtttctgtgatccattttgagtgaatttttgtgaatggtatgagggagtgatccaacttcattcttttgtgtgtggatatcaagttgtcccagcactatttgtttaaaccactgttcttttcccccattgaattatcttggcatcattgtcagagataaattgaccgtaaatgtgagggttttatttctgaactctcaagtccatttcattggtctacatgtccctatgccagtaatacactatcttggttactgtagctttttagtacgttttgaaatgtttttaaaatttgtttttcatctaaattttaggattaatttgtcaatttctgcacaaaaggcacctgggtttctataggggttatgcagaatctgtagatcaactgggggagtattacaggcatgagccaccgtgcctggctgactgagtttttcatagatgtactctatcaggtttaggaagttcccttttattcctaggttgttgagtctattttatattacttttttagagacagtcttgctctgtccctcaggctgtagcacagtggctcaatcatagctcactgcagccttgaactcctaggttcaagagatccgcctgcctcagccttcttagtagctgggattacatgcatgcaccaccatactgggctaattttttaaaattttttatagagacagggtcttattactatgttgcccagactggcattgagtctttttatcattaatgagcactgaattttgtcaagtgcctttataatacctattgtgatgatcatagggttttgttctttagtctaccgatacgctatattgcattaagtgatttttttgaatgttaaaccaaccttgcatttttttggtgtataagtcttatttgatcaatgtgtattatccttttatatggtgctggatttagtttgctactattttgttgaggatttttgtgtctatattcataagagatattggtctgtagtttcttgtgatgtctttgtctggttttagaatcagggtaatgctggcctcatagaatgaattgggaagtgttgtcttcttttctatgtgatgggagagtttgtgaatcattggtattaatttttctgtaaatgtttggtagaattcacaaataaaggcatctgagcctgggctcttctttgtgggaagtttttggctttttttttctttaaaaattttcattgtggctgggcatggtggctcacgcctgtaatcccagcactttggggggccaagacgggtgaatcacctgaggtcgggagtttgagaccagcctgagcaacgtggagaaaccccatctctactaaaaatacaaaattagctgggcatgatggtgcatgcatgtaatctcagctaattggaaggctgaggagggagaatcacttgaaccacggaggcagaggttgcagtgagcctagatcgtgccattgtactccagcctgggcaacaagagcaaaactctgtttcaagggaaacaaagttttcataacataaaaattaccatcttagtcatttcttttctttttttttttttgttggagacggagtcttgctctgtcacctatgctggagtgcaatgattgcagtcttggctcactgcaacctctgccacctgggctcaagagattctcctgcctcagcctcctgagtagctgggattacaggcatgcgccaccatgcccagttaatttttgtatttttagtagagacggggtttctccatgttgaccaggctggtctctaactcctcacctcaagtgatccgcccgcctcggcctcccaaagtgctgggattacaggcatgagccaccacgcccggccttaaaaatttttttaatgtacagttgagtagtatttaatacattcacattgttgtgtacccagtttccagaactcttcatcctacagaactgaaactccatacccattaaatgagtccccattctctttcccccagctcatggcaaacagcattctattttcagtctctatgaatttgattagtttagatacttcatactgtaagtggaatcatatggtatttgtcttttagtgactgcctaatttaaaaaaaatttttttgagacggagtcctgctctgtcgcccaggctggagtgcagtggcaccatctctgctcactgcaacctccacctcccaggttcaagtgattgtcctgcctcggcctcccacgtagctgggattacaggtgctcgccacaacacccggctaatttttgtatttttaggtagagactgggtttcaccatgttggccaggctggtctcgaactcctgacctcaaattatccacctgccttggcctcccaaagtgctgggattacaggcgtgagccactgtgcccagcctccatgttgtttttcacaacacctgtatcatttacatttccaccaacagtacacaagaatttcagtttctccacatccttgctagcagttgttattatctgtttttttttaatggtttcttttttcctttttctttttttttttttttgagacggtcttattcttgctcatgctggagtgcagtggtgcaatgtgatagctcactgcagcctcaacctctgggctcaagcagtcctgccacctcagcctccacataggtgggactgcaggtgtgcaccaccacttgtggctaatttaaaaaattttttcgtagagacagagtctcacagtgttacccaggctggtcttgaacttctgagcacaagtgatcctcccacctcagcctcccaaaataatgagattagagacatgagccaacatgcccaaccagttttgtttgtttgttttgttttgtgtttttgagacagagtctcactctattgcccaggctggagtgcagcggcatgatctcagctcactgcaacctccgcctcccaggttcaagtgattctcatgccccagcctcctgagaagctgggattacaggtgtaccaccacacccagttatttttgtatttttagtagacatggggttttgccatgttggccaggctggtcccgaactcctgacctcaagtgatctgctcccctcagcctcccaaggtgctagaattaagtttttctttctttctttctttctttttttttttttttttgagacagagtctcactctgtcacccaggcaggagtgcaatggcacggtcttggctcattgtaacctctgcctcccagattcaagtagtgattctcctgtctcagcctcccaagtagctgggattacaggcatgcaccaccacgcccagctaattttttgtatttttagtagaaacggggtttcaccatgttggtcaggctgatctcaaactcctgaccccaagtgatccacccgccttggcctcccaaagtgttgggattacaggcgtgagccactgtgcctggttttatttttattattattatttttaatagttcctattctaatgggtatgaggtagtgaggtgggtggttgtggtgtttttatgaatgtttaattggaaatgggtggccattgtgtgcaggaaaaacctcctaaattgtgtcaaactcctggaaaatgaaatatcattccagttgcaagaatatctttttttttttttttttttttttaagacagagtctcactctgtcaccaggcgggagtgcagtggcacgatctcggctcactgcaacctccgcctcctggtccgcctcccgggttcaagtgattcttctgccttagcctcccaagtagctgggactacaggcgcgtgccaccactcctggctaatttttttgtatttttagtagagatggggtttcaccatgttggccaggatggtctcaatctcttgacctagagatccgcctgcctcggcctcccaaagtggtgggattacaggggggtcaccgtgcccagccacaagaagatcttgagcatgtgaatgatcagaaatgatttagcctatgtaggcactaggccaggtagtgaaattcagggaaaataattcagatgcttctgagctatcacttatgaactaagaaacagcttaaagccattatagtgtgtttcctgaagatgaaagcatatggtaagatgaaatagtgattattttttaaaaattactactccagaaaggaaaagtttactaatttttattactaaagtttactgttggtgggtgcggtggctcacacctgtaatcccagcactttgggaggccgaggcaggcggatcacctgaggtcaggagttcgagaccagcctgaccaatatggtgaaaccccatctctgctaaaaataaaaaattaggccgggcgcggtggctcatgcctgtaatcccagcactttgggaggccgaggcaggtggatcacgaggtcaggagattgagaccatcctggctaacacggtgaaaccccgtctctgctaaaaatacaaaaatcagccgggcgtcttggcaggcacctgtagtcccaggtactcaggagttttgagacgggagaatggcgtgaacccggaaggcggagcttgaagtgagccgagattgcgccgcttcagtccagcctggacgacagagtgagactctgtctctaaaaaaataaataaataaaaataaaaaattagctgggtgtggtggcacgcacctgtactcccagctactcgggaggctgaggcaggagaattgcttgaacccgggagatggaggttgcggggagccaagattgcgccactgcactccagcctggcgacagagtgagactctttctcagaaaaaaatatgataattaaaagttgagacgttcttcgccgagagtggtcggggtttcctgcttcaacagtgcttggacggaacccggcgctcgtcctgcaccccggccggccgcccatagccagccctccgtcacctcttcaccatgccctcggactgccccaaggcccccgccgcagctccagcgccgcgtagccaccactgccgctgccgccgcctctccttagtcgccggcatgacgaccgcgtctacctcgcaggtgcgccagaactaccaccaagactcagaggccgccatcaaccgccagatcaacctggagctctacgcctcctccatttacctgtgcgtggcttactactttgacagcgatgatgtggctttgaagaactttgccaaatactttcttcaccaatctcatgaggagagggaacatgctgagaaattgatgaagctgtagaaccaacgaggtggccgaatcttccttcaggatatcaagaaaccagactgtgcggggagaatgcgatgggagagcgggctgaatgcgatggattacatttggaaaaaattgtgcattttgcattacatttggaaaaaaatgtgaatcagtcactactggaactgcacaaactggccactgacaaaaatgacccccatttgtgtgacttcattgagacacattacctgaatgaacaagtgaaggccatcaaagaattgggtgaccacgtgaccaacatgcacgagatgggagcgcccgaatctggcgtggcagaatacctctttgacaagcacaccctgggagacagtgataatgaaagctaagcctcaggctaatttccccatagccatagggtgacttaccttgtcaccaaggcagcgcatgtatgttggggtttcctttaccttttctataagttgttccaagacacccacttaagttctttgatttgtaccattccttcaaataaataaatttggtaccctccccccccccaaaaaaaaaatgtactgtgggctggcgtagtggctcatgcctaaatctcagcactttgggaggctgaggcgggaggatcacctgaggtcgggagtttgagaccagcctgggcaacatggtgaaaccccgtgtctactaaaaatataaaaactagccagtcatggtggcacacacctgtaatcccggctacttgggaggctgaggcatgagaatcacttgaacctgggctgcggaggttgtagtaagctgagatcatgccactgtactccagcctgggtgacagggagacattctctctctcaaaaaaaaaaaaaaaaaaaaaaaaacaaaacaaaccaacaaaacaaagtaatccaggaacaacaacatgatgaaggactgcatgcaggactcagtgatggatggtggaagacagccaggaagttaagcatgactctggtattaagtgttgtctgggagagttaagattccatttacagaaataagacctgtaggggaagctcttgatttttttttttttgcagactgctgatttcctgattacatgtgttaagtttgaggtatagagagaaagaacatcctggccgggtgcagtggctcacacccgtaatcccagcactttgggaggccaaggtgggcagatcacgaggtccaggagatcgagaccatcctggccaacatggtgaaaccccgtctctactaaaaatacaaaaattagctgggcgtggcggcgcgtgcctgttatcccagctactcaggaggctgaggcaggagaattgcttgaacccgagaggcagaggttgtgatgagccgagatcgcgccactgcactccaccctggcaacagagctagactctgtctcaaaaaaaaaaaaaagaaagaaaaaaagaacatcctgtagaaacaggcagtcagaggtatagaactacacagaatccaagagatctttcaagaaaagtgacatgcagcaagagaaactatcaagggggtaaacaacctatagaatgggagaaaatattcacaaagtatacatccaacaaaagtctaatatccaaaatctataaggaacctaacaagcaaaaagcaaataacccccttaaaaagtgggcaaaggacatgaacagatacttctcaaaagacgtacatgtggcccacaaacatgaaaaaacgcccatttctaatcatcagacaaatgcaaattagaaccacaaagagataccatctcacaccagtcagaacagcttttgttaaaatgtcaaaaaatgagaaacgttggtgaggctgcagaggaaagcagacacttgtacactgttggtgaaggtgtaaattaatttagcgtaggcacagtcagtttggagatttctcagagaactaagagtggaactaccattagacccagcaatctgatggctggatatacggccaaaggaaaataaatcattctgccaaaagaacatatgtacctgtatgttcattgtggcaccattcacaatagcaaaaacattgaatcaactcatgtgcccatcagtggcggactagaaaagaaaagaaaatatggtacatagccatcatggaatactatgcacccattaaaaataatgaaataatgtctttgcaacaacatgaatgtagctggagggcattatcctaagcaaactaacacagaaacagaaaaccaaatactgcgtgttctcacgcagtgagagtgggagctgaacatcaagtacacatggatgtaaagatggcaacaatagacatgggtctactagaggtggtggtgcggcagggtgggggtgggggttgtgtggcagaggaacagctgaaaaactacctatttgatactatacccagcacctgggaaacgggttcagtcataccccaaacctcagcatcacacagtatacctttctaacaaacttacacatgtattctgtgattctaaaataaacattgaaaaataaaaaaaaaactgacatggtttgtactgtttaatctgacataatggctaggggaaatgaagtctgcagaatggctgtttacggatgttgttgttgttgttgagatgaggtctcactatgttgcccaggcttgaactcctggcctcaagcagtcctcctgccttgacctcccaaaatgttgagattacatgcatgagccattgccaaaacggctatttggattgctgttaaggttattacattctctgtgtagtaagaccttgaaggagaaggatttgagatcaggagtttaagaaaaaatgttaatctaggaagagaggataatttctgtgtttggccagttgcaatggctcacgcctgtaatcccagcgttttgggaggccgagctgggcagatcacttgagctcaggagtttgagaagagcctgggcaacatggtgaagccccgtctctactgaaaatacaaaaattggctgggcgtggtggcaggtgcccactgtaatttcagccactcaggagactgaggcaggagaattgcttgaacctggaaagtggaggatatggtgagcctagatcgcgccactctactccagcctgggagactccatctcaaaaaaaaaagaaaacaagatgctgaaatgaagtaattaccacagtcaatgtgatcctataactttgttttcttttagagatggggtctccctctgtcacccaggctggagtgcagtggtgcatcatagctttctgcagcctccacctcctgggctcaggtggtcctcttgcctcagtgttccgagtagttaggactgactgcaggtgcatgctgctatgcctggctaactttaaaatttttttgtagaggcggggtcttgctatgttgcctaggctggtctccaactcctgatctcaatcagtcctcctgcctaccttcccagagcgctgggattacaggtgtgagccatcgcacctagccaatctcataacattttatgactagcaaacttagtagttctgattcaggcataaatcagttggtggggttatacaaggttgggtgagtttttctagatttctaagagaccatgttgaaatacttggctctgtctcagtaagggatagagagaagcaaaggtgtgggtaaaggttatgagcagacatgtaaagggggcaaattaaagtgtttagggaaggtgaaacagttccaaatcataatatagatcccaagcctcaccaagaagtgaaggagagggtaattgtgcgatagttctcaggactgagacctcaaggtgtaagacgaatctttattgtgggtggtcctctttgagaaaaagaacaaaaaagaaaaatgtgaaatgggtgctaaatttcagagcagaatatacatatatgtgtatgtgtgtgtgtatatatatatatatttttatgtagcaaattccagtttacaaagggcttttatgtgttttgcatcattacaacagttctgtgatgatgtggatgtggtggatattgtaattccacatcacagaggataaaattgaggcacaccataaggtagctgaccagagatcatgcagtatatggtagaatggcaacttgaggccagttcttaggtgtgtttgttgtccttattcagaatggaacaatgtggtttattgtacaaaaatttaaaaatgaatgtcgaaaagtagaaattattacccaaatctcaccctctgtggttgtttgctatgtgatcttccagactcacatatacatgtagataattttttttttttttttttgagacggagtcttgctctgtcgccctggctggagtgcagtggcgcaatctcggctcactgcaggctctgcctcctgggttcacgccattctcctgcctcagcctcccaagtagctgggactacaggcgcccaccatcacctccagctaattttttgtatttttagtagagacggggtttcaccatgttagccaggatggtctcgatctcctgacctcatgatccgcctgcctgggcctcccaaagtgctgggattacaggagtgagccactgtggccgtcctcacatgtagatacttttttaactttttgcttttaaccacttaagatattgtgaactcatttccaaattaacatatatttgcttttaacagctacatttccactggagttacgtaccatttgtaatctattcctggaaatttagatggttacaactgttttttattttatttatttatttatttagagacggagtctgactctgtcacccaggctggagcgcagtggtgtgatacttggctcactgcaacttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgggagaccgaggcgggtggatcccgaggatcaggagatcgagaccattctggctaacaaggtgaaaccccgtctctactaaaaatacaaaaaattagccgggtgtggtggtgggtgcctgtagtcccagctacttgggaggctgaggcaggagaatggcgtgaacctgggaggcgaagcttgcagtgagcagagatcgcaccactgccctccaggctgggcgacagagcgagactccgtctcaaaaaataataataaataaataaataaataaagctgtgtacagcctggccaacactttgggaggccgaggcaggcagatcacaaggtcaggagttcgagaccagcctgaccaacatggtgaaaccccatctctactaaaaatacaaaagttagccgggcatggtggcacatgcctgtaatctcagctattcagcaggcggaggcaggagaatcgcttgaacccacgaggcggaggttgcagtgagccaagatcgcgccactgcactccagcttgggtgacagggcgagactctgtctcaaaaaaaaaaagaagaaaaaatcctttattctggttttcccgtagcttccacagatccaaaagggtcaggtttatttccagtagccaaatattctgccatctggactgagatatctcctaggttgaggttattatagaggtagtaacctgattctttcttccttttctccttcccctttcctcctttgcctccctcctcttttcttcctctgtatttattttatcattccttcttcctttcttatttctaggccatataggccagccagggaaaggttagtaaggggtgacattgatccctatgacctgaggaatattcttcgaccttgagacatgccgattatgctcttcttttcctaggatgctcacaactgtattcctgagctggacagtgagacagccatgttttctgtctacgatggacatggaggtaactttaacagatcatattggtaacattctaggaccccaattccagacgttccagggcaagaacaggtccctttgttcatttactttccagggtctggccctcattatcatttcctgcgtggtgctgtttttctgtattctgtcattcttttttcccagtaggtactgtattggtttataatctcaccaggacttgttttaatccaaagagcctctatctttttttatttttattttttaaaatttttaggctgggcacgcggtaggtcacacctgtaatcccggcacagtggatcacgaggtcaggagttcgagaccagcctgaccaatatggtgaaaccccatctctactaaaaatacaaaaattagctgggcgtagtggtgggcgcctgtggtcccagctgctcggaaggctgaggcaggagaatcgcttgaacctgggaggtggaggttgcagtgagccaagaccatgccactgcactccagcctgggcaacagagcaagactcttgtcttaaaaaacaaaaaagtgtacccagttgagctgattctttatctttttttcactggagaactaagtatacaggtgagaaaagacgagatatttatacccgagagaattgatggtgaaatccatttttttggatcagaacttccccaaacagtgtccttcaaatagggttcaggggtgctaagatatttatcccctcaacccttggggttcactccagtatggcatataaatattgtatcactttctatgtgtggggagcagtgctccaggtgaccttccttcctttccttctaggggaggaagttgccttgtactgtgccaaatatcttcctgatatcatcaaagatcagaaggcctacaaggaaggcaagctacagaaggtctgtctgcttacaccgcccattcctcacttgtgtaggcttttcccttgttctctagcccttgggcttttcctttctttttgtcctctagctgctgctgcttatttactcttgaagaattctgttcctaaaacgagcttattggccgccttttagacttgccttattattcctaggcctctgagctgtttttatctgtgagtgtctcttagtgtggtggctcacactcttaatttgtattccatccttgtgctcaggattgtatatagggagttcattttgtactagtcttagactattttgcttatattcaggctttagaagatgccttcttggctattgacgccaaattgaccactgaagaagtcattaaagagctggcacagattgcagggcgacccactgaggatgaagatgaaaaagaaaaagtagctgatgaagatgatggtgagtgtggcatcccttgtttgaggggaaatcagcattttaagaaatattctttaatattacttatcaattctaagataggatggctttctagggacctggggagtccttatgttaaagaaacctatgatgttctcctgcattgtatgtggttatgaaaaggagggagagaattatcttcgttgagtggcatctgagctgtaagcattgtatatacattatcttttgtcattgtgatggggtcttcctggttcctgctagtatttatgtgcttttttttcccctcaagactggagcagttattagccccaatagccaatcattaagcctaaatcctaattcacagtagcattgtgggcttcctggatcctcagccagaatagggtttttacaacttaacaataaaaaatgagacgtcagaggggaagtatagtaactagtgttgttttgattaagaaggggatgaaacacaaaaaccaaaagaagtctgtggaggaggaggagctagggcatgttcttctgagacttgagcgagaggaaccttgggagtgggaggttgtggggaagttagaggctgcaagggctgttgaggtagtgagagggacggatcccatgaggagtctggcatgggggctctgatttagcctcttccctgcagtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggtaagggcctgtgagggcaggcagatgctgaagttgcagagaggtcctgtttggttgccgtctgtagttttcaactctctttccttctcctattttgacatcatcccccaagacccactgtattctaagctttagtcttgaattcattgagctccatcatcacaggtaccatttgcctttttacctcttcctttgttggtactataacaagcagatctagttctggcttttcagagtctgtctcctagagagagaacaaggagatagttgttaccttggctagttgactgttttcttctctggaaaatttattttctggccacagtgcctgaaagatatttttggctggcagcccttgccttgtcctgggctttttgctagtgactgctaagcccagttcaggatgtcagttgtactcatgctagccctttccatccccccaattttcatgaccatatacttgtatctttcagtgttttgaggacctgtgttcagtcaggacctcttgattctgagtatgagctgtggggagggaggggatcatcccagtctcagcagtctgggatcctccccctggcaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggaggtgtgtggggaaggggagcaatgagtcttgaaaagccacaaggcaggtgtgaatcccctaattttgattttgagacaggggatccccctgatactttaggatggaagtaatagtcatggggatttattctgcaaggggaatgagatggtaagcctttggggttgaattatctaaaaacaagggagagggagtgtgctgctgtctctagaaagatgaaatgtgtgcttctcctgtttgttaaagctcttttgggggtcccagtgaaagcaagcataggtgaacgatcaggagcacatcagtgaggaacgcatgttcagaagcccccatgatgctccttttcttcctcttaagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggtaagggccaagaaactgggaaagacttctagggtctttctctctgtcccagactacctagtagcaaactttaatcttcctagtgcttgtgcctttcaaagcactttaatatctactacctctgttcttatattcctgtgaaataactaagatgggtagaggtatcattatacataggtatcattatacccatcttatgtaacatttgaatgatgaaaaagacctgtgagtgccgggcgtggtggctcatgcctgtaatcccagcactttgggaggctgaggctggtggatcgcctgaggtcaggagttcgaggccagcctggccaacatggtgaaaccccatctctactaaaaaaaaaaaaaaatacaaaaattagctgggcatggtagtgcaagcctgtaatcccagctactcaggaggctgaggcaggagaaccgcttgaatccgggaggcggaggttgtagtgagccgagatcgtgccattacactccagcctgggctacaagagtgaaactccgtctcaaaaaaaaaaaaacaaaaaagacttaaaataaaaagaccagtgagtgactttcttaaggttcagcagtctggtggcagggttgaaactagaaaaactaggacttaggactcagttccccattccactagattatggaactttgtaaagaagggaaatgaatggcaaggtttgacctgccacaaacacaagtctgtgggaagtatccaaactgctcatcaaccattcctttactccaggggaccacttctataagagaaacaagaacctgccacctgaggaacagatgatttcagcccttcctgacatcaaggtgctgactctcactgacgaccatgaattcatggtcattgcctgtgatggcatctggtgagcactggcagaatgccctaaattcccctttctgcagcatgtcttctcttataggactcagggcacctctaggattagagcctaggcagacctaggcctcttggtgggtgaagagcacccagactaaggcagagctgagaatttctgtagttatttacactggcctgggccaccacctctgtccatactcctctacgctgccttagtgagactggaagattctgactgttgttcttgaccccaggaatgtgatgagcagccaggaagttgtagatttcattcaatcaaagatcagccagcgtgatgaaaatggggagcttcggttattgtcatccattgtggaagaggtgagtaccagggtggagaagagagggtgtctggtctgcacagccagggttcactcttttaatctgagctaagtcggcaatctgggagcattatcagtaattgctgacagacgctaaaccccgactccaaagttccaccttctgtcatttccctgacttagccttatgccttatggactagcaggtgggccgttgtgtgatacctcttgcccattcctctcctaccaccctgactcagcaagccagccctcttgtgggactgtagattcctggcaaggtgttcaaaccctgtggctgagctacccccatccctttcttagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgcgcggccgcttcccacggactacgcgtcccgtgcgtctctgcggcggcggaagcggaagcgagtacggaggtaccagctggtctccgtaggggggtagggggctccatgaatggaagcggcggcggcggcgggagcggcctgagctgggcgccggggccagggccgggggctgcccagggcccgcgccgctgcatgggggcggcccgcgggccctgagaggaagggcagacaggcgggccgagataggaggggcggggtcgggcggccgcaggccggaggcgcgtcgggctggagccggtcacgatgccccgaaggaagcaaagccacccgcagcccgtgaaatgcgagggggtcaaaggtcaggggtcaggggccttgaggggagaggagcgggggtggggtcagtggagtgggctcaggtcagggtggagggggactcctgagggatgaagtgggcgatccagactcctagcttcccaccgaggcactaagggaatcagagtgggtcagcgagtacgggaagtgtggtccacgagggctggttcctgagggagaatccacaagccccctcccctcttcagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggtgggttttcgggtcttggttaaggattagcggccgctggagaccccagcccttcaggaggcaggttaggtgaacagaacaccatttcctgccacaaccgagggctggtttagtttacatttgagctagatgacttcatttgtttaatggtccaatcacttccatcactttgttgaggtgaagttctgaggcctggtcaaaggtgataggaataggagggtgggtgaatcacatggagcaactgattaaaagtaaatgccctgtctctctccctagcccattccttatgtgtatttacttttaagagaggttcagggaagcaaactctctgtaaatcattcaacccagtatttaggtctaatctaactccctttcacctgcagcgtaagctccttttgtattgagaggttttagtttctgtctttatccttccatgtccctcttccctgtgatcttagcatcaccctaccctaatttgctgcactacccatccacttatgcaagatgttttttgaaagtcattgaggggatccatgtaaatatctgttctttaggcaggcaagtggtattacatgcattactttcattgtctccacttccctccaaattttgcctcagagataggttttattttatatcagctccttactaaaaggggccttagcaatagagcttagaaaaaggtcttgggggctctctccctttcgtatttttactttcttgtctcaagaattaatttcattatggattcatttcagtctg

SEQ ID NO: 12137 - DNA, 53789 bp, Human
  misc_feature (1)...(53789): n = A,T,C or G
aagtggtataactctacaagctgctatattcaagtcctagttccagcttagccaaaacacctactccgattgcaactgatctttttcttggttgctagaaaactgagagtcatatgtgtagcctacctccagcaaaccaataggaccttacaccatgcattttgcatacaaaactgctggcttaatcttatctttcacactcacggttttcttttgtcctatttttctctgtacttatttttaatttaccctgatgtacacatttatgtaaactacgttaaatcctttcctctggaataaagtagggtgtaaataaatttaacaaaacaacaaagagtgatgatgagccaggtcttcactcctgaaggcctcaaaacgaactggcagtgatctgtgaaaactacagagaactgcccgttcatctccacagattactgaagtctgtgaaaactactccagccaggaccaccattatagcctgctgcctgttgtgttcacaatcgatgcacaaactcaaccctgaaatggagagaaaaatagggggaaaaagacattaggaaatcctagctctatgtcatctggacattagaaagcacttggttggacaaagctttttctcccccacagcacatgcctgtttcagcatctcagcccacattcacggagagggagaatatagcaattgttaagaatgcagactctagcactgcatgctctgctgtttatttgtgttatttgggctaggttttttaaccgtctgtgcctcggtgaatcccatctacaaagtagagataataatagtacctacctcacagggcagttgtaaggattaaatgaggtaacccgggtgtaacatttaaaacagtggcagagtacatacagggatctgaacaaatgttagctactattagtgatatgtgagtgggggaagcacactgccttggacttgaggcaatatcaagtctgagtttctggaaaaacacttgtggaataagtaagggctggccacctcctaaaaccggacaaaagatctggcttgcctagatccttagcgtgactgcttctcctcctgcctttctagaggcagtattacgtgatggaaatacttggtgggtgctgtgggcacaaagataagttaatgtgtttttatcccctaggagctgagtcgagagtaggagaaaaatgcataaataattaccaggtaggatgattaagcaatatactggaggcagcaacagaaacacaccgtggaaaaaaaatacccacggcgtggatgaagatatgagatgtgtgaaagcgctagacacaggcagccacctgcacccatgtaaaattggattattgctgactcctacaaggcccactttaacgcttctttcaaccagaatccctgcagaactaattttttagaaccgccggggataaagacctttatttgcaatgtcgaactccagcagagtaaccccttttgctttccacacgcgcaaacccgggtcccaaacgctgcagttcgcgtttcccggctaacggaagaaacacgaggaactgtttgcagatctaggggatgaagccaaaaaacggaaagcgaggccgaaagggcgcaaccaccacgtctggaggaggccagtgaagtagagaaaggggaaggtcagccctgccccagcgcgctctgcgtaaccgggacttcctccgcgcggcaaagccggggaacctccctggcgcctgcgccaccgcggcgagactcggcgccgtggacgtggagagagggcgacgcacctgcgcgaagacggcagcgggagaagccgctccagtgcggttgcgcggcggcccaggcgtcgaggggagcctcggcggggagcgcaccgcgcgcctgcgcggagagctgcgtgacgcggcggcgcgcaagggacgtgcggagtgagtggcgctgcgggtggggccgtcggcggcgctggtgagctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggagggtgagtgcgcgcctggccgcgggacagagggaggtcgggcaccgccgccgacccctgcgtccccctctgccgccggaacgcgaggggacccctttcccgccccgagacgagtctctgggagcgcggcgcggcggacgaaccgaggagggggcgaggaggctctgggcgcgggggagcggcctctgggagcgcggtcaggggagatcgggggagagggggccgttcccgcggaccctcgggggccaggcccgccggccgaaggctgtgcggagcgggtctgcgggagacagcctttcggaaaggccgccgggctccgcgcgccgtggtgctcgcctccggtgacccgaggatggggagaggatgcctgccactgggctttgtgcgtccgtggaatcactgttcttctctgttctctttgtgcattgcccttggctgcctccgattgtcgttccgggagtgaattttacgtatatatatataaacctgtccttaacaggactgcttcgtctgctctgcatttttacacaatgctatatagaatggattcttcttaaagagaggataaaattagcgggaattaatctaccgtttgttacttggcctaaaaaaattgtaagacaagatatttgatcaggttgaagatgcacgtaagaaatgtgatgtatgtagatgggtttgctgaagggattggcttttgcatttgatttgagcagagcttaatttctgcacaaacttagtgaaaatctatttttaaagcctgtcttgtattcgaaaggtatttgtaggtctacgcagcatttgaactttccgggctcaagtgttcttattgaatagttttatgttggtgggaaggcaaggggggaaaacgaagaggtggactagccgggagttaaatgtattgattcattgcaggatattattcaaagttaaatgcagtcttctgccaaacagtccctctaccctaaagttttcgtcatcaataattgttttgtgagtgtgtagaaaagcctttaatcctttttaaacaatttagaggcctcctttgttagccgccgtccagcgattgcatatgtactgtttgctttcaaattaccttaagataattgctagagtgaagcagtatgtacttatatttggaaaatcatcaaagaatattgtaatgggggaggggtaattcctttttctcaaagtatgtgtcggtatctcaaacccaagttctgtgagtacctgttctgtaactaaatactgtgtatttgctccagatgtgaaagccatccagcagtcttaagactgaataggaagcaaaagttttaccaggaactcttatttaccttttcctttactatcaagttattcctggggggccccctggtgcctgcagtcagtgttcactacctaagactttgtttcagatgtgaacatcttgctgggtctttgagaaatttgctttgaaaataattgtattttgtaactgttttatgagggaaatacagttaatttaaaaatgtgtatgtcttgtttacatttgggaagtagaggcctactcctttttattttttttttatttttattttttgagacggagtctcactctgtcgcccaggctggagtgcaatggcacggtctcagctcactgcaacctccgcctcccgggttcgagcgattcttccgcctcagcctcctgagtagctgggattacaggcaccccgccatcatgcccggctaattttttttgtatttttgtagagacggaggtttcaccatcttggcctggctggtcttgaactcctgacctcgtgatccacccgcttcagcctcccaaagggctgggattacaggcgtgagccatcgcgcccggcatatttttatatattttaaactttgcttgtaaatttaaatattttaaaaatatgtttgtatctcaatttatttatattttatttcattttccatatattttgtaggcataaaacagatttatgttttaaaatgtttgtatccttttaaattagacgcacctttatatgattacaggtacttaaacttcacgagtgggttgtgcaaggttactagaaaagacactgggggaaaaataagtgattccatttgtttttgtgaattcaaattaaatatttggtttgtacaatctgttttccttttttgggggggcggggggggcgggtaagaattgtagtccagacacgtttctctcttaatttagcaagcgttagcaagttgacctcctccttgccaggcaccagcaatcctaagataagacacagtctcttcactcaaggagctcccagtctaaacaagtgtctttcaggctttttcagcctcctctctgtcctatgttcagcacacattctatcagtacttcttcatcctacagaagcatatttagtttgacagtgcccccaagggattcttaaatattctaggtttttcagctccttcccagatccagacctgttgaaagacttgtccagagcagacttgaattttctagtaaataattatttttaatcttcaaagaaaattttgtccacctggattttcagtgatattagatgctagttagtgatattttgtaaagctgcctagcaagaataactatggttagtgtttttagtgtcaaatgaacgtgtaagtaaaaatttggcaagaatttctctgcattaggggaaaacattcagcaggacctgatctcattttaaaatgctgattgtagccccacaacatattcctgattgttttttcttttttactgtattaaatcgcagatcagctatacacacttctggtgactacattttatgagttgctttttgtttttcttttttaggtgggcgtattattgataagttttttttgttttttgtttttttgagacggagttttgcgcttgtcacccaggctggagtgcggtggggtgatgttggctcactgcaacctctgcccctgcaggtccaagcgattattctgcctcagcttcccaagtagctgggactacagcatgccaccacgccctggctaattttgtatttttagtagtttcaccatgttggcctggctggtctcgaactttccatcctcaagtgatccacccgcctcggcctcccaaagtgctgggattacaggcatgtgccaccgcgcctgaccttgatatgatattttcaaagagtcctttaggtcattttaatacaaacatgccatttaatgtaaaacagaaatattgattttattatttggacggtgcatattctttcggtatgttttcttggattaacttttgcttagaactaaaaaccaaagacttctactttatcccctgtagtgaccctgttggccacattcttgtggcttaccatagtgttttgatcatttaaattgaagctagtttgtatgagtattctggaaaatccggtaaaagcttcttacttagatgagtggttctcaaagaggggtgggaaatgggagtatagcagaatcatctggggaacttcattcaaactataagtgctaagtttattttggaggaagtgaagtggaatgagtagaatctaatgcatttgggaggaggttagtatggaaaactgctgctgggtgaataagagtgccagctctgttcccaaccacagtcttgatccaggtatttaaaaactgggatgtgccagttgatatagtatgtctattatgtgtcatatatgtgataatatgaaactgtttagaatttgctttttcctgattatgaaagggcagcattctttcaagaagtcccctgtaattccacaatccagagataaccgttgttgaaattttgatatatttttgtttaaagatacttaacatactttgtaaaattcacatgctttacatcattagaatattctttacatagctttatgagttaatttttcatgtagtattacatcatgaacattttcccttgtcattgaaatgtcttcaaaaataccgaaaagcgatttgctgtgtgatagaaaagtttttcttaaagtattttttaacatattaccacgaagctgaacttgactattacaatatgagttgtagaatattagcactgtgtaaagttccatagcaaaatgtgattgtgttacatttttggcccacttacagttttatgaaaatcgtgggatgtgtttgtacctgttttgttttttaaattcatttttcatttaactttgacctgtcagatgtctgaatttgtgacactgcttgtgatctcttagtgcgtatctcccttttctttcttgtgaaacaggtatagtactcttaagatttagttaggctgacagactacacttttaacttttcctattcaagacaggctggaatgcagtggcttgatcatggctcactgcagcctcgacttcctggtctcaatcgatccttctgcctcaacctccctagtggatgggaccacaggcacatgacaccttggctggctaattttttttattttggtagagacggggtctccctatgttggttgcccagtctggtcttgaacccttgtgctcaagcaatcctccagccttggcttcccaaagtgttgggattacaggtgcgaggtgctgcgcccagcctgtagtgtccttttgaaggttaaaaaaatgaatggatttgaaaaatgaaatcgattaatgaaagcatattaaagccctccattttaaaatgacagctttatccagatataattcacataccatacagtttgcctatttagaggatatgatttttagtatactatagagttgtgcagccatcaccacagtgaactgtataatattttcaaacacatataccccccaaaaaaccctgttcccggtagcagacaccccatttctctccattccctcccggcccccactaatctacttttttttgtctcttagatttgcctattctggacgtttcatgcaagtgaaatcatacaatatgttgtcttttgtgactggtttcttttaatgtttttaacattcatctttgttgtagtatgtatcagtactttattccttttatggctgaataatattccattgtatgtatacaccacatttttaattcattcatcagttgatggacattttgttttctttcggctattgtgaatacttgtagtgctgctatcaacatttgtgtagaagtttttttttgtgggcatatactttcaattccgttgggtatatagctgggagtgagatttctaggtcatatggtagccctatgtttaactttttgatgagctgccaggttgtttaaggcctctttactgattaaattgtttaattctgacccagcaacctaaaggttaggtggttggaaagaagtgtcagttgttgccgacaacctccacttctgtagggaaggtgttttgtgtggatgtgcagctagacttgttagaaaaaagagcatgttggggagtgggggagatcacccgaggaatattttatctccttgattcttctggatgagatactagaggagacataaggtcgtggcatattttttaactgattcagagattaggtgtttgttttctctgaattaagttcagcaagtaagggaaactgacagtttgaagaagtagcccagaggtgtttttattttgctatctgaatgcagacctggagcttttctggtaaatatctaaatccaagatgaagattcgttgggatttaatacattatttaaattgagtctagagacaaagccacattaagagtcaggattagtggggaagatagttgcatctagtaggtctttttcttccttattctccacgtttattacttttaaaagagtatacattccaatgccatgcatttttaattttttttaattaattttttttttttttggaggcagggtctggctctgtcacccggttggagtgcagtggcatgaacatggctcacctgcagcctcaaccttctgggctcaagtgatccttctacctcagcctcacaagtagctgggaccacaggcatgcaccactaattaaaaaaaattggtagacacagaatcttactttgttgcccaggccagtctcagagttctgggattacaggcacccagccccattttcaaacatttctaacaggtaaagtaatacaggtatgaaggaatgttaagattcttagaaatactgacttaaattctgttatgtatttctgaaaggttattctcgaatgttggtggcatatagggaggcaaggggaagaaatagtttgtaaatgtcagtaggtttagcagtggtgtggtagatggggattcccagtggagtcttctaggatttgtgattggatacagattgatacccttaggcagcagccactgcttctagcagctttaaatagccatttcaaggcttattcaagtataaataaccagtagccagttttttcctgatttgatagaggaagtcagtccttggtctagatgggtacttgtcatacagtaggaaaaagggcgggggcagttgtcctttattctgcctctgcactattcacatgtggagcacagtgatttgtgagagtatgtataaccttcgtgaacatcactggcctcagaaccctcccttgccaaatttacctgcatctgtgcaaagacaagtggagatattgatgatatgtgcatatcccagagggaatagcgtttgctttttgatgcatgcccacccttgcataattgggaggttttaacatagcatatttcaccataaaggaattttattctaagaatgttaatcagaatatccctaagtaacagaagttcccatctggtcagttgcaaggtgaccaaaacactttcttggtttgagtatagtcatatgttctgtcaaatgatgttttggtcaacagtggacttcatgtaaggtagttagtggtcctgtaagattagaatggaactgaaaaattcctgtcacttagtgacatcataggcataatgtcatagtgcagtgcattactcttgtttgtggtagtgctggtgtaaacctattgcactgccagttgtgtaaaagtacaacaggccacgcgtggtggctcatgcctgtagtcccagcactttgggaggccaaggcaggtggaccacttgaggtcaggagttcgagaccagcctggccaacatggtgaaaccccatctctactaaaaatacaaaaattagctgggcttggtggcatgcatatgcctgtaatcccagttactcaggaggctgaggcaggagaatcacttgaacctgggaggtggaggttgcagtgagcaaagattgcaccactgctctccagcctgggcgaaagagtgagactgcatctccaaaaaaaaaaaaaaaagtataacacaattatatagagtacataatacttgataatgggaataaacagctatgttatatatttaccttttttttttnnnnnnnnnnnnnnnnnnnntgcagtgacgcgatctcagttcaccacaacctctgcctctcaggttcaagtgattctcctgcctcagcctcctgagtagctgggattataggcatgcaccaccacacctggctaattttttgtatttttagtagagacggggtttcaccgtgttagccaggatggtattgatctcccgacctcaggtgatccgcctgcctcggcctcccaaagtgttgggattacaggcttgagtcactacgcagggccctggaatatattcttattttaaaaaactagttaacttaaaaccgactcaggcatgtccttcaggtggcattccaggaaaaaaagcttcgttatcctgggaggtgatggctccatgcatgttactgcccctgaagaccttccagtgaagatgtggaggcggaatatagtgttactgatgatcctgactctgtaggcctaggctaatgtgtgtgtatatggcttagtttttaacaaaagtttaaaaagtgaaaaatatttttaaaaataggaaaaggcttaataggataaggatataaagaaaatattgtacagctgtatgatatgcttttgttttaagctaatcgttactagaaaattcaaaatgtttaaaaatttttttaagtttccaaagtaaaaaatgttaagtaagcaaaggttaatttattcttgaagaaagaaaaatatttttatctttattactgtatatacattgtgccttttctgtgtttagatatgtttagatatacaagcacattgtgttacagtagcctgcagtattcagtacagtaacatactgtgcatcatgctttgtagcctaagagcaatagactataccatctaggtttgtgtaagtccactctgtgatgtttgcacaacaacaaaatcacctcactgtgcatctctcaggaagtttccctttggtaaatgatgcataactggacttgtctgacaccattttaaccttccccctagtcctacctctcattctcaagatttggagaaatcaaaatctaagttttcataataaaaggttaggtatattgggtgttacatagctttcactaatgtcatatctagcagttgtaatcacgtattttaaaactttaaatagtaaattaagaaggaatctttataggtacttgtatgtttcctcaatgtggtttgaattgagcgttttatttaaattactatcaaatacttgagccaaactagcgagacaaaaagaccagaccttttcttttttccgagatggagtctcacactgttgtccaggctggagtgcagtggtgcagtctcggctcactgcagcctccgcctcctgggttctagcgattctcctgcctcagcctcctgagtagctgggattacaggcgcctgccaccatgcccagctaattttctgtatttttagtagtagagatgggatttcactaaatctcgaacacctgacctcgtgatttgcccaccttggcctcccaaattgctgggattactggggtgagccaccgcgcccggccgagaccagacttctgagggggagaaacttgcaaacctgtcagtgagaaagagtgaggtctgattttagatgacagaaaggaatagcttttgtgaatttcggactcccaactactagaattatgtgaatcctgaatgataatcagatgtttactcagttaagtgtttactcaaatattaataagtattgatacattgggatgccatcttatataatgattaacgacacagattctgggtgtatttcagccccagtttcttctgcatatatgatagtaagtgccttcaaacaattcttgacacattaaaggtcagaaaatgttagccgtcattattgcttagtacaaacctgagctaggaaatactaacagagagctctttgtgccactgagtcctggaacttccccatactaattttgagaaggctttcttgtaagtatgtgacagatactgtttcctccactttctgtttattgcatataaccactattcttgtatgtaagtacgtataacagtttctttactattcccattattcagcgtttataatctggtttgacatatcagtgttggtgctgagagggaaaggtatttctaggtaggataaaatggtgaaaagtgatttaacactgttgtatgcttgcttttggccaggaactatagggcagtgtatcttaaactttgagtcttgagaccctcttacactcaaattctccatatatgtaaagaattgaaaacgagcttttatttatgtgaggtatttaacaatattgcattagaagttaaaactgagaatttaaaaatttctgttctcggccgggcatggtagctcacacgtgtaatctcagcactttgggaggccgaggcgggtggaattgcttgaggccaggagttcaagaccagcctgggcaacatggtgaaaccccatctcctaaaaatataaaaaagttagctgggcgtgatgtcacatgcctgtattcccagctacttgggaggctgaggcacaagaattgcttgaatctgggaggcagaggttgcagtgagctgagattgcgccactgcactccagcctgggcgacagagtgagactgtgtctctaaataaataaataaatatctgttctttaagtagcaacatattacattttagcataaatgttttttatgaagataacttttctaaagcaaaaatgtgagaagtgccatcattttatgcaaatctaatgtctttttaacagaagacagctgaattcacatctctgttttgtttcagtcttttgataccttgttttagttgaatatgaagaaagtctgtagtcctacagatacgtagttagaaaaaggaggagtagtttaatagctgttctagataattgtgggtattctctgatgtttataccaaaaatcagcaagtggtggttttttaaaggtgaattttaaaagagatgtggaatctgaaattatatccatgaatttttatgttctcttacattaaaatccattgatctttcttgtactttaaatggatcttacacatgactttataatacgcgttgttcatttggataatattgattcagctgagttatgcagatgtccagatgttgaaacagcttattatgtaatacagtatccagaaatgacatttgttaatgttacaagatctcatcagaagagtccttaattatggagaagctgtcagattcatggtgctgattacaaggtttctagaattttagtttgtaacttgaaagcttgaattttatcattggcaacaagtactgtcagttgttttccttgaaatgacagggtcactttgttcatgttcacgtgtatctgttgaatatctaagtctgaataaccatagtttgtcagttaatactttccagtaaaagtgtttagtgaaaaaaagtgtctaggtctgcttggaactaaaacagtcacaggagtgctttcctttgcgacaaccattgtactttgggatggagcaggagtgctttgtgggcatttccattttatcatgtagattattaaagagatgtattcaaagattgaagtttaataaaattgatcatttgtactgctttaccaaagggcatacatgaagctgccttttttgtgtttcactgcatgtgtgttgcaatgaacaacacagtgactgactaccagtggggtttggtgccactgacttggtgtgtactgagacacttaacagttttacccatccttgcttttgtattatcaaagcagatgtcagtgcagtggaaaaaaaaaaagtcctttattcctgaaatgtctagccctcacctatatctgtcacttttcttcttcactcttttctcattatacttgctatttgtttaccaatgtacctgaaatgactttttacttatgctttgtgaattcatgaaagccatgggccttctcagaaaaatatttttacatatacacaatattacagacaatttgtggtactatacagagccactaaaggccattttggtctctgaatccacgttagttattcttttgttttgagacggagtctcactttgtcacccaggctggagtgcagtggcaccatctcagctcactgcaacctctgcctcccgggttgaagcgattctcctgcctcagcctcccgagtaatctgggattacaggtgcgcgccaccacacctggcttattttcgtatttttagtagagacggggtttcagcatgttggtcaggctggtcttgaactgacctcctgatccgcccaccttagcctcccagaatgctgggattacaggcatgagccaccatgcccggcccacattaattattgttaacaggcagtcctaagatgagagggaagtacagcagctgcctaattttttttcacttaaaaccgtgtgtgtgttgtgtgcatagagaaagatggggaggaaaggaagacagagtgggagagggagaagaaaagcaagagagaaagaatgaaaaagcaaagggggctggacgtggtggctcacgcctgtaatcccagcactttgggaggccgaggcaggcggatcacgaggtcaggagatcgagaccatcctagctaacatgctgaaatcccgtctctacttaaaatacaaaaaattagctgggcatagtagcacccacctataatcccagctactcgggaggctgaggcaggagaatggcgtgaacccgggaggcagagcttgcagtgagctgagattgtgccactgcactcgagcctaggcaacagggcgagactccatctcaaaaaaaaaaaaaaagagagactccacattttagccaattgtagaatttttatttttctgcctttttgttgcttaaaagcaggcttttgtgctaaatatggagaaaatgctaggaaaaaattaggatgtctagatttaactgccattaattagtatgtaatcttgggggtgggggttgagtaagagttagaataccagtggtcagtgaagattactaagattttatgaggccaaggcgagtggatcacttgaggtcaggagttcgagcctgggcacatggcgaaaccccgtctctactaaaaatacaaaaaattagctgggcatggtggcacacacctgtaatcccacctacccagtagattgaggtaggagattcacctgaagccaggaggtggaggtttcagtgagccaagatcatgccattatactccagcctgggtgacagagagaccctgtctcaaaaaaaaaaaaatttatgagacaccgtgcataggtgttggaattagtgcttttttcttgccatcttttctgttttagagaggtaatgataagtaagaacttgctggggaaagtagcataaggttagtgaaaagtaaaatttagtatacacacaacacacagacacatatatatcacatacccttggatatgtgcgttggaaagacaaacctgcaatggaaaagtttttacactgatataaaatgtgaaatataatggttgagtaaaggacagaattcttttgggagaggatacacattctgcttaattgagattcaaagttaatgttctctgtcatcaaaactgattgcaagtggtcatctcttgatgctgatctgtagtgagattctatgtatttcatcttagaagatgtctttttacacagggacatactgcatattcatcacttggaaagcatttatagaattctcctgatacttgcctttcagcatgtcattacattgcagattaatcacttccagtagagggttaggtggaagctcctcggctgcacagttaaatggattttgatatatggaaattttttttgcgcttgagtcaaggtttgaagaatgctagtttgagtttgaaaaaatgtatctgctgcaaaattgtgtgggaatgaagatctcacttgtcttaacttggcagcacgggttatgtataaagcagtttgctgactgggtatggtggctcgcgcctttaatcccagcactttgggaggcggaggcaggaggatcacttgagttcagcagtttgagacctgcctgggcaacatagtgagaccttgtctttatagaaaattaaattagccaggtgtggtggcatgtgcctatagtcccagctacttgggaggctgaggcaggagaatgtcttgagccagtaggctgtagtgagcctcattacaccactgcactctggcctgggcaataaagcaagaccacatctcaaaaagtaaaaaattaaaaaataaagcaacttgctttaattcagacagtattagttgtcagaatgacttaccacaatggaagtttctcatatatttttttgccttataattttaggctgaatttattagaaaacatttaggggagctttcattctattttgtagaatagaggctacctcgaattaaaaggggaaaaattactagatctgccgcaaaatttaatttctaaaactcttctgtgtttggtaatagtgattgagggtggtggttcttgtttagaaaaaattcagtatcagccctgaatgcaaataaattacaataaagctgtcactgctaagccatcaaaatcctgtgtggttggccaaatgaggatattcagcttttattactaacaaatagtcatgtaactgacagtggttaagttcattagagcaaatgaagttgaccattgatgcctgtggttcagtaatacctgattaagatatttttccacaaaaaaactgcaccagacttcaaacatcctacattttctcagactttgtaaaatagtccaactaagtatttttctactttaccatcatcagttgtgacatatcttagcagattacacttcaggttgtactaaaatagtttttctcagctgctttgagaatattcttgcctctagttgttccacatagattatttatagagggtaacttttcagtcacttcgaatgaggattggctccccaaataacaagtattggtaatacctgtcatcgagagccaaggaacaccactcagaaccatttggcttgttttttaattgtttactaattttgctcccagtgttctcaactcttcaagcaccgtttttacagaaaggctaatggcgtttaaaagtttattgtctcggctggggtggtggctcacgcctgtaatcccagcactttgggaggccaaggcaggcagatcacgaggtcaggagattgagatcatcctggctaacatggtgaaaccccgtctctactaaaaatacaaaaaattagccgggcgtggtggcgggcacctgtggtcccagctacttgggaggctgaggcaggagaatcgcgtgaaccagggaggcagagcttgcagtgagccgagatcacaccactgcagtccagcctgggcaacagagcaagactccatctcaaaaaaaaaaaaaagtttattgtctcaagacatacatagttcttcagcttttccaatcagatacaatttaattaacccaccattgataaatgacttaacttggctaacaaatgggccacttggaaacttgagttgcagactcatttttatttttgtgaagaaattctgctgtgatgagatttcattttaattttttaaaaagttcccttaccattgctttactatgaattgggaatgctgtggtgagtgctccatctggtaacatcagtatatgttgtggttttttttttagcacagctacataatgactacaatgccttagcacccaattaaataacataatccacactttattgtgtcttaaaaacacaacattcaaagttcactttttttgctttgacatgatgagtatgcactggtagtaaaagtaaataaaatgttgcagtacagcaataatcgtgacacccatgacgctgccaggttgtaactgcatctgtataatttgtgatgcaccgaaaagcagtgtgaagtgatgagagtaccatatgtagtccatcacaactgctcagctctgccattgtagcatgaatgtgtccagtgataaataagtggctatgcttcattaaactttatggccaccaaaatttgagtttcatataatttttatatgtcacagaggattcttttgttttgcttttttgcaatcatttaaaaaatgtaaaaaattattcttaggcccctagccatgcaaacactggcattgggctagatttgaccccttggccttagtttgctgaatactggtgtagtttttctgcctttcctaatgtaaacatgattgtagaaagataaccttactggaagtcaggaaaccttggtgctcccaccaaagttgtgtgactgattaagtcaggtgaaataaattgggattaggagccatggtgtctagtccttgacaagtcattcctcaatttttttaatgtaatcacctgaatttctagtgtatgcataatcacattttgtgtgcctctcggcagccattccattgttgaagaggcagccaacacagaaaattgttgaggggttttgatctttgacaagggaagcgtatagtgtgagctcaccagtcaccctggcttttttccctggagacatttcctagtttgtggcataggggaaatagatcccaaataaaaagtgacggtctcactgggctaaggaagaaaggtggaagtttggggccactaaagcaattgaagcttaagtccaggagaggagagaaccacataaaatctaacctcaaaatctgcagtcaggtccctctaaagtcattgactgacttcagaggtacacataagcaagagaagaaacccagcagaaaacagtagctgaaaagctaaagatctgagcagacatttcagtatctaatgccagagaggcaaaaatggaagttcaaatcctgccaagttagaggggccttattacaccctgagttttccactgtggccccatcatgaccactgcctaagattgaaggcaaaactaaaacagaccagccctcaggaaaatgagttactgctgtgctgctgctaaaaggaaacagccttctttggagaaaggtattatctaaaacttctacaattttgtatccataattcagtatttcattcaccaaaataggatatgctgttttggacaagctaatgaaactgaattgaccaaaaaccaatagaaattatctagtgctgacagaaaaaaaaaagtgtacagaagaaagcatgagagacttatgtattgctgatagacagtggaaaggtctatcatgtataataggaatcccagaaagagaggagatagacatacaatgggatggaaatattgactaataattttccaaaacagagatatccaagcacatattaaagaagctgtgtgattccaagcagggtaaatagagagaaaaccatattgaacatagctgctagaaatccaagagaaagagaaaatgttaaatgctgtcagaagaaaaaattcattatcttcagggaacaataatacgaatgatggctgatcgatcacctgaaactgtggaagacagaagacaatagaatggtgttctctttaaagcactgaaagaaaaaaaatgacaacctagaattctttatttattttgagatggagttttgctcgtgtggccgaggcttggagtgcaatggcgtgatcttggctaactgcaacctctgcctcccgggttcaagcgattctcctgcttcagcctcccgagtagctgggattacaggcatgtgccaccacgcctggctaattttgtatttttagtagaggcagggtttctccatcttggtcaggctggtctagaattctaaatctagaatatccttcaatagtaaagtaaaatgaagacaaactaaagctcagaaaatatattgctgatatgctggcactagagaatattaaagcaagttctttgtgttgcaagaaaataacagataaaagcaaagaactgcagaaagaaatgaacaatggtaaggataaatgtgagtaaatacaaattctgactgtttaaaataatagttgtggcttgtgggatttaaaatatgtggaaacaaaaatacgacaactgtagaacaaaaggctggaggggggtggtaatcagtcaaaagtgtatttgtaatctctagagcaacctctaaatgaaaaaagaatatataacgaaaagctaatagaggagaaaatggaatagtaaaaaaataactgattactccaaagaaatgcagggaaagagagaggaatgaagaacagatgggacaaacagaacagatgacagaatggtagacttaaactcaacttcgtcgatgattatattaaatgtaaaaggagcaaatattggctgggcaccgtggctcacacctgtaatcccagcactttgggaggccaaggcggacaggtcacttgaggtcaggagttcaagaccagcctggccaacatggtgaaaccctatctctactaaaaatacaaaaattggctgggcgtgggtgcctgtaatcccagctactcaggaggctgaggcaggagaatcgcttgaatctgggaggcaaaggtttcagtgagctgagatcatgccgctgcactccagcctgggtgacagagtgagactccatctcaaaaagaaaaggagcaaacattgaaattaatgcaaagctcagaagacctaactattatagatactgtttacaagggatgtattttaaatctaaggacacaaatgaggaagtaaaaaaaagggggggggaggggggtgtgggggagacgatatcatgcacacattaatcaaatgaaagctgacttggctatatttatgttggaaaaaagctctaaaaccagaaataacactagaggtaaagaagggcattatataatgctaaaaggataaatttaatggaaaaatatctaaaatttttatatatgtaatagtataggtctaaaactaaaaggaaaggttgacaactattataaaaagttaaaatagacaaaaccacaaccatagatcagtgcccctctttcagtaactagtagaacaaacaggaaaaaatcagcgaggataaagatttgaacaacacagccaccctgacctacttggcggacatagaacacttcactcaataatttcaggatatatatgcttttcaaatatgtatgaaacatttactaaaatataccatatgctataccataaagcacccctcagtacatttgaaagaaatgacatcacagatgtcagccaaaatccatttaatgaaaaacgtgaaagactgccatactagagtatataacattgctgagagaaataaataaaaggagagataccatatttgtggattggaagacttgaaattgtgaagataccaattctgtctagacttacctacttattccccgctccccccccccacccttttttttttttttttgaggcagagtttcactcttgttgcccaggctgcagtgcggtggcacgatcgtggctcactgccacctctgtctcttgggttcaagcgattctcctgcctcagcctcctgggtagctgggattacaggcacctgccatcacgcctggctaatttttgtatttttagtagaggcggagtttcaccatgttggccaggctggtctcttcctgacctcaggtgatccacccgcctcggcctcccaaagtgctgggattacaggcatgagccactgtactcggccttattcccaatttaacacctcacaagtttgggggtggaggggctagacacaagccaattttaaaacatatttgaaagttcaaaaggaaaatctaaagaacaaaattgggatgtttatattactagataccgagactttataaaaagccatagtaattaagacattgtggtattgatgcaaaaatagacaaatggggtaatgagctatatagtggctaaaaacagacctgttcctgtatggtcacctgatttttctacaaagctgccattgcggttcagtggggaaaaggatgatctttatgataaatggtgctgaatcaactgggtatctgcttagataaaaaccttgacctttacatcaaaccatacacaaaattaatttgagatgggttatagaatgaagtgggctaaaacaataaaatatctggaaggaaacataaggaaatatgtttagagaaggcaagaatttcttgaataagatgcaaaaggccttaaccaaaaaaagattgactaagattttttaagatttaaattcattaaagaacttctgttcatcaaaagatagcatgaagagatggaaaaagtccagttttaaagaatgaacaaaagacttaaaacgaacttgtccaaaaaaaaaaaaaaaagataacctaaagggtctattaggcacatgaaaaagatactcaatggccaggtgcagtggctcacgcctgtaatcccagcactttgggaggccaaggcggggagattatttgaggttaggagttcgagatgagcctgagcaacatggtgaaaccctgtctctacaaaaattagctgggcatggtggtgtgcacctgtaatcccagctgctcaggaggcaggagaatccttgaacccgggaggtggaggttgcagtgagccatgatcttgccactacactccagcctgggtgacgaagcgagactccatctcaaaaagaaaaaaaagggtacttgacaaccttggtcctcggggaaatcaaattaaatccaacgaataccaccatatacccaacaaaatgactaaaattaaaaatactgataatttgcagtatcagtaaagatatggaccaacagtgttaggaggattatgaattggtatagccactttgggaaactgatggtatctactacttaatgaaataaactgacccgagcagttctactgctttgttctatacatacctaagataaatatgcccatggatattcatagcatttgtaatagccccaaactggaaataatccaaatagagtagtaaagatattgtcatatgttcatagaatggaatacaggttgaatattttttatccaaaatgcttgggaccccaagtgtttggaatttggatttttttcagatttttgagtatttgtattatacttaccagttaagcatccgtaatctgataatctgaaatctgaaatgctccaatgagcattttctttgagcatcatattagcactaaaaaaggtttcggttttggagcattttggatttcagattagggatactcagcctgtatttcaaatgactgttaaacacaattatatggatgtatctcacagatgcaataatgagcaaaagagcattcttatgtttctttttatctaaaagtctaattcacaaatacatcaaatcaatatatactgatagcaataaggatagtaacctcaggcattactgtcattagttagggtacaagggaatcttcagggttgcaggaagcattctgtaccttgatctggatgatggttactcaggtatatagatagtttaaaattcgttgagttacacccataaagttagtatactatatgtatgtaatatgttaaaatattttctaaacagtagtaagtatggtagatatttgctatcatgggattttatctggtctgaaattactacatgctgaaaatttctaggaaatttttgatccaaaaattttatgtggtgaagtggaaaaagtactggcctttaagttagaagactaagtctgaatccctctctgctgcttctcactcctatcagtcttataaaacctgggcactgtgatcttatgcaagttattgaatctctgtcattgtacagtggaaagaatagcttctcttttcagttcctggggtgtgaaaaggattaaatgaaatgattgatgtgaaggtgctttgcacctaatgaagtatgctgatttataatatttttataatccagcagcgttcagatatccaaacactggaatccctcatggatgctgtgatagcagtctagttgccctgtgtaacaggttgcccggatgatttcttccttttttcagaagtcttgagagtacataaaggagcaggacttttgaattggaagacagctgggattgccctgggacatctgccttattctgtccaacctttggctaatttatttctaatttctaaaactcttgtcagagttttaaacattgggaaaacctttagcttctctaactgcattcatcaactcttaagatgtgactgattattaaatgcacttttatgtgccactaagttggtggggggggctgccaattataattgtaagaagcttttaattgcaagagtctcacaacttcagagatattagttaagggagaaatgtgcatcctacagttagtgaaaatataaaaagtttctgtgcagtgtgtttttggtaaatttttagtttctgtggatttgcttgacttacaagttgaagcactttatagttctgtaaaaatgttacacaattacttgagaagtcaaaattatacagagggaataaaataaatactaggtaaaatattcaccactgtcatttgaatattttaaattgacatattgaagtgacccacattagtcttttgacttagtagtcaagttacaactaagttttgataatttactgttcttcttgttcattgctgttctctataaacaactaatacacagtagactctcaaacatttgttgaatgagttaatacagtttgtaagtacttttagctgtgtgtttgttatctgaaagcagtttgagacccttaattcttccaaggcgaatactttttttttgagacagaatttcgctcttgtctcccaggctggagtgctgtggtgcgatctcggctcactgcaacctccacctcctgggttcaaggagttctcctgcctcagcctcccaagtagctgagattacaggcacccgccaccactcccggctaattcttgtatttttagtaaagacagggtttcaccacgttggctaggctggtctcaaactcctgacctcaggtgatccacccacctcggcctcccaaagtgctgggattacaggcatgagccaccgcacctggtcacattttttttttcttaaactaaaatcttccacatttaaaactaaagctgagatgtctttttggtgttagaaaaacccaaatatgcatcagaagtaggtaattgatgtttgagaacaagcactaatgaagctatatcagttcccataataaaagcagttctgctgatcattgttttgaatttcagggatagtcttataaactagcatatttgctaaagcacatttgaatgttgtctgtgtctcctgtttattgcctcctttttacttttatattaatatattaatggaatatatagcttttgcatgtggaggcctttttttttttaaagcctcttattgacctggcaaaggaatcagcaatttttagcaagaaatatgtggaattttattttactttggagatggggtctcactctcacccaggctggagtgcagtggcacgatctcagctcactgtagcctctgccttctggggtcaagtgaaccttccacctcaacctctgccttgagtagctgggaccacaagcatgcaccatcatgcccagctaattttttgtattttgggtagagatggggtttcatcgtgttgcccagggcgatcttgcgctcctgagctcaagtgatccacccaccttggcctcccaatgtgctgggattacaggtgtgagccaccgtgcccggcctttatttttattttgcagagacagggtcttgctctgtcaccaagactgaaatgccctagtgccatcatagctcactgcagcctcaacctcttggcctcaagcaattctctactatgctaggctaattctgttttttaaaaacatcttttgttgacacagggccttgctttgctgcccaggctggtctcgaactcctggcttcaagcagtcctcccgctttgaccccctaaagtgctgggattacaggggcaagctactgctcccagcctattttcttttcttaaatgctctttcacttaagattaaatgagagctcagctgtaaatttaaggttaaagggagtcaggggagatggtgatgagaggaaatgattacaagttgagttcagtggggcaaataaggaactcttctgtctctccatgcaacattctgttccccttcatcccacaagttactggaaaccatattatcttatggctcagtaatgcaaagatgcctcactccatctaaatagcctttagaggttttaatataatgatctattgggaatgtaacgataagttaatttttaatacatagctgatatcttttttgtatttcttttgatcagaaagtagagataggagttgctaaaattttggggactgctggtaacattccaagaaagtgtgtgaagctaaatcacctactgacaattactatttaatctccctttcttcatagcacattgttcttaatgaggctgttttgacatcctactagatgcgagataagcaggccagaccttaaagggtgcgggctctgaaatgtttttttgtgtgtgttttttttgttgttgttttttttctgtttgtttgttttttttttatttgagacggagtctcgctcttgttgcccaggctggagtgcaatggggcgatctcagctcactgcaacctctgcccccgggttcaagcgattctcctaactcagcctcccaattagctgggattacaggcatgcgccaccacgcctggctaattttgtatttttggagagatggggtttctccatgttgatcaggctggttttgaactcccgacctcaggtgatccacccacctcaacctcccaaggtgctgggattacaggcatgagccaccgtgcccggccctgaaatcttttaagtctctttggctactaggccccaggttggtcacaggacagcaaaaaacaggactgcatttcatcaacagcagacttgaggagcatcatcaggaaccagtaacaatgaaaatagaagtcagagatcatagaataacattattttaaaccatgggaccaaatagggtaatttgctgcctgtgtgacttttctgatttttaaagtatgggcatgactctttttgaaagattattatgagtaaattttagaaaactgactgttttatttatcgtttgtcagtacgaggatgtcgtccaggaaagattgtgcagatgactgaagcagaagttcgaggcttatgtatcaagtctcgggagatctttctcagccagcctattcttttggaattggaagcaccgctgaaaatttgtggtatgtaaatgggtaaagttggaaacaactcttttgaatcatgtttttcctcccatgtttaagatctagagaaaacattttttgaaatttttgtataaaacagatcagtaggctttactaaataaaagtgtataaaaattgaaacttataaaaatgacaagttacagacaagatgaaaatacttgctatatatcaacagataaaaggagttctatttataatatataaagagttcttataaataagagaaaggcgatacagtataaaaataacataggaagaggaaggtcttagaagaaattcaaatggccagtaaacataaggacgtcagcttctttttttagtaatcagtgatgtgcaatttaaagcaagtctccaactctagtcagattataaaaaaataccaaagattgatgtttagtgttgtcaaggatgtcatgaaaagggcatcatagtacactggttagaaaaaaataggtgtataatttagagggtcaatatggcgatatctgtggtcttctaactttgatgttatttaaatttgttttgaagattatactactttataccttgtattcttttaagttttacagtgacttttttacagtcctttgtacagtgcccagcaaataagagatactcgctaagtaaatgtttgttttttgtttgtttggttggtttttctttgagacagagtttcactcttgttgcccaggctggagtacaatggcacaatcttggctcactgcaacctccacctcccgggctcaagtggttctcctgcctcagactcctgagtagctgggattacaggtgtgagccaccacgtctagctgactttttgtatttttagtagagacagggtttctccatgttggccaggctggttctgaattcctgacctcaggtgatccacctgtcttggcctcccaaaatgctgggattataggcatgagccaccgcagctggccaataaatgtttgttgaatggatcagttaacttagaatatcacaccttcaagtaagaggtagtagttcagaatttgggggaactaatcaatcccctgtataaacttaagcaaatgtagttacttagaggtgatcttaaaattattagaattaaagtattctttgaaggtgttctttaaaatgtaatatagaaataacttgaaggtaatggaagttatttgtactacatatttctaaaggtttactatttgtctccatatttggtgttaaaaagtgacgtaagttaaactaccagataataaaattgttttagttacctattgttgtataataaatcattccaaaactttgtggcttacagcaacattaatttaccatctcacaatttctgtgggtcaggaattcaggaacagcttagtgggtcctctggctctgggtctctcacaaggctccaattaaggcgtgatctcgggctgcagtcatctgaaggttgaactgtgaaaggattcagttccttatagactgatggactaagagcctcagttccaaatgagctgttggtcagaggcctccctcagttctttgctacgtgggatgcttcattagacagctggtttcatcagcgagcatggaagaaggtgagagagtgcaagcaagatgaaagtcacagtcttttgtaacttaatcttggaagtgacagcccatctcactttcgcttattagaagtaagtcaccaaatatagcccatactcaagggtaggggaggattacacaggatgtgaacattgggaatcatttcatagaagctgcttataacagtaaccaatttttctaaaactgactctttctctttttaggagatattcatggacagtatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgtaagtgaaaataaagacttagaaaagtaattcatggaaacattgcctaataattttctggttcagaagagttgctttgattcagagttttttcaaaataagatctgtcaggcataggccaggaagaggaacctgaaactgggaaacatgttactaattaaattggttccttgagatctccttggtcatatttcagattgactgcagcttacttggctgaagaggctcttttaaaattagtttatctagtaaactatccaggtgaaacagaagtcactgtaggcagtggcccttggttttctagtgtccattaaggttttaactctcggcattcttgtggtatgacagcttttattagtcctgtgtcacaagaattattgagaagttctgtgaaactatttaaaagtcaaagtttaatattattagaatttaaatctatgtctgtaaaccttgaaagataaagatactgaatactctggggtatccttattttactctctttttcattagtaggaaatcaacgatttggtattgtatgtttccaagtgttattattaaaataccctactaggttcaaatatggtcttttggttttattagaatacgggagtaagtatttatttggttaattactacttagaatcaattataatcttcaaattgaattttttattgctgtcttccctattagaatctacttttgctttttttcaatccttaattatgttagagacctattcaaactcatatctccttgatttatataatgatttgacaaagtttgagggtatgttatatgtgcaggcactattgtgaacacagtgcgtgaagcaatacacaatacagatgatctctgttctcatggagcttacattttttttcccaagtgtttctccagcattgattggccttccctgtccagccaaatagcaggtcatcagcctagctgggactgtatgtccttgtagtgaaaaaaggctgtatcaggcttccaatgcttaatgaaaatagcctttcttttttcttttttcttttcttttctttctttctttttttttttttttttgagacggagtctcgctcttcttgcccaggctggagtgcaatggcacgatctcagctcactgcaacctccgcctcccgggttcaagcgattctcctgcctcagcctcccgattagctgggattacaggcatgtaccacgttccctggctaattttgtatatttagtagtagagatggggtttctctgtgttgatcaggctggtcttgaactcccaacctcaggtgatccacccgcctcggcctcccagagtgctgggattacaggtgtgagccacggcgcccagccatgagcttacattctaatagaaatgattctgtatttgattttgtattgtatttttatttctgagatgtagtgtgtggtttgaattatttaaatcagactagcagagagaaagtgggttggagtacatcaaactacaacattcttcctaaagctacatcagaaatggaggtatatttttaaaggataaaagataggcaagaatgtctttggggatagaaatgacatcaaatgaaataatgtatgggagagcaacttgtaaacagtgctttgagttatgtacttactcattaaggggcaggttgtggcataaaagcacaggaagttagtacttgtgtctttcatcccttccctagcttagtagttgtaccttattaccaaattcaggaaaatcgagtaactctaaaaaggtgaacatacacttgaggttgtctttgtcgtagctttttatgctaggctacaggaaaattatagcctttgtgcctctatttatacttgctatagtgccaagttgtaattcacacaaaagaatactagtaaacacttggaaattttccttccttggcaataagtttatactgtgttaatcaatgcattagtgttaaaatggacagtttccagaggcaccttttcacttctgcttgcttatttggctaggtatttaactagtccacacactgaacggaaaaaaatgaactaagagcctattagactgtttaaaaattgctatattatactgatcttaaaagacaaaaattgtttgatgtatttcataaaacacctagcacaatttttgggattttttaagtgttaaatttgattaggtttattttatttgtcagaaattctatgtatttatgatgtacaacatgatgttttgaagtatatatacattgcagaatggttaaatcccgctgatttaacatatgcattacctcaaaaagttagcattttgggagaaaacaacacttaaaatttactcttagcattttacaaagatacaatatagtgttaactgtagtcactgttatacaatcgatcttctgtatttattcctactacccaactgatactttgtattctttgaccaacatcttcccatcccacccctacccccagcacaatctttgaagtcttggtaactttactgaaggtattgaatgtttattgtagttgttgcctttttgaaagtacgtaaataacatctttgcattgtagaaaaagttcttctttatagataaacatgaagaaatgaagaaaattgaaatcattcataatcctgcggctttgagataactgatgagaacagttttagattttttaatttattctatctgttctttttacaggcaaacgaagatttaatattaaattgtggaagaccttcactgattgttttaactgtctgcctatagcagccattgtggatgagaagatcttctgttgtcatggaggtagactagtaaatttgccttacagattttttttttcttctattattcggaaaatacctataataatcaagaggctgtgggaaaacaaagcagtgcttgtatgaaaactcaagtgattaaaactgttttaaacatggctaaacctcttttaaaaattagaaatttatttataaatgaaaacgtaatgcttctttaaatacagtttcacatataaagagtgtaactagagttgtttgagaaagtctcctttgcctcaagttttaacagaaagacacccctgctatttattagtaaaaatgagaggatatcttcctgcctatattgaaatctttcatcagaatccaaataaaattgagtttcatattcacatatatcaagaattctaggcttcatataatatatttgctttagtattaacaataaaataataaaataatctttggcagattggtaggttactctgtatggcttatgaaataagcttgaagttttttgaaagtttatttgaaaaattaatgtatatgtctaacacctagctagtagatagtgtatgatctgaccatcttgaagagttaaaaacctgttgctaagatacatttatgaaacagataattgagtaataaaaggtatttaatatgtcagaacttattaagacactatgagaagtcaggaggaggaaagactgggtacatgtgtgtatggaggcatgggttttagaggataaataggctttggagaagttaaaaggacttgagacactctttgttgtctagtttagggaatgtgtaagaactggcctgactagaaggtcaagtacatgctgggaaatgatggaatcagattatggagatttgactattgagcaacggagtttgttgagtgatttaataaccatattgggtttttgtacagggaagtaatttaatggaaatagtgtaagaaaattagtttttcatcaatatacgggaagaattaaagtggaaaaacgctgaaaagatagatgcacttgcctaggcccgaggtaataaatggtttattctctggcagaacataattcactatattaattgaaatatgttttccagtagacattaaacacgtaatgaattgtagttcttgtacattagtgtagctaaggatagaagtgtagcagtatggatatgaatgtttagcttcattccttgtgatgatacttggattgcctatcagagagaaataatagcttatataccacttcaaagattgcagagtatttttatgagcttttcctgttaatccttctgatcaatagtttatgacttcatgaagataatgaacatgttggagtgggatgtgaaaagaaggtcttagggaaccaagtgaggcactttcacttagaagttaaaatgtttaagattagtggtaagaactggcaaaagtggtaggaagggttgcagttgattatgtttctatgaaggccagggaatgattggaaaaaagaatggtagttttttttttccttgggaagtcttttgaaatataaaggaatttcatttccctggtagggaaaaatggaaaaaaacaattataatgctgtattatatcaaagtggaattcctaataactctgtgttgccctttaagacattaaaaggggcagggcgcggtggcccacgcctgtaatctcagcactttgggaggccaaggtggttggatcatgaggtcaagagatcgagaccagcctggccaacatggtgaaaccccgtctctactaaaaatacaaaaaattagctggatgtggtggcgcgcgtctgtagtcccagctactcgggagactgaggcaggagaatcgctcgaacccgggaggtggaggttgcagtgagctgagatcacgctactgcactccagcctgggtgacagagtaagattctgtctcgaaaaaaaaaaaagacgttaaaaggaacacttttcagtatctttaatttcacatagtgaatctattttgattaaatgctttttattcggtgactgttaaaatattaaaatttttagctgttagtactatgtctcatctttttatttataggattgtcaccagacctgcaatctatggagcagattcggagaattatgagacctactgatgtccctgatacaggtaagtgtagagagaagtttaattgttttgtgtaaagtgttttcatatttgaacttgattacatttagtggaagtaggattggcttatgtaataaataaaagagcttttttcatagtcaataagccagctacagattactttatttgcagtaatacacaatttttcactttgcactgatcctcaaaatgcggaacctttttatttatagtcataatgtagttatttgatcacaaaaaagattttgctgttgagtccttatacctatttttctaaattccctcattcatactagcattggttatgttcttcaaaaatttgttaaattagacaaaagttttttaattaaaataatctattctttgcttcttaggcaaggatacaactaccttcttttcaaatgtctagtagttttttgttattttctatgtcctctatttgaaatttttagagctttttttcaagggggtgtgggagggatttcaatctgttgcccaggctggcctcgaattcctaggctcaagcaatcctcctgcctcttctgagtagctaggggactccaggcatgtgccatacctggcttaaatttttagagctcttaaggctctagagacctgtggtcagttttgtgaaaattacattggaaatctctgggaaggctgggagcagtggcactcacgcctgtagtcccagcgctttgggaggctgaggtgggcaggatcacttgaggtcgggagttccagaccagcctggccaacgtgatgaaaccccatctctactaaaaataacaaaaattagctgggcatggtggtgcgttcctgtaatcctagctactcaagaggctgaggcacgagaattgcttgaacctgggagacagaggttgcagtgagccgagatcacaccactgcactccagcctgggtgacagagtgaaactgtctcaaaaaaaaaaaaaaaaaagaaaaaagaaacaacaatcaccacaaaaaatgctgctcagaactacacatcaacgattataaatggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccaccttggcctcccaaagtgctgggattacaggcgtgagccaccacacctggcctgtgttatgagcttttttacataacacgacttgttgtgttgattattttttaaagtatgcattttatcacagtttttgattgtaattatagaatacatttgactaaacctaacaaactggtatttaaatagtattttatttaaaatgctgtttttaggcctggtgcactagttcatgcttgtaataccaacagtttgggaggccaaggcaggaagatcacttgaggtgaggagtcgagaccagcctgggcaacataacacccatctctacagagaaaaaaaaaatttttttttttaattagccacatgtcgcagcaccgcggctactcaggaggctgaggcaggaggatcacttcagcctgggaagttgaggctgcggtgacctgtgattgtgctcctgcattctagcctgggtgacacagtgagaccctctctttcaaaaaacacccaaagtgctatttttaaaataaggtataatataaatatgtattactggtcattcttcagaatatctgtttatagttcagatgtaaactgatctagtgtgatatgctaggcttctgtttttagcatgttttatttattttagcgtattttaatgagaagttttcaagatgctgaaaacagttattttgatctttgatagtgtctgcaacattcagaaatttaatttataagttaatacattatttgaagcagcctagttgattgtgatgctagctcattaaacaataaatcttgactctgaaattctttttgagacagaatttcactcttgtcgcccaggctggagtgcaatggcctgatctcagctcactgcaacctccacctcccaggttcaagcagttctattgcttcagcctcccaagtagctagaataacaggttcctgccactgtgcccagctaatttttgtatgtttaatagagacagggtttcaccatgttggccaggctggtcttgaactcctgacctctggtgatccgcccacctcggcctcccaaagtgctgggattacaggcgtgagccaccatacctggcctgaaattcttatctagaccctgttaaggttaaagaattccagattgttgttgctaccattatttgatttttttaatgcatccagagtgtcatgtttcctaaacctcaaactctattctaattttatacagttttattgtctcactgaaattatagattcttgagatcgagaccatcctggctaacacggtgaaaccccatctctactaaaaattcgctgggtgtggcagtgggcgcctgtagtcccagctactcgggaggctgaggcaggagaatggcatgaacccgggaggtggagcttgcagtgagccgagatcgtgccactgcactccagcctgggtaacagagcgagactccgtctcaaaaaaaaaaaaaaaaaaagaaattatagattcttaataccttagctttctactggaaagaggctggaaagtatgaaagcattattaagcactgggtgggtgtatattttcgaagagtcagcttcaaccagaaagggcttaagaattgagactgactattccagtggattttgtgtgctagtgaatttcttaaaacatcatacagggagcttgggatatatcaatgatagagattgaatacattgccactaattctacaaatggttttataatgcctctatcaagatatgatgtactgtaactgaaaatgaagatgccctttcctcctaaaccatactatgatgtttatggattatttaaaattcttaaaactgacttaactctttaaaaattatcttcttggctgggcgcggtggctcacacctgtaatcccagcactctgggaggccgaagcgggcggatcacgaggttaggagatcgagaccatcctggctaacacagtgaaaccccatctctactaaaaatacaaaaaattagccgggcgtggtagcgggcacctgtagtcccagctactcgggaggctgaggcaggagaatggcgtgaacccgggaggcagagtttgcagtgagcagagattgcaccactgcatcccagcctgggcaacagagcgagactccgtctcaaaaaaatatatatatatcttctcttagccactgcaattcttagaaaatcaccatcaccatctcaacatccacccttcttttaatatcactacagttggacttttacccactccgttaccctcaatcaccaagaaacttgcattgaggtctgatgatttaattgtaagtggcacatttttggtcttcgtcctactgcccttgttcatggcacatttcctactttaggacgattgtttcccctttcgggatacgtttactatactaagccctttgtcttgatcattccttctcaatacctaatgttcattctccctcatctacctgcctattaaatgtttgaattcctcagaattcatttgctggtcttctcactttgtattcctaaggtggtctgagtccctcttaagatttccactaccattaatatgatgacaatactcaagtaaatatttttaaccctgacctcttttccagggctccaaacattaccaaagtcaaggatctgatctgattttgttcttccacatttaaaaaaaaatcctcagggtctcagtagaaaatgtttttttttcgctcaagtgatctgtagatcaaatacaattccagtgaaatcacaattgagttttttatggaattaggcaattgtttttaatgtttatgtggaagaacaaaagatcaaaaagtaaccaagacaatcctgaaaaaaaaatggaggatactagccctaccaaatataaagacttattaaaaagctctagtctgttattggctcagggataagtaaaatagactaacagaatagactgtggtgctcagcagtggaaccgtaaggaaaggatgaactgttgaggaaataccactgggttgtttggttattcatatggagaaactacccaaaagatgaacagccttttccatgtattgttgtgctgtaagtgccatgcacatatttcctatatgtggaaagggttggaaagtactaccttaagaggccatggaagattatatttggtttgtatggttgctttaacaaaagtataagttacataggctggaatacttaggcaagtgatggtcattgtttagtaaaaggtaagagggcaagaaaggaactgaaatttgatgtagatgtgctatattctataaatctgtaaattttgttcttaattgctgtatttctgtcctttaaaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtatgaaatataaaactcttaagctttttcttttttctttcttttttttgggggcagacggaggggcagacagattcttgttctgtcacccaggctggagtgcaatggcgcaatctctgctcactgcaacctgtgcctcccgggttcaggcagttcttgtgcctcagcctcccaagtagctgggacgatagccgtgtgccaccacacctggactcttaaacatttattatttgttaacttcacataagccctctcattttgttttgaggaaacatatccaagaaagctaaatgagttgtacaaggaaagcagtaggagaggtggcagagccagttcctggatctcacacttaacaatctagtgatttgttaaccttttatcaccctaaaagaggaaatgtttagaaatattttggggctgggcatggtggctcacatctataatcccagcactttggcaagctgagatgggtggattgcttaagtacaggagtttgagaccagcctgggcaacaaaatgagattccatctctacaaaaaaaatcaaaaatttagctgggtgtggtggtgcgtgcctgtggtcccagctacgtgggaggctgaggtgggaggatcgcttgagcctaggagatcaaggctgcagtgagccatgtttatgtcactgctctccagcccttgtgaaagagctagacccagtctcaaaaaaaagaatgtatttttgtagtatacagcaaacctaacaaaattttcagtgcttctttgaagctttgtagatatgatttagattttttttttttttttttttttgagatggagtctcactctgtcacccaggctggagtgcagtggcacaatctctgctcactgtaacctccgcctcccaggctcaagcgattctcctgcctcagcctccggagcagctgggattacaggcacgcaccaccacgcctggctcatttttgtatttttagtagagacagggtttcaccatgttggccaggctgcccttgaactcctgagctcaagtgatctgcgcctcagcctcccaaagtgctgagatgacaggcgtgagcgtgaaccactgtgcccagcctcatttttatataatctttgtgcataatggcgattttgataagagcaaaccacactttaaaaaagtatttttgagaccattgaagaatttgattgtggctcagtgcagtggctcatgtctgtaattccagcactttgggaggctgaggcaggcagatcctttgagccccaggagctggagaccaggctgggcaacatgacaaaactctgtctccacagaagatacaaaacagccagatgtggtggtgtgcacctgtagtcccagcttgcttgggaggctgtggcaggaaagtcgcttgagctcaggaggcagaggttgcagtgagtgtagatcgtaccatttcactcctgcctgtgcaatgggtgtgaaactcagtctcaaaaaaagagaacatttgattgtagacttggtaataggtatgaattatttaatcttttaattttttgtttttgtttgaggccgagtctcactctgtcacctaggctggagtgcagtggcatgatctcggctcactgcaacttccgcctcccaggttcaagtgattctcctgcctcagcctcccgagtagctgggactacaggcgcctgccaccacgcctggctaatttttgtatttttagtagagacggggtttcactatactggccaggctgatctcaaactcctgaccccaggtgatctgcccacctcagcctcccaaagtgctgggattacaggtgtgagccactgctcctggccggtatcaattattttagctgtttcataatcattaattgttatgtaagaagaatgtctgtgtttttccaggaatgcatacttgagtgtgtagaggtaaaatgacatgcctgggatttgctttaaaataatatcagcaaagagaaaaggagagggagaagataaacaaatgtagcaaaatcatgaaaagtattgaattaggctgatgagttaatgggagttaattcaagtcgtctttatctacttttgtgtatatttgaaatttttcattataaaaacatttatacagttcagggtttttggttgtcttttatgtccgccaccactaactagattgtgtactctaaggaagggattacaacttgtttttgaatctctgttgctttatatagttgctgacattgtagcatagtgtatcatgcacatacagtgttgaataaattaataaaagcgtatttaattaagtatatgctgtcccacagtacttccctttctttctggagctttactccccatgacacttactactgctgcctctttctttgatcctaagtgataaaaatgactggctttttattctttgcttattgtatattacatgccacttttatttagcaggatttcttggtggttccattgaaatgaggtcatgttcccacatcctttgattttggcaaagtagtttttttttgttgttgtttgttttttttgtgagacagagtctcacactgtttcccgggctggtgtgcagtggcaccatctcggctcgctgcaacctccacctcccgggttcaagtgattctcctgccttagcctcccgagtagctgggactacaggtgtatgccactagcctggctagtttttgtatttttagtagagacggggtttcactatgttggcctggctggtctcgaactcctgacctcgtgatctgcccgcctcggcctcccaaagtgctgggattataggcacgagccacctcgcccggcctgacaaatagttttttaaatcagtaaaactgtgtttatgattttgataaatatgccttctattaaataacaaggcagaattgctaagtttcctaactaaaatgacccctgataatcagtttttttcagccatagatcttcattcactggtcttttcaaaaataaatgatgatttttaaaaatcaggtttctgaactacgctagtttgcatggtcttttgttttccagaaactgccaaaatccttctattgtgtttattttcaaataattgtctctaaaattctagaaatattccctttaaaaaagaaaatttgaaagaatgaacaagtaagcaaactaaaaaaccaagaactaaaaacatggagtccatgaccagcctgggcaacacagtgaaacacgaaaccctgtctctacaaaaaaatacaaaaaactggctgggcaccgtggctcacgcctgaagtcccagcattttgggaggctgaggcgagtggatcacctgaggtcaggagttcgaggccagcctgaaaaacatggagaaaccccatctctactaaaaatataaaattagctgggcacggtggcacatgcctgtaatcccagctacatgggaggctgaggcaggagaatcgcttgaacctgggaggcagaggttgccgtgagccgagatcgcgccgttgcactccagcctgggcaacaagagcaaaactccatctcgaaaaaaaaaaagaaaagaaatacaaaaaaattagccaggcatggtggcacacacctgtggtctcagctactcaggaggctgaggtgggaagatctcttgagccccaggaagttgtgactgcagtaagccaagattgcaccactacactccagcctaggcagcagagcgagaccctgtctccacacaagcacatacacagagaaacaactaaaaacatgagtgccatttgctatgtggagcaggggtcacagggattagataaggtggctatggtcttaggagaaaaggttcatctaaattgtaccataaggtaatttcagcagaagcatgttcctagtactgaggtaggagttattttaataagtaaatgccttcgtaattgcttttttatattagcaagtggtgtcggataattttgctaattaaaagatacctaaaataaatttaaaagtaatcttgcccaccgtaaataaatataaaatatttacatattattgtgttcctcaaatttgtagactgagagaaaaattgtttaaattactcagaaattgacaactggttctagaaatgttaactcatcaaggccaggcacggtggctcacgcctgtaatcccagcactttgggaggccgaggcgggcagatgacctgaggtcaggagtttgagatcagcctggccaacatgacaaaacctcatctctactaaaaatacaaaaattcatcgggcttgctggtgggtgcgtgtagtcccagctatttgggaggctgaggcaggacaatggcttgatctgggaggcagaggttgtagtgagctgagatcatgccactgcactccagcctgggttgacagagcaatattccatctcaaaaaataaaaaataaaaataaaaatacagtctgttggcagttaatttaaggagcatgatccatgtaaattaaactcaacttagtaatgttttcagtgtgtagccagtagtgttttcagtgtgtagccatgtaataataatacatattttaaaatcaaagcaagaagtaagctcttcgcaaagtcgttcattggttgttgctcatttaattaaggattctgtagttggattataatgccctcatcaaagtaataattgatgtccctctgaaaaacacgtagattaattaaaataaaattaaatttaaaacttaaaaacaaaaaaagtacttagtgtcccagctccctgtagtcatgatgcctattagtatgttttgtttcatggggagccttgcaaatggcatgatttttaagctttcaggagtggtgaatttattattccaattaagctaaattgtttccattatagaaaaggcacaccagttttaatgttctaagcaaagtttaagaataaaaatcacaacttccaaaacaaaacagggtggtttgggggtgaggtggggcacagtctttgccaccttaaccttaattagtatagatggttcagaattacccaccaataaatgttttttcttctgacatttcctttgacaggtggtggaagatggatatgaattttttgctaaacgacagttggtaaccttattttcagccccaaattactgtggcgagtttgataatgctggtggaatgatgagtgtggatgaaactttgatgtgttcatttcaggtatgatgtaaacataaatatataagaactagaaatctaataaaaactattatcagaattcgttttagatttgtgaagtttccttgagcaagtgttgaaagtctgtttaattcagaagtgattaccactcaaactcattagatatttctattttcagtcacaaagtttccagcatttgtggtatatatcaaatatgaccgttttagggaacctaagttacgtcagtcattcttgattcagatgttttaattgttaaaattcctctatgaccttttgaatagtggcttactaaaagaatgtgaatgtaatgaatagtttaggcttttgttttcttttgcaaagtaaatgggtggaacagacactgggaaaagaattacaaactcagatgaaaataaagtaaaatagttccctggctgggcacggtggctcactcctgtaatcccagcacttcgggaggctgaggtgggcggatcatgaggtcaggtgatcaagactgtcctggctaacactgtgaaaccccatctctactaaaaatacaaaaaaattagccgggcgtggtagcatgcacctatagtcccagctacttgggaggctgaggcaggagaatgtcatgaacccgggaggcagaggttgcagtgagccgagattgcaccactgcacgctagcctgggcgacagagcgagacttggcccccaaaaaaaaatagtttcctgaggaaaaaaaactttcaaaataatactaaactacccgtttatgtcacaggaacatttatttatttatttttttcttttgaggaagcacattgtataccatgtacggggggttgtttgctcacttttattataatatttttattaatttatgtacgtactaggttcagggggtacatgtgcaggtttgttcccatgtgtaaattacatattgctgaggtttggtgtatgaatgatcttatctcccaggtagtgagcatagagtttttcatttcacattccccctcaccctttccactctagtagtccccagtgtctattgttgccatctttatgtccatgtttacccagtgtttagctcctgcttatgagtgagaatatgtggtatttgattttctcttcctgcattaattggcttaggataaaggcctccagctgcatccatgttgctgcaaaggacctgatttccttccttaattttatggtcgcatagtattccatggtgtatatgtaccacattttctttatccagttcactgttgatggacatctaggttgattacatgtctttgctattgtgaatagtgctgtgattaacatacaagtgcttgtctttttttgtacatacccaaagtagtgggattgctgggtcgaatggtggttgttttaagttctttgagaaatctacacactgctttccacggtggctgaactaatttacactcccaccagcaatgtttgaacattcctttttctccacaaccttgctgacatctattatcttttaactttttattaatggccattctgactggtgtgagacagtatcttgtggtttgatttacattaatagtgatgatgagcattttttcatatatttgttggctgcacgtttgttttttgagaagtgtctgttcatgtcctttgcccatttttaatggggttgttttttgattgttgaattaaatgccttatagagtctggatattagacctttgttggatgcatagtttgtattttctctcattctataggttgtctgtttattctgttgatagtttattttgctgtgcagaagctctttagtttattttggtcccacttgtcaatcattgttttggttgcagttgcttttggggacttggtcataaattatttcccaaggacagtgtccagaatggtatttcctaggttttcttctagggtttttatagtgtgaggtcttatatttaaatctttaatccatcttgagttaatttttgtgtatggtgaaaggggtccagtttcagtcttctgcatatggctagccagttatcctagcaccatttatcaaataggcagtctcttctccattgcttgttattgttgactttgttcaagatcagatggttgcaggagtacagctttatttctggctcctccatcctgttccattggtttatatgtctgttttggtaccagtaccatgctgttttggttactgtagccttataatgtaccttgaagtttggtagtgtgacgcttctggctttgttctttttgcttaggatgctttggctattcgggctctttttcaatttcatatgaattttagaaaagttcttttctaatgctgtgaaaaatgacattggtagtttgataagaagagcattgaatctgtaaactactttgggcagtatggagattttaacaatattgattcttctatccatgagcatggaatgtttttccatttgtttgcatcacctctgatttctttcagcagtgctttgtagttgtagagatctttcacctccctggttagctgtattccttgatattctttttgtggctattgtaaatgcagttcttgatttggctctcagcttggatgtttttgatgtatagaaatgctactggtttttatacattgattttgtatcctgaaactgattaacaaagttgttcatcagttccaggcacgttttggcggagtctatggggttttctgtgtatagaatcattatcgtcagtaaagattgtttatcttcctctcttcttatttggatgccttttatttctttatcttgcctgattactctggcagggactttcagtactctgttgaataggggtggtgagaatggtcatcctagtctcttgttccagttctcaaggggaatgcttccagcatttcccttttcagtacgatgttggctgtgggtttgtcagatggctcttactattttgaggtatgttcctaatttttcagtgcctaatttgttgagggtttttaacatgaaagggtgttgaattgtattgaaagcctttctgcatctattgagatgatcatatggtgtttgtttttaattttatgaggtgaatcacatttattgatttgcatatgttgaaaccttgcaccccaggaataaacccttcttgattgtggtgagttaactttttgatgtgttgctggattcggttttagtattttgttgacgattttgcatctgtgttcatcagggatattggcctgaggttttcttttttccttgtgcctctgctaggttttggtattacaatgatgctcacttcgtagactgagttaggggggaggtcctcttcctggattgtttggaatagtttcagtaggattggtactagctctttgtacatctgatataattcagctgtgaatctttctgggccagggctttttttggtttataggtttttttattactgattcagttttggaacttgttattgttctgttcaggattttaatttcctcctggttcagtcttcggagtttgtgtgtgtttctatgaatttattcatttcttaggaggtcatgtgtgtttctatgaattcatttcttgggagcgcatgtgtgtttttgtgaatgtattcatttattctaggtttcctagtttgtgtgcacaggtgtttataatctctaggtattttgtatgtctgtggggttggttgtaatgtcacctttctcatttcagattgtgcttatttggatcttttcttaatctagctagcagtctatcttgtttattcttttgaagaaccaacttttggtttcaacatttacatttttaaaagaggccagttttagctttagtgtgctcctacaaatcattcttgttcactgagtaaaacagcttcagtactttgcttttgcaaaggctattctatgtctttgatgtacacacactgtatttctcttaaaatgcattggggctttcccattcctctttctctttatcataatatactgtttccaccaattagtacaattgaatggtaaatggttgattgctcatttacaaattaaatatagtaaccataccttatccttccagcagttgtcatagtggtgttggattaatatattctcttcactaaggcactattatgttctaaatagtttttaaaaaatactttgtacatatttctatactgttttagttttggaaaatcatgacttttttatgtataatgtaggttaaagctctatttacatccaccagaatgagtgtagtaaaaaagccagactgtatcaagttttggcaaggatttggaggcattagaatcttcatacattaatggtgggaatagagttctcatatgatgcagcagttttacctctaggtatatacccaagatatatgaaaacatgttcacacaaaaactgttacataaatgtgcattattccttatagccgaaaaagtcacacaattcagatgtccatcagctactgaatagataaactgtggtacatccatacaatggactgtacaatgtacaactcagcaataaaaaggaatgaaggactgatacttcaaaactggttttgaaaacctgagtgaaagaagccagtcacaaaagaccacatattatatgatgccagttatatgaaatgttcagaataggcaattctatagagacatagtagattagtagttggttagagttagaggatgtggagagcaggaatggggagtgactgctgatgggaacaagctttctttttggggtgacaaatgttctaaaattagatttatatcaataaagctgttttttaagtaaaaagatctatttatacataaataaataaggtctgaagggtttgtgacttgtaggttagttaccctcctaagttactgtatcagaattatgatgacaacatagatcttctgactcttaaaccagtgttcttttcctcacaacagagatacactaagttcaaaaagttttttacttaaatctaaggattggatagttgatagagttagtgtacttttgttattaaaatatgagtggaatgacaaagttcagacatttgcacactttaagaaatgtttatggaactttgctattctacatttttattgcatttttgcagtttatgccatttattgaaaatcacaattgtaacaattttcttaacttctgtacatgaaaaaataacattatttgttaataatttactttaagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttcttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatggattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatgaccataaatctttgcttctttcctcttagggatctttgctagtttatgtgattatgaaatcttacttacaacaccacattgtttggggtatacagggtggaagatagcaagtgaacagggggtgcgggtggggagggtttgtgtgtgtgtgtgtgtgtgtgtgtgtgtgtgtaagagagaacaaactaacggcctgaggctaataggttcagcattcctttcagatactatatgcaaaaaggtgggaacctaaggtctgttcctggaggcttttcagtgaagcctggcataggatcggcaagttaaaatatgtattaatttttacagctgcctaatcagaatgattcagcagatttacaggccaaatttttcctacaaaaccagtgacatcacagctaaacatctagaactttcatagattattgtacaaatttattaaaaggcacagtaatttatggtctatcatgtaaacactgattctcgacaaaaccacaaaggcaagtaatacagtgcaacagaaaaaagtagtccagaggagtttctttttttctttttttcttttttttttttttgagagagagtcttgctcttgtctcccaggctggagtgcaatggcatgatcttggctcactgcaacctccacctcccaggttcaagcgattctccagcctcagcctcctgagtagttgggattacaggagcctgccaccacac

SEQ ID NO: 12138 - DNA, 24263 bp, Human
  misc_feature (1)...(24263): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaggaactggggctgttgcgcccttaaggttgctaaggcgacggttctggccagagcgaggcgcattgacgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccaggtgagtggggtcggccgggggctcaggcgaggtgagcttcgtcgcttcgcagccggtttgcgggagctggaccgatccaagatggcgtcacggggagcgacctgcagggggacggccgcaccccctgcccctccccggcccggcgggcgcctccccgcaggcctcacgcccccggctccgagtctgcatcctcaaggccgtctgggcgttggctttggtgcggggctccccagccgccccgctcgcgctcgctgcccccaccccacggctcctggggccctgggccctccgcggccctccccggccgccttcgcccccgcgcgccgcggcctcttcgctcaccctcccccatttcctgaaggacaacggctctattttactggggtccgccatcgtctcgtccgccggtcctggctcttcttgtaagccggtagttttcctctccacttttgatgactcgtcattgctagcagtagcctttcctcttcatagcggagtgatctttcccccaacacgacggtcttagtcgggctcctgaatttcctcttgtcccctttcacctctctccctttcccaattttgccccctgaggcctcctcgccaccactgtggccttccgactggcgtagcttgaagtctcggcttcccttcattttgtggtcatgaccgtggcctacgtgaagtgaagggcattttcctgcccttcttctagaaaatacacggtacctattaacctcttcagctcagagcctgtggtgacgaccgtcctactccttgagagattcccaagagatccgtctttttagcagagcgaggaaagcaaacacttactcaagatgaccctaggggagccgtaacttggctggtctaagggggtgcggtctgaatcaggaacagtttctcaaagtgtttttatttatttcccagaatgtaatcctttcgaaacaattttgtcacaactgaattttcaaaagaatgaatctgagtgttttgttttacatagagacaatgcagcgaaagttttaaagcagttaaataattgtgtgtggggagggaaggctaggttgttgggctttacaaataagtacacatagagaatccgggtaactcgattaaaaatattaagactgtgaagtctggttattcagggatttacatggtgactgcattaattttggtacatttctgttcgtatactgtcttattaccggtggctatctttttggttttcgtaatacattagttgtttcaaacaaaaacacagtttcactccttaggcccagttctctcatctctaccagccaaagacctgatcttagaatgattgatcatttgaatgttcttaaaatatgacaatgctttgaagcatgaaagatctgatttatgattgttcttggtggcctttaagtattatttgaaatgcagacaattctactgaagtggattttcagttcatatgattgcctgacctggagaagtggcttgtataaatctatcctaaagtaaatgcgcgtttttgtttttgttttgcctgtttaaagtagcagcatgattatttttccatggcttctaatttatgtgcttgtcttggagccacgaactttctaatggtctgttaattagtctacttgttgttgacctttatggtgaaagttgtcaaaacaaaatgagtaacagtgtagcactttagaatagctctttactctgttaattctttctataagttcttttaaatttacagtttcatctcaatagtttacaatgcattataattggaaaagtctgattagtattgaattcagttgctgagtggaggggaccacactcttgtcttctactcttaagtgcttagtaattaggagttggaaggaaaacagtatatgaccctgttgttaaattagtaaacttttaattctagggtaaggttagctgctcatcattatctctgtttgctttactttacataaaggtaccataattcgaatcctctaaaatccattaaatgcaatttatccattaaatgtaatccattaaatgcaatttatctattgaatcttcatgcaagtttgaaacttaagtgttttaacattctcctgtcaagatgaagaaaatattttgacaattttctgtccaaatgttttacagtttatgtggtaagaattctcccctcccccaactaaggattttccttcttttaccactagtgtattatcatttaggggtggaatctggcaaacgagtctggaataaaggttgcttttaaaactcatctaattttcttgtgtgtttttaaaaattttgattatgctagtagttggctaatcagatcctcactccagtggtttgctctgtgacgttaggatactcccatgggatagaagttacgtatagggaatgtcagatattcttcattgtgctgacttgctttcgcttacagttgacttttgtgccctggtaattctgtatcctgtttaccgtttacctacttcccacgtcatcatgatttcttttgagggagaactgaatgaaattcccttaagggcctgacttcagcacccgtctctgcagaggttagtggctcatacttcctcccaggagctgaggttatcgactctcactgttgcctacagagcacagatcctgaactaaatgaaacatttacttggaataatgctaattctgtacatattttattccctagtccccacttccctgtttaaaaacaaaatctacttagaaaaaaatccctgtgaatcagttgtctaatgaatttagcaagttaaatgccagattgacattttgctttatagtttatacaagcatgtgtgtgtttttttctcgcagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggtaaaaataaatgtggggagatgatgaggtgattgtgacagttgttacatttaataactggaatgttactaatttgtattttttggaagaaaaggaatctgactaaataaaaagtctaaaacaatttcaaataagaaatacagttaaggcatttgtagtaatttaaaaattcttaattagtagaatttatcagaaaaatgaacctgtatgctaactgtacttggctaataaagggtttccaaacaattctttgtaactttttaaattagtgcgtagaactataacagataaaactgatcagaactagtatagcagttctatgaataagaaattctatagttcttaaaggcagttaatgctcctcccgttttgaacaaagcaagtaagcgtagtaaatcttatcccacttttaaaactagtgtaatgaaacatgaatctagcttgtgactgatatatcagaaattttcaattagattcggtctattttagtatagagtatatctgataaattactgtagagatattgatattgatgttcctcaaaaattttactccattttattggtcaggacttgttgcgccttgaaaaaaattaatccaatttttattcttttttgctcttcctccttgcttgtatgtcattgtgacctacgtatatggcatatgtttttctaagcaaagtgataattttacatcagggataattgaagcaaatgaatgcttcaattcatctccctcaagaaacgatgaatgaaaaagtctgggttaccaaatattttgaatagtttatgtgattcgcttctgtaaatcagtgagagaaacttactgattttcttgtgcatgtggaagttatgaggtggttcataatgattatgaattaattgaaatgaatcatataccaaaagaaatgattcatataccaaaagaaatgaatcatttcttttggtatatgattatctaattgtataatagaaataatttgctttattttccattggtttttatagtttcttataatcagtatagtttattagtaaaagaatctgtactaagctttaaaaagtatttgggtagctcattgagcaggtattttctattttctttaaaaactgattgttaaaatttgtatttagtaccatgatcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccataagaaatgtaccaaaaactcttgacagttggtcttttgaaagcttctgcattttaattcagtcatctggcaatttgagtcttcttttactcttgtatttattagacccttaggtaagaggaattaaaataacagtgaccttgtgtctgctgtgtcaggtactgtgtgaagcactttatatacataaatactcgttatttcaaatgtacgaggtatgtgattttcagcattttatagacatagcagtaaaactgagagaaattaagtaatgtggctgtggttatagactgtagtcgtcagcttttgctggagcaacatacaacccccaaatttcagtggttactacaacagaccagtcatgtgcagttcttctggtatcagcctgtcttatgttcttgacaccacatatcttgttctggggctgagcagaaggagcagccctatatagggcatgctgttctcaaagcagagggagggcagaagctcaaggtggacagagccaaaccacacaggcaaccatggtatggcatgtccacttacattccatggccagagcaagtcctgtagccaagccttaagtcagtggggtgggaagtatactttacccacagggaagagtgacagaagcagggagggaacaaataatcgggaaaacatagtagtggggacagaatttgaacctaagagtcaagaagatagtgcagaatttaatgcaaaaccgaatgcagaatttgaacctcagagtcaagaacataattaaccactgagtagactgggaggttttttctaatttttaattttttattgatatataacatttgtatgtttttatggagtacatgtgatattttacaggcatagaatgtgtaatgatcacgtcaaggtatttaggttattcatcacctcacttaaagagctgaggaggaaggagactgacagaaggatgacaacagcaagagaaaggatataaaaatatatcatagtatatactagaaaactcatgatctgagtaatggctctgagttgtcagattaggttatattcagattgctgtttttaaaagactcactagaatccatgagacactgctaaaatcagaatgcttttgttacttcaaaattaatcttaaaaattcagtgaagtagaatgtagtcccaagtgaaatgttatttgtgaaatttttcctgaaatttttgtgaaatgtcagtgacaaatttgggggtgggagaatttgtgttttcatttatactcttaaactgtgtgtgtgttttattttatttttattattatttttttgagacagtcttgctctgtcacccaggctggactgcagtggtgcaatctcggctcactgcaacctctgcctcctgggttcaggcgattctcctgcctctgcctcctgagtagctggggctacaggtgcctgccaccacacctggctaatttttgtatttttagtagagatggggtttcaccataatggccagtctggtcttgaactcctgaccttgtgatctgcccaccttggcctcccgaagtgttgggattacaggtgtgagccaccatgcctggcctgttttttgagacaggatctcactctgttgcccaggcctgagtgcagtggtgcgatcatggctcactgcagtctctaccttccaggctcaggtgatcctcctgcctcagcttcccaagtagctgggactacaggtgtgtgccaccacgcccaactaatttttatgtgtttttgtagagatgaggttttacaatgttgcctaggcgggtctcgaactcctggactcaagtgatctgccaccttcggcctcccaaagggttgtgattataggcgtaagccactgtacccagtcatgtactcttaaactttaaacttgggagagacttgagttttatacctgtgttaatatgaaatgagaaaaccttactggttattggaacaaccagaattaacatgaaatgagttttctaaaaaccatattttaaaaagtaggttacatattcacatatttcaaagttgtgcaggtacaaaggggcataataatgaaaggtctccctcccacgccattgcttttcttgaatgctgccaatgttctggagattaatatatgggcacttacaaatttatatatagaaaagaaataacgggtcaaatgaatgagaaagtagaagataacacatttttattttttcccttttacttcaggcacaacaactaattctttagatctgagaggaatttgtttttaaggctctagatgtgaaaaaaggaatgtttaatagtttatcttaggttttatttgaattggtccaataagtagtttttaaaagcaagtaaactctttttgtcttttaacttcaagtttaaaccttgattacaaagagtgatcctagctctgctgggagaagtattatagatacgatctcgtttaaattcgtggttaccatcacatcatttcattatttgtttttatctgggatcaaactggaatgtgaattccacaggctcaggaccctctcctatttgtttttaatttcctgttgcctagcataggtcttggcctggcagatccagaaaatggcttattgagttaatgaaataactcagtaatctagacattcttggatcactatgttgggcttgaattgtttttcctgataacatttcttttggcaggagggtctcttgctatctgcagtagcatccaaaaaaacccaattttcaggattttgtcttgcagtgtgttactgttgtgtgcatcacagataattgttgtcaagacattaatgaatatctgatttgttactcacatgttatgtgagtactaatggcttgtactaatgacttttgcccattaataaaggatagcatctgttatcatctgaggtacattctgttgagagtgtttcaagtgttactctctttttttcccctttggaattggtgttttcctcttaacttacattgttaatggaagaagagattggaagtgactgagatagactatcattggaacatgagagtgccagctttacatgccgaaggatctcattttgcaaactcgtaatttctttcaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggtagttttgatatttgaatatcggggggatgcttttgggacccacttggtggtcatctagtctcctttgatgaatgaatcataaaatacaaaacagggtggaacttcatccatcctgtacaattcttgggtactggaaaacaggtttctgtaatagcatgctgtcagaggaaataactaatagtgattatgaactagtgaataattgcattttggggtttgttatttccttgcagttgttttgcagtagaaggaggtgggcggtattgctttttctcttgaatcgtgatgtcctttttttgctatcctattaaatgttgtggcttttaaccttttattctacgagcctcatttgtcctgtgttctcctcttcctcagagccaggctattttgagttatgctgttagccttaaaggggaacagaattgtcctggcacttgaggcttgtgaagctaacagatcacagatttttaaaatgactaattattataaaatacttagttttgcctcagaataatgaccttggtccaggtgttttgatttgtttctttagttgttaactgggaaccaagtaccagactttatatttaggcctggctgtaggcaaggggattaattagtcaatacttgttgagtagtttatggatcaaagatagtacaagtgtgttgtagtgaaacactacaaagcagtcttgtttaaataccataatgtggcttgacatttaattgaagcgcaggttgcaaacgtgaaatgtttttggtttatggaattgtcatttgaccttcagttcttttctaggttataccaaaagattacaagacaatggccgctttagccaaagccattgaaaagaatgtgctgttttcacatcttgatgataatgagagaaggtaggaacaggctctttcttaacactatttttcaagtaagggtgtgatcccaaattgttttcaacacttgttgcaagttttagagctcttagtaattgttcaccagatgacagtctggggtctttaattctaagcttaatgtttgaaattcacggaagagacatgtgaaatgtaacacgaggccttctctcttttgcagtgatatttttgatgccatgttttcggtctcctttatcgcaggagagactgtgattcagcaaggtaagggcctctggagcatgcaatattgttacgggagaggaggcgagactagaggatttttttggttttgttttattgaagtttgttttcctctttgatcctaccacttttttttttctgttatactattggatttttctatttcttttaaattaagattttctgagatggacagaacactttgtattgggaactaatatttttgatatagttttgtttataatttaaaggaaatgcctacattgtcttaccttgaatgtcatatagaattgcagaatcatatatatctctcatgttctttatattgttaatcacttttaaagtaagaaataaatgaaacacctacattcttcattgtatagccctgtctattaaaaaggttctagggcttctatagattcttactttgcctatatagactaacatggatctaactttttgactatcttcctctttttattttcttatttattcttgacattttatgagtgggtatatattttcattttgtggcagcctgataatttgttattaactatttgagttgtttctaatgtccttgttataaatgccatagcagttaataactacacatatgtagcttttaaaaatttttttcagaggtattcttcaccatgagatgactaaaaaaattttgattaattctatgacttttaaaatatgttgcttgattttctttcccctgaaagattgtgttagtttgtaacacactctcacagtaccactgtaaaataagtttattgttttgtaataattttgataatttctttctttaatttggaatatgcttctaacttttttaccctcttttaggtgatgaaggggataacttctatgtgattgatcaaggagagacggatgtaagatttaccaatatcaaaaatatgttgatcttaaaagccaatgtattgatcgcttccgagcaataagaatagtgattttgaagggtcattacatcccttgtatgtcagattttattaataccttttgccaagtatttttatgacacagagaaactctttaaaggtaattttctgttcagaactttgctggagtggtggtgaagaagtgtgtgtagctgggtgcagtggccgatgcctataatcccagcactttgggagatggaggcaagagggttgcttgagcccaggagttcaagaccagcctgggcaacaaagtgaaacctcatctcttaaaaaaaaaaaaaaaaaaagattctagacccagccattagctagcaaaattaatatacctttcttattcacaaatgaaatggggacaataatagcattgatcttttaggattattagaagattcagtgacctaatgcaagtaaaatgtttagcatagtgctcagcacggttctctaagtatctgtgactggtattagtgcttagctgacctttttcccttacatccttacagagtgcttttttcttatcagataattaaatcaggtaaattatagacactcttaactcatttaactcgtcagaaatcacctattcttctctgttgtgtactgcaaacataatatattctgttttttaaaacaaagttcaggattgtgaccttttaaaaaggtttgagggtttttaacatttaagtgtttgtatctagaaaataaacttttttgatgtcacttgcactttaggtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatggtaagagaccatggtgtttgagagtgtgatttagaattctcatctacgtaactaatgtttgaatattaccaaattaaaaagagaatatttcttttaatgagcaaatatttctttcttttaataagcgaatatttctttcttttaatgagcaaatactttgcattaagcccagcttagcattattcattatgccattttaggcagtgatattttagaacaaaaccttgggaaacaagatctggtatatatgtgctggtcatctcatgtttggaaatctatccatttgctggtaggcacatcttaatttacctagttatacccattacagcatgataggtgctgcttttaagtgcttaaagttatttggggccattcagaaataatcagcttccctaacctgtgaaagtgggttatcagtaatgtatatgtatgtcatgtcccctctcgttaaaggaataaacaaaatactaaaaccattggaactttctggtgatagtcagattttttgagaacgttgtgataaatttataggatagctttggatgtttaagtctcagccaatgcattggtcatttttaatggttttcttaaatttgtgcagtgtccatctgaccatttgaaaatgtacagcctgatgtactttgaaatttttctgcatttgggatatatagatagattagattagatagatagtcttgtccttcgcagcaacatggatagagctggaggccatttttctaagcaaaataacacaggaacagaaaaccaaaccacatgttctcacttacagttgggagctaagcaatgagaacacgtggatactagaaggggaacaacaaacactggggcctacttgagggtggagggtgggaagagggagaggatcaggaaaaatacctgtggtgtactttacttattacctgggcaacaaaattacctgaacaccaaacccctgtgacacccagtttacctatataacctgcacatgtacccctgaaccttaaacccacacacacaaaaaaacgcttatggcaaagataagtctaaattttagaaagattggttttgaagtgatgtgacagtctactggagaagaaactgaccatacagttagttctgcatttcctctacaggaatactattagtaaaaggaaacatagaatgtttacagctttatctcattgtcaaagaaggaagaggtaggacctggaactattggtttgaaataaaatattttactttctcatagtgggcctgaaaggaaattagggcctcacaatgctttggctttgtggacaggaattaggaactgtagatatggggtgaaatatctatatagctgggtaggggaggatatggtcctttttttatagaataaagacatgtcaattgtataggtgagaagccagaactaatggaggaatctgcatttaaataccagcgttgaacaggaagaacactaggattattgggttgtaaatgacctagattacttttgtgagaaaatattttcagagataaattgggttggcagtggcacaaaatcagtttgagagtaaacatggaaattggacattggtttaaagtgtgtggaaaaatatcttgagtgataggctcaggtataaaccggtatttcgactgtatttggaagttgggaaatgctttgtgaaatatgtcaacatactggttgcaaatgctaggaattgggcataatattggcggaaaataaaaatcacaagaatgtcatatcattcattacctgtaaaataaaaatgaattagttaaaattaaactttcctcattaaaagcaacaagctttgactttctggttttaaaatttatttgaaacttaatatttattattccatagcattatgtggtgataattacacgtcttggggatatcacttttgttatttttatttttagggaagcacactgagaaagcggaagatgtatgaggaattccttagtaaagtctctattttaggtgagttgtaaagtgtgttaactttgctagtatgtgagatacccctgaattagaattggatggacttgggaaaagccttctgaaagtataattgctactcattccccctgaaaagacagaagggctgaaagtccttctgactgtggacattcacagttatttcctctgtgacttcccgtctctcttgttccatcattgagttgattggttcagaaaagtgagtacttccaacaatacatttcctctgtggaaagattaggtatcatttgctggcatcctctgaaaacatgccagaagtttgttgaaatttagagtaaagcagattaattgaagatattcttttgtgcattttgttatgtggacttggagatgttagaacttgttcttcatgaaaggggaatggggatttttataaggtaacaggcttctgccattgtttattacagtgaatttttcacctcttctttgtcttttctttgaattggttacatatgctttgtgttttggatagtagtttggccttggggaataaaagttattttctagttctttttcataaagtaaaccaagaatttaaatagattaaattatttctatgaaactttggaacgatatggatggggaaactatgacttttgagtattgtagttgtaggtttgatttgcattgatggcaatcttcaggaatacttaaggattacattttcttattcccttgccatttggtacagttggtataaattaacctagccactgggctaccgaagtaaggatctaagggctatctgcaggcagtatgagaatcctgctcagactagaggtaattgaagacaggtaccacttttaatctgagacactactagaatgttgaatgggcatggctatttggttgaatctctttatactttctttttacctttataacagcaccaaataatacagagcaattattttgattcttgtctttcagagtctctggacaagtgggaacgtcttacggtagctgatgcattggaaccagtgcagtttgaagatgggcagaagattgtggtgcagggagaaccaggggatgagttcttcattattttagaggtaaagaactcagaatttaatacttgaattttagaggtaaagaactcagaatttaatactttaaaaagttgtacgctctaagagggaaagagtgggctaattctgaactatagctttagtttttaagaatacctgaccattttattttaaaattatcttttactttgaaatgctgttgtttggttttctgccaggtcactatatttttaaatgagtttgagtcagaattcttgaagggccctagacatgaaaagccaaattctaaaaaccatttaacataacaaactgtgatgattctgcactattcttgttaaaatgcaagtgtttgggctatttggcaaataaggattaaaggtaattatttaaatttgaaaaattactgtgtttgtatatctccacattccatggaaatgtatagcagatactcttgctaagcggatccaagtggcagatttctatgaatgtggctccatagttgctaattgattttatttaaatcaggggtcaggagactgtaaagggccaggtggtaagtaagttaagctttgtggaccatagggtttcattcgcaaagtctcaactcttgtcatagtgcaaaagcagccacaaataatatgtaaatgaatgtatgtggtatttcagtaaagtttgatttgcgaaagagacagtgagcttggatttagcccttcatctacagtttgctaacccaagtgtgcaccctttaagcaccttagcttgatacgaagaacctcgctagcaggagatgctggtaaaatagaaattgaagctcatgtggtgactaactttaaagtcattttttatcatatgcacacatttgcaaggtagttaaaattgcataggatgtttaaggtgccaccctgggtttgagagtgtttgtttgtttagctttttggtgattttattataggggtcagctgctgtgctacaacgtcggtcagaaaatgaagagtttgttgaagtgggaagattggggccttctgattattttggtatgtatgaattccctcacaataaatacatggtttctttaagtcacctctcagtgagatattgtagtcttccataattttgtcttctcctgaattttattttctaactgcagtcttttttggctctgagagggaaggtgtgagattttgatctttactcatttaatgaaattactgattgtctcatatctattgtcttctttctcagaagtgcactgctttaaggaaatgtttttcatagaagttagcctgttacccatctttgctttctccaggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttattcctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattcttaaatgaatcagtttttcttccctttctcctttccgtctttcctctctctgtccttccccgaaagtctactcgggtgggcaaaaatgaaaagggggaaagtgaattatgggatcggtgttttgaaagagcaatgtttattttcagtgcttttcagtttgtcaaagagtggatctcaaaatcttgcttaaagggtaattgagatgtagcagatttatttacttagtcatggaaagaaaaaaattcagtcaaaagctaaagatttccttttgattgaagacagattggttctgtggccttggaactttcccagacttaatggggaaacatcatttctagattagcatactctttggtttaaatttaatatatacatttaatgttacttagggatacttttatattttgcatatataaagcctcatatataaagccttatttctgatgctcttagatttctgaggagtgagatgattaagttgtattcattagtgtattggtatttcttcacatccagtgaaattggagatatgttgtatgttagaagagcattctttaaattgtgttgctttgaacatgtgtaccttttctagattcagtaatcccttccccccgtcctctggagtatgaaacctttagagtcacaataaaatgtaactaaagaaaatttctctgggttgacagtcctggttatagttgaattctctctaaacagtggcccaagtagactcttttttttgtttcttttattttttaatgatttaaatattgacatttaaaaattgaagtagcatgtcagttttcttcatactactttatctctaaccacaaataatagctgaaccttttgtacttatgttaggccctggcagtatatgtttagatgggctaagacaacatcaagaagcaatggctagataaccatttaatttgtccccaaaggtacgtttttatctgtctatttgtctatttatcgatctgtctatctaagatggtctcactctgtcacccaggctagagtgaagtggcatgatcactgcagcctctctgcttcccagattcaagtgattcttgtacctcagcctctggaatagctgggactacagatgtgtgccatcacacccagctagttttttgtatttttagtagaggtggggttttgccatgtagcctaggctggtctcgaactcctaagctcagtttgcccaccttagcctcccaaagtgctagcattacaggtgtgagccagcgtgcccgtctcccaaaggtattattataatagctatcagtaaacgctgtagctatgtgaatttcttaaatctcttccttcctatgctatgtgatttttacatagaaagcagcattgttatgtacatgtaccgctaacatttgtttcttgacataagttcagagctgtgacttcatctggactacacctaaaaccaaaaccactgagtaagattttttcattttgtgaaagttctgccaatttt

SEQ ID NO: 12139 - DNA, 54382 bp, Human
cgggagccagaggttgtagtgagccaagattgtgccactgcactccagcctcggcaacacagcaagactctgtctcaaaacaattatattgtaattctggtgcctgcagcaccaagctttgcagctgagagcccagacagtagggaattgggctcctcagggagtccaatatgctcacactctacccattccaagaggttcacccatatcatatcattcccctggacctcatcaccaaccctctgatatcattccttccaaatctttccccagcagagaaggcagatttttacatcacccctgaggctccctgaaataggagggttttctggtacagtcataaaagcgtgtgtcctctgatcatgcttaagcttgccatttttcattctttaagctctcttgggcagttcaggggctcaaaaagtcagaaaaacttgtccttgctactgccattgctgctgccacagccatcccacacccacaaagctgacaaatggacacacagcactgtcagagttttcttgtcacctggaaatgccacaaaaagatggctctgcctcatgtctaccttctaaacctcccgccagtgctttacatataggggacttaagctatgcccaggaccagagctacaaggaaagtgtagattttagttgttgataccctgcaatgtggggttgttgggggatggagaagggaggctggagaggatgcctgcctaggtgtaattttttttttttttttgaattggagtcccactctgtcacccaggctggagtgtagtggcatgatctcagctcactacaatctctgcctcccaggttcaagcaattctccctgcctcagcctctggagtagctgggattacaggtgcctgccaccacgcccagctaatttttgtgttttttagtagagacggggttttgccatgttggccaggctggtcctgaactcctgacctcaggtgatccgcccgtctcagcctcccaaatttctgggattacaggcatgagccaccgcgccagcctaggcataatatttaatgtatatttgaggtctgtctttggaccaccttcctctcttatcccagctaagatactgagagtacaaactcctggttataattctaactccgctgcttactacctgtgttaatccaaattctctgtgcctcaatactcattagtcactgtgccaatgaactctggaactctgtgtgactctgggagtgtgtcgcagtccatcaggtgagtagaatttctataaatcgaggactactggtgttggactatggtaggaagctccctggggtactgtaggaagcaggtgtctctatttagcagcaggactggcccacaggtgcttttacagcggctggcaagtgtctgctcatgaatgaatggatgggtgggagcggagtgaaggagattacgcccccaggcctctgatccccaggcttgtaaaggtgagggggccgcggtgtggcaagagggaaagagtgctttggtgtttacaggccccgacttgaactgaatcctggctttgccacttacgagcggcaggacccctgggtgagttcatttactcagtttcctctattgtagaatggagctggtaagacccatcttcccaaccccaccccaaatatttgtgttgagagtaagtggaacccttgattcgagaacctagtgcggccaacggactaggccagcggagaagcctaggagccccgggggcgggggatgggggtgcggggtcctggccgtgcaggggcagcacgtgggtgccaagcccgcccgccggtgccaagcccgcccgccggtgccaagcccgcccgccagtgcctctcgcgcgcactctggatccagcgccaatttaccccaatcccgtagcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcaggtgagcagggcagggggcagccgagggagcgcggggagcgggggccggggggccacgtacgaggggctgcaggcccagccggggcgggactcgccaatcctgcgtccccagctcaggacgcggacgctgatccgaagcccctggccccggctgggtcagcactgggagagcaggcccaggtccgcagcccgggtgtggggccctccccaaatccagggaaaggatcgtggagcggggtggggactgaaagccatttccttcccgtgaagaatttttatcagtgcaagtaacaaatatttcccaggcagcagttgtggggcggggtctagtggaagacgaataggcctagtggcttgacacatggaaaatacggaggcctgaaatactcatagactggctgaacaatctttggctaaaaatctcttacgtggagagttgcagtagtttcccaattgcctggccgcagttcctgttcccactccgtatcctcacccctgaacctccaccccctacctcttctccacacctcagcatctggaatgttcctttaagtaagaaccagactctcccctgctccgaccttccccgtagctttcctgtctcatcagaatcctataaacatttattaaggctcacaggcaaggcccctcgcaccccctactccggccacgctggcttccttgctgttcctggtgcacagccaagcatcctccagcctctaggcctttgcactgcctgtttcttctttctggaaagcttcttccccagataactgcatggggaaatccctcccttatcctgcactgcttcccatgccagcttatcagagcagccttcctcaaacaacctgcctatacaagaaaccccgctctgcccttgctgttcccccttccactacttcggttgtcaacatagtagttatcacctggtgacattttctttcttttcttttcttttttttttttttttgagacagattctcactctgtcgccaggctggaatgcagtggcacgatctgggctcactgcaacctctgcctctcaggttcaagcgattttcctgcctcagcctcccaagtagctgggactacaggtgcccgccagcacagccaactaatttttttatttttagtagagacagggtttcaccatgttggccaggctgtatgtagtctgctggaaaggaagtggaggcatagccaaaataatttctgggcattagtaagatggacaaatattattttttagtgattatgatggaggtttcttccagatgagtgaataagatgtagaatctgctccccaaagagctcactaattagtttaaaaagcagtcagggctgtgttgaaggttgggcaaggtggagtggcaagcccatactagctgaccctccagcatcaaagaaggctgtgttgatcctgatagatgagtggatattggtgggtacagagagaatgcagatattgcactataagtgtagagaaaagcaggtgacaagtcctggatggggtatctggagatattttggtactcactcattcattattgagcctggtcccttacctgtagtaattcatgctctattttggaaaatagttaaataagcaattttaataaaggggatgagcactgtggaagagcctgtgaaggagtgtctgggattttgagctgaaatctgtaggaagtagaaattgaccaggccaagacagcagaaggaatagagtcaagggcattttaggagggagcaggttggacagaggcagttgggagttcaggagagagtccatggtggaagcgtgcttttgagaaccatcattgtgtccgtggaatttaaagccacaaacctggaggtgatcaccaggggagtgagtccaagtagaaaagagcaagtctaaggaccgggcccagtgatgctagaatatctagaaaaggggaagttagaaccatagaaaaggttaaaaaaaaaaaaatagaagaaaagaagttgaagatgaaccaggaaaggagacagaaaaggagtagcttgtcagaacagaagaaaaccaggcccaggtgccatggctcatgcctgtaatcgcagcactttgggaggccaaggtgggtggatcacctgaggtcaggagtttgagaccagcctggccaacatggggaaaccccgtctctactaaaaatataaaaaattagccgggcgtggtggtgggcgcctgtaatcccagctactcggaatgctgaggcaggagaatcgcttgaacccgggaggcagaggttgcagcgagccgagatgccaccatcacactccagcctgggcaacaagagcgaaactctgtctcaaaagaagaaaactaggagagtgggtgtcttaaaagtccaagctaagacagggagaggagggcgaagaggatgcgcaaccccatcaaatgctggttgtaagtcaagtagagaaggactaagaactgactactggatttagtgatagggaagccattggtaacctcgacaaaaacaatttcagtggcttgtggagactgcatgattgaattgatgtttttttgtttgtttgttttgtttttgtttttttttttgagacggagtttcgctcttgttgcccaggctggagtgcaatggcacgatctcagctcaccgcaacctccacctcctgggttcaagcgattctccttcctcagcatcccgagtagctgggattacaggcatgtgccaccaccccggctaattttgtatttttagtagagatggggtttctccatgttggtcaggctggtcttgaagtcccgacctcaggtgatctgcccgccttggcctcccaaagtgctgggattacaggtgtgagccaccgtgcctggccactgaattgatgttttaaaaagatcatgatgtggctgtattaaaaaagaaaacagataataacaagtgatggtgaggatgtggagaaattagaaccctcgtgcattgctggtggaaatgtaacatgggtgtaaccactgtggaaaacaatttggtgattcatcacaaagttaaacagaattatcatgtgattcaattccacttatataccacaaatattcagaagtagggacttaaacagatatatgtataccagtgttcacagcagcatgattcaagatggccaaaaggttgaaataaccagtgtccattcataaatgaatgcatgaacaaaatatggtatatatacacaacggaatattattcagccttaaaaaggaaaggaattctgacatatgctacaacatagatgaaccttgaagacattttgctaagtgaaataaccagacacaaaaggacaaatactgtttgattccacttatatgaggtacctagaacaggcaaatttacagagacagaaaagagattagaaaatataaaaaattaaccaggcatgcccacacctatggtcccagctactcgggaggctgaggtgggaggatcgcttgagcccagagttcaaggctgcagtaagctgtgatcacaccactgcactccagcctgggcaacagagcgagaccctgtctcaaaaaaaaaaaaaaaaaaaaaaaaaaagagattagcagagactgaaaggactgggaaatggggagttactgtttaatgggtacacactttctgtttggaaagattaagagttgtggatgtggatgtggtggcggctacacaacattgtgaatgtacttaaaggcagggaattaatacattgaaaaatagtacatttcatgttatgtgtattttatcacaattttaaaacataaaaaaaaaaatcacaatggttgcagggtagagaaggaattgaagtagctgtcggaactggttctgagattctcacagcaatccaggaatgaggtggtgttggcttgaactaggatggtaagtgtagacatctttgagaagtagaaagattttggtgacaggacttagttatagattagaaggcagggagaggaaatgtcaaggatgcctcccagattgatggctttcagacttggatagatggtggactcatttcctgtgaaaggaaacttcaaaccagcttgggagaagatcatacatgcagtacaggatattttgagtttaaagttcgttcaagatgttcaagtggagaatttggatagagagatctgaaactcagagcggttcataaggaatatgtaaactttagtggtaatggcgtatagatgatcactgaaatcatggacgtgaaagaaatcaccttaaggagaaagtatagagtgaagagaagaggattgttgggccatgccagcatttagagctacaaagattaaggtgtgttaaaaagagtggcccggccaggcgtggtggcccacacctgtaatcccagcactttgggaggctgaggctggtggatcactggagttcaggagttggagaccagcctggccaacaccgggaaacctcaaaaatacaaaaattagctgggcgtggtggtgggcacctgtagtcccatagtcccagctacttgagaggctgtggcaggaaaattgcttgaacctgggaggcagatgctgcagtgagctgagatcatgttactgcactccagcctgggcaacagagtgaggccctgtctcaaaaacaaaaaacagaaagagtggccctggaagaaagaagatcaaaagagctttccaagaagaattaagaggtttacaggatctgatttctgcctttatggatttaccgattctggaagtttcatataaatgggaatcatacaatatgtgtgaaattttatgtctggatttttcattttgcataatgtttttgaggtttatccatgtttttgttgttgtggttgttgttttttgagatggagtcttcgctctgtcgcgcaggctggagtgcagtggcgcgatctcagctcactgcaagctccgcctgccgggttcacgccattctcctgcctcagcctcgcgagtagctgggactacaggcgcgcgccaccgcgcccggctaattttttgtatttttagtggagacgaggtttcaccgtggtctcgatctcctgacctcgtgatccgcccgcctcggcctcccagagtgttgggagtacaggcatgagccacggcgcctggcctatccatgttgtagcatgtatcagtacttcattttttttgtgactgaataatattccgctgtgtagatatatttcacattttgttcaccatttatccgttgatggacacttggtttgtttccaccttttggctattgttaacagtgctgctatgtacattcctgtctaagtctttgtttggaaacctgttttccaattctttgaaatatctaggaatggaattgctgagttttatgataattcaaagtttaccttctagaggaaccccagcaaccgtattgttttacattcttatcagcagtgtttgaggggtccagtttctccatgtcctcaccaacactgattttttattatttcctgattattattattattgccatactagtgggtgtgaaattgtatttagttgtggttttgaattccatttctttaatgactcatgatgttgagtatcttttcatgtgcttattggcgatttacatattttctttggagagatgtctgttcaagcccctttgcctatttttttaattgggtggtttgtctttttgttgttgagctgtaagaattctttatatatctggttactagaccctcatcagatatatgatttgtaaatattctattctgtagattgtcattttattttcttcatagtgtcctttgatacacaaacgttttaaattttgatgaagcccaatttatctctgttttcttttgttgcttgtgctcttgctgtcatagctaaaattttatcaccaaatccaaagtcatgaagatctcccccatattttcttctaagagttttatagttttcgcttgtacatttatattttatatcctctaaattttgtttataatttaaatcattgctatagacttggtccagtgagacctataaacagaggtcttaatttactcagtggttaaattgtcctaaaattgatttctgcaaaattcagaggggagatttttgggatttcatagagaaatctatatccatacagttaaatccttcatgatttcatacacttcacttttttaaagtattaaaacttttttatttgaagaatacgtggggagaagagaaatatatttcagcacttagatatgtagattatttccaaaatagtttaccactcaactagtcacttctgtgtaaatcagttttccctgaagcaagcattgtgttgttcccggctacaagcggtcctcattttgcatggtactgtgggaccataaaaatggccatgcaaagcaatcttaataatcaatggggaaaatgatgattgttccatgacctttaaaattctgctaaaatattaaaactcttaaggtcagttataaatgtagaaaaaaatgcaaaaaaaatttaaaaatatttagtacactgtaatttaaaacattaaaaatagaattaaagtgttttatttcattgtgaaaactaagtagtttgaatagggattgccttttttttctgccaagtgacttatgatactgagtaagcatcttttctattcatggcaaactgtcatactccttttaagtttgggtgagcttccagccttttattgcttgtgctttcaatgttgtgaagtatttctgtattcacattaaatgctctttagtgtgaagtttgtttttttttttttttaccgtcacttcctctgggacatatttatctttattgcaatcacttttcttatttgtgttgataagtttgccttcactaagctcctatgaatgcacagcaggaagaacattcccatgatcagtgacttcttctacaaatccatttatgtttgattcaaatttcacttccagtgttatcatttttcgttgctttgttggactttcatctttgttggccagttctttcgattgttcacttctataaaatgtcaggtggaggacaaagagacagtgtaactacgtgctctgctgtgagtgaactgattaacagatgcacagggaccaaccactggaagaatttgaaacaagtaacacgactggtcactgatcatgaagcatatctgttatttacatcgtgatttgtagactgaagaactagcagagaagtttgtacttcctgtaattactcagagttatactgtgctacctaaaattttaacctaggtttaaacaacaccagtttccttaccagtttcctttccttcctggtaaggaaactggtatttaaactaaatctaggtcactgaaatttgtgccatgggaaccgtgcacattgaggacctgcctacaccctacatgtttatattggtccaggcaggcttaatgctgactactgagaaataggctatctgaatttatatcaaatagtgaatcttaaagcacccaagatgaaaaattcgtgcacattgaggtgcttttaaaatctttgtcatttgacaatcaagcttaaaatgtatcttagagtaaccgaattttagaaataaagacctttaaaggccccatagtttgataccacagattatccagcatgtttataatgaattatttctcctccttcaatttcagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatcactcgtctgtctgaaccagcggttgcatttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggtacaagcggtcttccgaattttgcactcagaaaagtggcatcatctaagtcaattacatgcaaattttggggggctagttttttgtgtatgttaaatgggtcacaacacgacttctgtaaatcctcaaatctgtcaatataaatttttatgtgatgaaagcaaattgtattgttcctagaaagtgtccttccagttctaagttgaagtaaaagcatgtcatttgatgacaattcttgcaacatcttaaaacctgtgtgacaagtatagtaggttttatggcactcatttgtagtacgaagctggactgcaactatcgatccatcattgttgattctagcatattttccttgttttattttgtctagagatctaggtcacgggctgatcacccttagcttgagctctcctccgcctggcttccggcaggatccacgtccacacaggcacacttgcctgcccgttcatttcccagcctgtccccatgctaccactccacttcacttattatatatactctaaatctttttcttctcaacataaaacattctacaatcctgcagcctttttacttttttaagcaggtaggcaaacatgtagttgatactcagtggaagcacagagcagagttaaagagaaggaccccctttcactgaccagttgagttttttttctttcctttattttttaaaacaatttcaaaattgagatggggtttcgccatgttgcccaggctggtctcgaactcctgagctcaggtgatccgcccaccttggctgggattataggcgtgagccaccacacctggccaagttgagtttttaaagtagaaaattttggagaaattaactttattgtgcagtgaatgagaaagaaagaacggttttgaaagaaagtctctgcatttatgtgagactgagatgagtcctataaaggggagtctccccaacccctctgtctcctaaactgcattgggaaactcagattaaatatgttctgtgagcatcactcattcaaatgtctcttccattgtaggatacgggaagaagaaatggctggtgatctttcagcaggtttcttcatggaggaacttaatacataccgtcagaagcagggagtagtacttaaatatcaagaactgcctaattcaggacctccacatgataggaggtaggttgctataaaaaatgatatggcagccataaaaaatgatgagttcatgtcctttgtagggacatggatgaagctggaaaccattattctcagcaaactatcgcaaggacaaaaaaaccaaacaccgcatgttctcactcataggtgagaactgagcaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacctgcacgttgtgcacatgtaccctaaaacttaaagtataataataataaaattaaaaaaaaaagaaaaaagatatgaccttataaatgtaagctgggggaatggcaactctggcacaactttgaggtcaacactttagttttgtgagagtgctcttggcataaagtgggaaccatggtggagccacagttgactccagagagaaaagagggtagaaacctttccatgcttcaacaagacatgctgctttactgtttgaggtgactgcttaaatgctatattgaatgtaggttcaaaccctcaaaggtagtcataggaggtagtgatgactagagtacttgtttttagatagtgcatgagttgtataatattttatgaatattctctttgtaatcaggtttacatttcaagttataatagatggaagagaatttccagaaggtgaaggtagatcaaagaaggaagcaaaaaatgccgcagccaaattagctgttgagatacttaataaggaaaagaaggtgagtgattgccattttttcctaataaatgggaacttgcaaatacattttctgtttctctctgtgagaaaatactttcatacagagtaaagccattcacacgttcccttacattcaagagtttggttaagtcattcaccctatcttcatttctatgaaaccctgagtgagagccacacctaggacaccatgggcaaagctggataatagttatttagagtgtcagcagcagttaaatactctaaagttgaacaaatatggaaaggtgagaagtgttcagtgggaaatgagctgacaggttctgggaggagtcccctccacctaaatgaggaagtacagtaaaaaaggaaaaagagatgaaagtgattgtagggagaataatgtacagtggtcactcactctctgtggggaattggtaccaggactccctgtggatgccaaaattcactgatgctcaagtcctttatataaaatggcatagtatttacatataacctatttacatcttcccatatacagttatgcattgcttaacaaggagaatacattgtgagaaatgcacctttgggcaatttcctcattgggcaaacatcatagaggtacttacacaatcctgaatggtacaaccagtacacacctaggctgtgtagtatagcttattgctcctagactacgaacctatacagcatattattgtactgaatactgtagccaattgtaacacaatgtttagtattcatgtatctgaacatatctaaacacagaaaaagtacggtaaaaatacagtataaaagacaaaaggctgggcttggtggctcacacctgtaatcctagcactttgggaagctgaggcgggtggatcacctgaggtcaggagttgaaaaccagcctggccaacatggtgaagccctgtctctactaaaaatacaaaaaattagctgggcgtggtggtggacgcctgtaatcccagctacttgggaggctgaggtaggagaattgcttgaacccgggagaaggaggttgcagtgagctgaggttgtgccactgcactccagcctggggatcctatctcaaaaaaaaaaaaaaaaaaaaaaaaaaagacaagcaaaagtacacccatataaggcacataccatgcataaatagagcttgcaggactggaagttgccctgagtttgtcagcaagtgggtggtgaatgaatgtgaaggcctagggcattattgtttaccactgtagactttataaacactgtatacataagcaacattcattttatttaaattttttttcttcaataataaattaaccttagcttactataactcttttactttataaacttcttatttttaacattttcactctttccaaataacacttagcctaaaacacaaacgcggccaggcgcggtggctcatgcctgtaatcctggcactttgggaggccaaggcaggcagatcacctgaggtcaggagtttaagatcagcctggccaacacggtgaaaccctgtctctactgaaaatacaaaaattagccgggcatggtggtgggcacctataattccggctacttgggaggctgaggcaggagaattgcttgaactcaggaagcggaggttgcagtgagccgagatcgtgccactacattccagcctgggcgacaaggcaagactctgtctcaaaaaaaaaaaaaaaaaaacccacaaaaccacaaacaaacacatagtatggctgtacaaaaatattttgtttctttacatgtttattctataagcttttttctatttttaaaattttaaacttttttttttaacttttaaactttgttgtaaaaaattaaatcatggttgggcatagcggttcatgcctgggatgtcgaggagccatgattgtgccactgtactccagcctgggtgacagagtgagaccctgtctcaaaacaaaacaaaacaaaacaaaggctgggtgtggtggttcatgcctgtagtcccagcactttggtaggtcaaggtaggtggatcacttgaatttgggagtttgagattagcctaggcaacatggtgaaaccctgtctgtactaaaaacacaaaacattagccgggcttggtggcatgtgcctgtagttccagctactcaggaggctaggcgggaggatcacgtgcctgagaggtcagggctgcagtgagctgtgatcttctgactgcactccagcctgggcaacagagcaagaccctgtctcaaaaaaaaaaaagaaagaaaaaaaattacaacacaaacacacacatcagcctaggcctacacagcgtcaggatcatctacatcaccatcttccacctccagattttgtccctctggaaagtgttcaggagcaataacatacatggaggtgtcatctcctattgtagcaattccttcttttggattacctaccgaaggacctgcctgaggctgttttacagtttacttttttttttttttaagtagaaggagtaacttctaaaataatgataaaaaaagtatagtaaatatataaaccagtaacagttacttatcattatccagtattatgtactatacataattgtgtgtgctagacttttttataagactgtagaacagtagatttgtttacagtagtgtcaccacaaatgtgtgagtaatgcattgtgctgtaacccaggagtttaaaattatcctgggcaatatggcgaaatgctgtctgtactaaaaatatgaaatttagccattacagtggctatgacctcattagatgacagtaattttttagctccattataatcttatgggaccactgtcatatatgcagtccattgttgaccaaaatgtgattatgtagtacatgattatcctttagatcatctctagattacttataatatctctaatacaatgtaaatgctatgtaaatagtttttttgttgttgttgttgtcgttttttgagacagggtcgtactctgtcacccaggctggagtgcagtggcatgatcaagggtcactgcagcctcagtctccccaggctcaggtgatcctcccaccttagcatcccaactggctgggactacaggcacgagccaccacacctggccaatttttgcattttttgtagcgatggagtctcactatgttgcccaggctggtcttgaactcctggactcaagcaatctgcccacctcagcctcccaaagtgctaggattgcaggcatgagccaccacacccagctataagtagttgttatgctgtattgtttagggaataatacaagaaaaaaaatctgcatatatttagtacagatgcaaccatcattttttttccaaatatttttgatccatgattggttgaatccagggatttgaaacccgtggatatagcgagccaagtgtttacagagagcaggtaatggagaaccaatatacatgtgactggtatcccggaaaataagaacagagtaaatagtgcagaagaaaatgatctgaagagatttcagcagacaatgtttatgaaataaagaaagacttgactgcagattaaaacaacttaatagatacaggaaaatttagaaccacccagaccaacattgattctttttttttttttttttgagacagagtctcgctctgttgtccaggctggagtgcagtggcacaatctcactgcaacctccgcctcccatgttcaagcaattctctgcctcagcctcctgagtagctgagattacaggcacccaccaccacggccagctaattttttgatatttttagtagagacagggtttcactatgttggccaggctggtgtttaactcctgacctcgtgatccactcgctttggtctcccaaagtgctgggattacaggtgtgagccaccgcgcccggccccaacattgattcttatgaaagtactgtgctccagagatgaggaaagaattttataagcatctagagagaagaggaaaactatgtaaaatgtaaaaatttttaaaatttcatgctgtgcacagcaacattataaaccaggagatagtgtagcaatgcttataaaatgaaacatgaagtcatttacattttagacaccagagggccattctcagatttggaaaatgttgggaaaatttaggtttcaaggttctttcttgaaaaatctacttaaagatacccttctaaccaatttttttttaactcaagcaaaagtgcaaagtataattattaatgaggtagaaaattgagtcaagaagttagaaaaaacaaaaaacagaatgttttacccccaaaaagcagaagaaagaaaataacaatggttgaaattactataaaagaaataaaaaataaaaaaaaaagatcaataaaaccaaaagctagttttttgacaagattaataaaatagcaaaactcagccgggtgtggtggctcacacctctaatcctagcattttggaaggctgaggcgggcagataacttgagcttaggagttcgagaacagcctgggcaatatggccaaacgctgtctctacaaaaaatacaaaaaaattacccaggcatggtggtgtgtgcctgtagttccaggtgcttgtgaggctgagacaggaagatggtttgaacccaggaggtcaaggctgcagtgagctgaggttgcaccactgcactctagcctgggtgacaaagtgacaccctgtctgaaaaaaattaaaaaaatatcaaaactttggacaagatttttgtcggactaagaaaaaaaggtagagataataatagtagaaatgatgctattatattcatctttttcattaagttatgatccagtatacagctttactgtaatatctcttgccttgttttttgagattagaaagggtataacaagctagaaagtgttatagtactttccaaggacaaacaagaaaaagtgacttctttcctgttgttaaaatctatcttcgtcgatttttttctggtagagggagatacgtagtcacacttttgctcaaggtaatataataggaaaatatataacatccaagttgtctttcaaattgctcatttagtaattttattagaagaatgatttttaaaaggttaaatctttgttgtcatttatattaaacaggaattttttttctttgtaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaagggtaagacataatttggcttttctttctgtttcattgtatttaagcaataaagttggtttattttcgtgtctaattttccagaaatatgtgtccttttaagcattctgtatgcaaggttttacatgattgataagtaattggatttataatttgtaattaaaatgcttaattgctgaagccatggaacccatttaccataattgatcaaattagggtaatcctttatttcagagaagtagctgggtggtttagtctgtggaacacccaagagagtacagggtgccactgctcgaagaatacagaaatcttttcatcattgaggacatgatggtggtaactgtctgaaaacctctctgccacatgtatagaatcactcttcacccttgtcagatcagggagctctttgtccaggtatttgtccttcaaatttgattaaatgaacaaataccatgtatcagaaggaatgagctttagccctagactatgaggagaccgggatttgagggatctgatgagacagatgaactagagtttcaaagttactgagaacatcaccagtgagctaagatgtgtggaaataggataaagaatggattggaactgaaaaaagcagaaatcaaatgagtatgaggcaattgtttttcaactacaaccaaccagttaaagagaaagaagaaaaaaaatatctacatggcaaatagttcaaatcatcactttaggatacacttctatgaattgactcagctatttacagtcatggcttttgagccaaaaccaggaagagaaaaatgttatagtattcattggaatgaaatagtcaaaagtgaatctgtgagtcaatctcaataattaagagatgattttattttctgtagctcacttttttggtttctttaaattatgctaacattagatacctaaaagaaagaagaaatctgtttgcgggggggggcagtatctgaaaaaaataggagctatagaaatgatccagtcactcaacccagctatttaattcagggtctagcggggaagactcaccctgtttggatgtgtttctctcgatggcttccaacagaaacataaagcaaaaggagttcaaatactggaatcatttttcagtaatagatagtaaccctgtgatataaattgccatgtccattgttttatcccttaaaaatagttattatataattgtccaagtatccttgcctaaccacaaatgtccttacatctaataggaggagagtgtggactttagtatagggaatctgcactgtggggattttctcaaatttttgtgcacatgagcagatggcagacaatggtgaagttagagcagaatccatgctttgctcttcccctacactataacctcatagcttctcctgtggaagcctactttctctgctggctttttccttcccatttgagcacctctgaaaaaattcactggatctctttctttcttttctacctccgtatcttttgacctttggggaattaaaaaaaaaaatcaccacttagtgcctttgtgccagatctttcagcaaagcaacaaaaaattagaaattgcctggaaaatgcaagctcagatgtcagctgatcctgggtattcagagaaattggtcaggcatgttactgagggtttaaattatgcaagatatgaactataaatctatctaataaattggtgttatcttaagatctctgttaatatgttattttttttgaatcctaagttggatttgctatatttttcatgtttggataagtaccttctatgatttctcctagatttcattataaatgcaaaatgggacagaaagaatatagtattggtacaggttctactaaacaggaagcaaaacaattggccgctaaacttgcatatcttcagatattatcagaagaaacctcagtggtacgtattgcctttggattaaatttttatgttttaaaattccctctgaagttgacttgaggttagactgtgttaacattatgccaagacagccagtgatttagcaaaatgattcctccattctgtgtcgtaccgatgagccatgcaccatggggccatgaggcctcagagggataaaatttctggtggcaactcagggtagtttttaaactccaggctgggctgggtgtggtggctcacacctgtaatcccagcactttgggaggccaaggcaggtggatctcctgagttcaggagtttttttttttttttttttgagatggaatctcgctctgttgcccaggctagagtgcagtggcacgatctcggctcactgcaacctccgcctcccatgttcaagcaattctcctgcctcagcctactgagtagctgggactacaagcgcctgctaccgtgcccggctaattttttatttttagtagagatggggtttcactatgttggccaggctggtcttgaactcctgacctcgtgatccacccacctcagcctcctaaagtgctggggtttacaggcttgagccactgcacctggccgaactcaggagtttcagaccacctggccggggcaacacagcaaaaccatgtcgctacaaaaaaaaaaaaaaattagacgggtgtggtggcatgtacctgtagtcctagctactcaggaggctgaggcgggaggattgcctgagcctgggagatggaggttgcagtgagccaagattgtgccactgcacttcaacctagacaacagagccagatcctgtctgaaaagaaagaaacaaacaaaatatctgccctgtgatccagaaaagtaaaataaaaaataaaataaaatccagaccaaacatccaaaaaatgttattaatcttgtaattgtttatggttgtggatttggtaaatgtgttgaaataaatgtgatagtacatagaaactgagcctctgtagagaaataattagttgtatttaagcctactaagggatactttttctttcagaaatctgactacctgtcctctggttcttttgctactacgtgtgagtcccaaagcaactctttagtgaccagcacactgtaagtgtagacaaacaattgagatacttaacatattcatatttctgtctgaaagacagatttttatgtttaaggagaatttagggaaagaaataagtgataaaaacagaattaataaactaatagttacacccttttcttctagcgcttctgaatcatcatctgaaggtgacttctcagcagatacatcagagataaattctaacagtgacagtttaaacagttcttcgttgcttatggtatcgtattagtctcgaagcttcctacttaatcttatttttctgtgcgtttcctcatttaaaaataacttccagtattccaccataatttttatattttttatcttatgcactcttactaaatgataatacctcagtagactttttttttttttttttttgagatggagtctccctctgttgcccaggctggagtgcagtggtgagatcttggctaattaccacctccacctcctggttcaagcgattctcctgcctcagcctcctgagtagctgggattacatgcgcgtgtaccacacctggctaatttttgtacttttagtagagacggggtttcaccatgttgttcaggctggtctcgaactcctgacctcgtgttctgcccacctcggcctccccaagtgctgggattacaggcatgagccaccgcgcccggctcggcagctttttgactttttttaaaattaagttccattccttacccttccacacgtcacttctgtctttcctcactcatccttatattttagtatattcctatgattttgcttttctctcctaccaatgggataatatttaaagattcactaatatagttcgtttctgtttttaaaaattagaattaaacttaaaagtaaacttgaaatcagataattttttaggctggtgcagtggcacatgcctgtagcctgcagcacttgagaggccaaggtaggaggatcgctttagcccaggagtttgagaccagcctaggcaacatagtgagaccctcatcgcaaaaacaaacaaacaaacaaaaaccagacaatttttttgtgcacataagcaggcaatgttgaacttagagcaaaatccatgcttttggtgattagtgttacaagagtattctgttataaagaactacaaatcaataagaaaatggcaagcagctcagtagaaaagtgtacaaaatgtataaacagatattcagagaagagatacccaaatgggcaacaaatattaaaagctgctttactaggaatcaggaaaatttaaatcaaaacaattagatactattttaaactcattagattggcaaaaagttaagtcttacaatactaagtgttgatacagggcttgatgagagtacagacattgatggactaagaaattggtcagagagccatctagatatacaggaggaaggaaaacgggaaaggaagatgactgatttagtcatctgaaactatttctcattttcttttgttatagaatggtctcagaaataatcaaaggaaggcaaaaaggtgagtatcattatgcattgaacatattttgatctgaagttttatttcagacttatttattgttcttaatacttgtagagtattgtacacccttatttgagcagagtttcagaagcagaaagcttgaaatctataaacaaataattttagatgtgtcgagaaatctttgactatgtgcacatgctacactgtaaacataaagcactttgggggtatcgctagagtaattaggttaagggcattattttgtacaagactggcaaggaattgggctgttttcactgtagaagtgttttcaagagaagtgtattattttgcagacaagtaaggttaaaatagcataaaaacttggattaaaaaaaggtcaaatgctatgtcaattaactgaagagaaaggcaaagatgtaaatatagtcagaaatgacagtaagatggcagtaggagccattatgagccaccagtatattctgagcagtagatagatgtattgaagaaacatggttcttgatgtggatgcttggatggagagaagagagttctgcacatgaggtgccctcagccacgattactgtggcagtcaggagggatgaggagaatgtgtgagaaagactgtaaaggaagagtggacatgacttgagggaataggttccccgtagctgagtgaaagcatgaaggagaggtaaaggagaaaggatttgaagattgcttcactttgaacaggatgcagtcaagaaccatggcactaatggtgttaaggaagttaaggagttaagggcttagagagaagacagcagtttggatatgtttagttttaggtggtatttaaacttccatttgcaggtggcttatcatcagtaaggaataacagctaggatgagggtgtaaggagatgtacttcctgaggttttgagtctggaggaggaaaaggagaggttagtgacgcatcaacaatgagcactctaaggtggaaaaaggaaccagaggagggatgaaaaagtattagaggccagaggagaacggtaagtatatagttttataaagaaaaaagttggctgggtgctgtggcttgcgcctgtgatccccagcactttgggaggccaaggtgggaggatggcttgggtccaggagttcgagaccagactgggtaacatgaagagaccctgtctctactaaaaataaaaagaattagccaggtatggtggcacatgcctgtaatcccagctacctgggaggctgaggtgggaggatctcctctgagcccagaatttcaaagttgtagtgagctatgatcacaccactgcactccaggctgggagatggggtgagaccttgcctctgaagaaaaaaaaagaaagaaaaaggttaacattaacactaaataagttatatttgatttcaattttatttgagttttacattcaactcttaatttttagatctttggcacccagatttgaccttcctgacatgaaagaaacaaagtatactgtggacaagaggtaagattttaagtgctgaagaaagaagaaggggtaatgctgtcggtggatgtttttggtagttgtctgtgaaatggccatgatcctgtcagttaaaaatatttgaataagattaactacgcagggtaagaacaatagtcttaggcttatcattaagagggggcccaggaatgggatgacccatattatgattttgttcccaaaccaagaatctagttggttgttttgatactcccttagctttttagccctttctttaagtttttcatcagcgtttcttactaggcccaattggttgagataaaagcaacattcctcacccaatgagaggcagaggtcccttttttcagccattattagatctagtccccatctgttttggaggactactccagccgaggagtctagtttgtcttggactcttataatgcttcaggctatatcttctaaagaaccctgtaattctgtggaaagagctttaaagtatgttaagggagtggccaatctgcctgctcccaatccaagtctggaggttatatccaaggcagccattaaaggaatgacgtggatggccctcctcttcctaacgtattggatggatggaatgggcaaaggttggctaggaggaattagtccaatggagggagaaagataaactagggtacaggttccagtccagttagtggggagacaaagatatgtgttggtgccactcacacaaaaaataagcctttgtcataaatacagttggagatacagaaagaaaacaagtgaattaaagatgggtgttttttctttcctatggttcattactccaggtggtcaaggaggaggtcaaggagacacccactatagtagcgatataggaagagttattttttacacatttaatacgatttgatgttgcaccattgcattgatgttgagccatggataaaggtgggcgctaggggcagcacaaattaggccagaggcattggttgagggagaggctgcaaaacgaacaggttgcagaaatgctccattcgtttcaggtgatacttggtagtcaactcggttagtttgatggtcagcagggtgtttaacaatgataatgcggttgcattggttaggtttaaggatcttacacggaaatttccctcagaggctgaaaagcaaagtgaggcttgttgtaaaagtggggtgtgtttaattatgggcccttcaatgggagggccttgtggcttaaggcgttgtagggagttgtaataggtttgaaataatgtgttggcctgattgaccttggaagtgggataatcgccaaccagactgtcagctctttcaaaaaaggaagctcctttttggagtttatagattagggttacgttttctgttaaaaggtcatgaaggggtgtaggaagggatgtataagctgaagaagacagcgataaacacatccagcattctggagcaaaggaagagttagcttgcagcaagaggggttgtgtaaggtttatagaacgttctagtttgatagcagtgaggagtggttgtatcggtgaggttgatgtgattagggaatttagatagaaagaaacaacaaaaggaggaaaaagtttgggtaggaataaagtcctggaaggttccttgaagccataaatcccgtggaatagtaaggagctgatcaggatgtataatgagagtttcataaggataccactgaaggtctgtaacaaggctagttaggaagcaatgaaagtttgggagagaaagagacatagctgcttaggtgaatttctcttccttttcctccggcattcatgtgagatgaagggaagtggatcctgtggagacacaagagaggctgaaggtggtttagatttgattgtttggatgtgtagtgaagggaagtctgtgttcttgagagaagtataatgaaaccagctggggagtccctggagctttgctgctgtgggtgtagtgaggaagatctggtaaggccccttccatttcggtgtgaggggggaattgggggtagggctgggaccttttaccagaacccagtttcctgactgtaggaagggattaaaggagttgtattttgtcagcatattcccaaatgaaatggcagatgatatgcagaagaggagaaatgagaggggttgttagaggtggggcttgaccctgaggtggaacaaaaggagcatgagttcaaatacttatgctcaaaactcccatacatgagttcaaaggggatgagcattaaaggtttacgtgagagtgcccgaatttttaggagggccaaagctagaagtgtaacccagtctttatgtgtttggagtgagtacctggtgcgggtgatttttagaatgccattcattttttcaacctttcctgaagactggggttgataggggatgtgtagcttccaggtgattcgtagggcttgtgcaagtgtttgagtaatttgagaaatgaattcaggaccattatcagattgaaaagaaggaggcaccctgaacctggggatgatttctgttattaatttggaggtgacagtcgaagctcatttgttggttttcggaaaagcctcaacccatgccgaaaaggtatcaaccagaaccaaaagaaatcgaaccttttttactgggggcatatgggtaaaatcaatttcccagtcttgtcttggaaggtgtcccctggcttgatgggttggaaaagaagggagtccagtgttggaatggggtgaagctttctggcaaatagagcattgatggaaaatggctttcaactgttcctttatatctggggttatgtgtatgtgggaacttaagaaatgttgtagaggggaatggctagtgtgcaagaggttgtggatgtcccataacagagttgttttttgtttgtttgttttttgagacagattcttgctctgtcacccaggctggagtgcagtggcacgatctcagctcactgcaatctctgcctctggggttcaagcgattctcctgcctcagcctcctgagtagctgggattacaggcacgcaccaccatggctggctaattttgtatttttagtagagacagggtttcaccatgttgatcaggctggtctcaaactcctgacctcgtgatccgcccgcctcagcctcccaaagtgttgggattacaggcgtgagctaccgcacctggccaagagttgttttttcagggtcaggtaggactaatttgttttgtatgacagtatgggagtttgaattgtgcccccgctgtgagtagttgttgtatttggtgtttgggataaaaggggatatgttgtgtgaggggaaatagatattagagaattggatggttggttgaggtgtgttttgcccaatagtcagcctcacggttccctaaagaaatgtggcttttatctgattgaagtcctttgcaatgggtaactgcagccttttttggaagtagagctgcctttagtagacaatggattagttttccattaatgataggagttcccttagctgtgagatagccccacttgctccaaatttgggcattggaatggttgatgttataaacatatttagaattggtggtatatattaacttgtgtgttttttgctagggttaatgctttcattagggcaactaattctgcttgttgggaggatgtgcccaaaggcaagggggcagcctctacaactcttctaggtggaagacagtgggtatcatcacaatatctctcagtgactgcatatcctgcttggcggggagggttttttgatgcgctgccatctataaatcaatctggggctccctttatgtgagtggaagtaaggtggtaaaacacggcaagagaactttcaattagatcagagcatgagtgttggtcagggtccaaaatcagtgttgaagataaaagagtagcaggattaggagtgagcatctgtgaagagagatggagggttgaatgtagggcttgcatgtgagaggatgagatggaggtgagcgccttatggctgagcatatcttatagactgtgagaagaaaacacctgaagaggttcatagaatgtgagtttgtgcctcagggataattaaagaggctgtggacaaaatttttaagcaaaggggccaggttttgtaaatggggtctagttgttttgaagaatatgccactggttggagggaatctcccatggattgggctaatagtccaagggcctgattatgagaactgtgtaaatatagatgaaaaggtcttagggggtttggaaggcctaaagtgggggcctgtaataaggcacattttaggtgacagaaagcatgataaaggtctggggtaggagtgagtggttgatcaagatttcctcttgtgtgttcataaagaggtttagtgatagtggcaaaatttgctatctataatcagaaatatcccactaatttgaggaaagaaaataagtccctttttgtcttaggaaatgggacttgttaaatgccttgctttcatgctagtggaatttccctggtatttggagttatgattaatcctagctatgaaacgtttggagaggttaaattgggtcttccttttggatatctggtacccacattcagccaaaaaatttaaaagcctggctgtgtgttgaatacagtgttctagagaggggctgcaaagaagtaaattgtccacatattgaagcaaaacactgggttgtagaggtagttgggaaaggtccaatcaaagtgcctgaccgaaatagtgagggctgtccctaaacccctgggggaagacagtccaggtgagttgttgggagtagcctgtgtcagcgtcagtccaagtaaaagcaaaaaggttttgagaggaggaagatagagggataatataaaaggcatctttgaggtctaatgcagagaaatagctagtattgggaagaatttgcaatatgaggatataggggtttgggacaacaggacaaacagaacagtagtggagttatttgttgcaaatcctgaaccagtctataggagccatctggttttgtaattgggagaataggagtattgtggggagaatgggtggggattaaaatattggcagccaggccaggtcggtgcctcacgcctgtaatccgagcactttgggaggccaaggcgggtggatcacctgaggtcaggagttcaagaccagtctaggccaacatggggaaaccccatctctactaaaaatacaaaaattagttgggcatggtggcacacacctatagtcccagctactcaagaggctgaggcaggagaattacttgaatctgggaggcaggagttgcagtgagccaagattgcgccattgagctccagcctgggtgacaagagcaagactccatctcaaaaaaataaaataaaataaaatattggcagccaaaagttgggagatgatggacttgagtccccatagtccattaggggatattgtgggaccactatttgacatttaggatccttcattgaaatttgaattggagaatggtgggtagctaacatgggggagtcagtgttccatactatgggatttacagggctgaggaatttgggatttaagtctgtttgatatggaatgtctgaggaagggttctgttcttgagatgataataaataggggtagctttggtgtagggttgataaatgaatgattcgtccccgtttgtgtaggatgtcccttcctagtaaaggagtgggggaatgaggaatgaccaagaaagagtgagtgagggtgactccctgaaatgagcaatatagaggcagtgttttgtatggggtttcttgtatgcccttcattccatcaacagaaacaaatgaacattctaatgggccttggtattcagttaatgccagtagacttgccccagtatccaaaagaaaggaaataatcttaccagataccgtcccaattaacctgggttttgtggactcactagatgtgggggcgaaggatgccgggtaccctcagtcttccgttgtcagcaccaacagtgaagagatttcctcctgtaatgtttggggggcttcattatgagtggtacccgaatggggaaggtgtccctgttgagggcattccatcgtccagtgtccccaaagactgcaagttgggcatggtttggtgggaggccaggggataggacaagccttttcccagtgtccagggttgccttattgaaaacagactcctggagaggtgggggagtttccctttgggttattaggaggctttcgtataactgacttttggacagcagaggcaagcatctggtattttaaatggagatgtttgtcctcttgaattttttgttcctcatctctgttgttaaagacatggaaggtcgcatttaggagctcccaccaagatgtctgggggccctcctctaatttttgtaattttttccgaatatctggggtggattgggaaataaattggaggtagagaaaagtttgaccttctctagattctgggtccaaattggtatattttagcatagcttcagtgaggtgtgataagaaaagggcagggttttactggtgctcttgtgtaatttctctgagcttttcataattaactgccttatgggcatttttgtccatgcccgtgaggagacaggtaatcatgtggtctcttcacctgatgccattgtctccctgttggcaagtcccatctgggcctctatgggggactgcatcattggccactggattttgtataggggctttattatggagttattataatcaaggggaacttaaagtagtggtgcttgtccaagatggtaatgctcctgttctgtcaaagatggaactgtgaaatagaatttgtttaaagatgtgttgttcattcaacagaagtttcttgagggcccattataaggctaaattatacttccacccgaacagtttaattgacattgcactatccggcgcacgattgatcatgtctcttggagaagtaatatctagacagatccaaatggaatgtggtaattgtagatctttgtgatgcttatgtggatttctctgacatctatacaagttattaatattgaaaacaagtactcctgtaaatcagtgattaaaaaaaatacttctgtgggaattagaattgatccacttgtatctgttttctactttctagctccatatcagatttcacttgaaaaaaagtctactctgctgtagacaatatgtttggatttaaaatgaaatgtctgaaacgatggagacctgtttgcatcagtggggcgggtcattcaatataaaactttaaaaaacaatacggaatcaaaagtttattaagcacccaatatagaattggcactgtgctgggcatcaggtttatggtaggaacaaataaaatggtccctgttgtcatggagtttcatggggatgaccgactttaaataaataattacatgaacaggccaagcacagtggctcatgcctgttatcccagcactttgggaggctgaggcggatggatcacttgaggtcaggagttcgagaccagcctggccaacatggtgaaaccccatctgtactaaaaatacaaaaattagcaggtgtcgtggcatgcacctgtagtctcagctactttggaggctgaggcaggagaatcgcttgaacctggagggtggaggttgcagtgagcggagatcgcaccactgtattccagcctgggtgacagaacgagactctgtctcaaaaaaaaaaaaaaaaaaattgcaggaacaaactatggtcagagctgtgaaaggaaagcaatggcatggagagaaatggaagcaggggtgaggcgaggtttctctggggtcacagttgtggggaggcctgatggatgagtgggcacagagcagtgggtgctaggtggaaggaagggcgtatgagaaggtaaagatggaaaaggtgatgtgaaagttcgagaacagacagaagagtgtgtgctttgagtgcaatgaggaggggcacagtgccatgagatgaggatgctgagggaggcaggggcctcctcatttggcaccttataggccatttaagggctttttgtttttgtggaatgcaaaggttggctgttggagggtttcagcaacagagagacatggccagactcagttttcatccctctggttgctgcatggatcatagattggagtgggggaagagaggaagtggggatccagttaacgaggtactgctatggcctaatggaagcatggactggggtgaagatgttggaggcagaggaaagcgggtggataccagcaatgtgttttggaggtagaattgacaggtcttaatgatggaacacgaagcttgagggagaagagaaaaccaagtagaaacctaggcaggcttagagcgtatgcccatttctcttataaaagcttgatgatagtagctgtggagcacaatatagcagttcctttgaacattttgtatttgtgataggatttttatcatggctttttttttttttttttttttttttttttttttctgtttttttgagatggagtttcattcttggtcgcccaggctggagtgcagtggtgtgatcttggctcactgcaacctctgcctcccagattcaagcaattctcctgcctcagccttccaagtagctgggattacaggcactcgccaccacacctggctaatttttgtatttttagtagagacggggtttcaccatgttggccaggctggtcttgaactcctgacttcaggtgatccacctgccttggcctcctgaagtgctggtattacgggcatgagccatggcacctggacttatcatgacttttgaaaagccaggagttgactgtgactgcctggggtgatatgttacgttagacttgccctgggaggagtgagaggactactctttgtgagtcaagagtttctgccaagtggatctttcttattcagaaggagagaatcaaatttgttttattgtccatttcacaagtgacattaaagggaaaggagtggggaggcgggggggtgggggttgagcatgaaatgtcaaaataacagtggtttttatctttaaggtttggcatggattttaaagaaatagaattaattggctcaggtggatttggccaagttttcaaagcaaaacacagaattgacggaaagacttacgttattaaacgtgttaaatataataacgagtaagtagtaaatgtttacatttttttgaatggcaaggtacgctgaatctgcactattcttttttatgcttctctcttctttattagggtatcatttatttctttctgatcctcattaaacatttcattctaccaagaggagtttggcttactccgagatgatctcactttactgtggttatttcaataaaaatggatataccattgatcatccttttggtgctatcttcagaactgaagctatagagtcatttgctttaaagtgacatgcaaattcatgaaatgctccgtattttaaaaaccgtggcaccagatagaacctatcattacccacaaaataggtgatctttgagatgttctagtcttaccttcttattttatagatgaggaaactaagatccagagatgtgaagtgattttgtctaagataaaagctagatggtaattgttctctggttgtctgttattgtataaggcactgctccaaaatgcagtgcttaaaaacagcaatttattgttgtctctaatggttccatgggttgattgtgctcatctggacaattctcacttggggtctcagagggatttgcagtcagtagtcatctgaaaccttgactacagcctatcttaggctggatatccaagctggctagcagttgacaccggctgtgggctggaagttcagctgggactgtcaatcagaatacctccacatggcctccctatggggattgggcttcttacaacttggtggctgggtttcaagaaggattgtccccagaacaagtcatccaaaagatcaggagtgagtggcaaggcttcttttgacctaatctgaggagttccagaacgtcactaccatcaagttatattggttaaacaagtcactgaagccagcttagattcaaggggaggccaaataggccctaccccgtaatttgtcattctaggggatgagttctaagaatattatttagggactgggtgtggtggctcacgcctgtaatcccagcactttgggaggccgtgcaggcggatcacctgaggtcaggagttcgagaccagcctcaccaacatggagaaacccctctctactgaaaatacaaaattagctgggtgtgatggcgcatgcctgtaatctcagcttctcgagaggctgagtcagaagaattgcttgaacccgggaggcggagcttgtggtgagcccagatcatgccattgcactccagcctgggcaacaaaagcgaaactccctctcaaaaaaaaataaaaataaaaataataaaaagaatactatttagggaggctgaggtgagtggatcacttgagcccaggagtttgagactagcctggggcaacatggcaaaactccacctctacaaaaaatacagtaattaggccggtgtggtagccacgcctgtagtctcagctacttcagaagctgaggtgggaggaccatttgagcccagtaggtggaggctgcagtgagccatggtcacaccactgcactacagcctgggtgacagagtgagaccctatctccaaaaaaaaaaaaagaatgttattcaaattatggatttatatccaagaagatataaatcacagtgtcattcattaacagtaaaaagttagaacaaacaaaatatccagcagtaaagaaatgagtatatatattttgttctgtcccctgatcgatggctgttttgcagccattaaaaatgactggctgggccaggcatggtggctcacgcctgtaatcccagcactttgggaggccaagacaggcagatcacgaggtcaagagactgaggccatctggccaacatggtgaaactctgtctctactaaaaatacaaaaattagctgggcatggcagcgtacgcctgtagtcccagctacttgggaggctgaggcaggagaatcgcttgaacccaggaggcggaggttgcagtgagccaagatcgcgccattgcactccagcctgggcgacaaagcaagactcttctcaaaaaaaatgactggctgggtgcagtggctcaggcctgtaatcctaccactttgagaggccaaggctggtggatcacttgaggtcaggagtgcgagaccaacctgggcaacatggagaaaccctgtctctacaaaaaatataaaaactagccaagtgtggtggtgtgtgcctgtggtcctagctactagggaggctgaggtaggaggatcgcttgagccctaggggtggaggttgcagtgagccaacattgccactgcactccagcctgggtgacagagtgagaccctgtctcaaaaaaaaaaggaagaatctaaaataacattattttaggattgtcaaagtatcagtaattttttttatttttgcaaatttgtgtcatatactttaaaacttcttgcattaaaaaataaaattgtaaaatgattattcttcctcatctttgaaatctccaatttatttactgcacttagcatggaattttcttaggtcttggcaacacatccctgtaaagccttccaccatttcaccttctctgcataagttatcctctttgtgtatatttgccacacattgaaaatcctgaattaggtacttcacactgcctgggttacctagccttgctgcctaaatgtggtttgcttgtgaaatacaaagattttaacacaaatctaagcaaaacataatgtatgatttagctatgaaaaattgcactggctgggtccattggctcatgcttgcaatcccagcactttgggaggctgaggcaggtggattgctagatcccaggagtttgagaccagcatgggcagcgtggcaaaaccccatctctacagaaaatagaaaaaattagatgggtgtggtggtgtgctcctgtggtcccagctactcaggagactgaggtgggagaattgtttgaggctagaaggttgaggctgcaatgagccaagattgtgccactgcactccaacctgggtgacagagcaagactctgtctcaataaaataaataaattaattaaaatgacatcactggcatttcaagagtactacagatgatttttaaattgtctgatgcttggcattaagtcgctgccttttatttatttattttttgagacagagtcttgctcttttgcccaggctggagtgcagtggtgcaatcttggctcactgcaacctccgcctcctggattcaagcgattctcctgcctcagcctcccaagtagctgggattacagacatgcgccactgtgcccagctaaattttttgtatttttagtagagatggggtttcaccatgttggtcaggctggtcttgaactcctgacctcgtgatccgcccaccttcgcctcccaaagtgctgggattacaggcctgagccaccgcgcccggccactgccttttattttatcttgagagtgagaactgctatgttttttttcagtatgttcactttttccttttgaatgtcctggcttccattctaaaactatgtgagaaccacagcaatggtttaataagggaatgtagacagttgtctattacatgaggtgttttgtggttgttatgagggatgtacactgacactgccatgttccctgttccttttaactaggaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtaactaaaaataaattctcatagccataataggatggaaggaaattgttatttactatgtatgggccactggataaggctattaatcatcacgattaattatcacaattccctctgagagacactgttatctctccattccgaaggtaaggagaaagtgaaaatctcttccttgctcctcctcttgctgcagacttgctctcacaaccctctgttacatcctcagctgtctgcaaaatctcaggttcagctttcctgactccattgtttcatggagagccttgttcacgtgccggcttcagcgcaggctgtttaagtgtagtcttgtgaagagagttttaacatatagatgctgcatctgggggctccctcctcagctaccaacacttttctgtccctctcttaggctgtgattggtgtggtgccgtcagagggtctctttggaatgtaactataccacttatgctggggtggtggggagtgaaaatatttttaagaccacaagctgagatgggggcaccctcatgttttatgtcagttaagccattgccaaacaactggagatcctaaagagctggcatctgtctttgaaagtcacccaacctattatggggacagtcctctcactaaaatcctgaggccaatggggtcccattcattcattttctcctgccccacctccatctccatgtcgtgtaagtgagaacattatcatcagttcaggagttattgaccgtcagcatacaggacttcagctttcagcaaattcttggctacctcttcctgttttcaagctgacatatatacaaagaatataaatgaatattgaggctaacttaattcagaaaaaaaataaaacgtggttagcaaaaaaaaaaaaaaaaaaaatcaagcctccaatttatgtatcttagtaatttgttggcacttctcttagagtaccttccctattgttttaggtttgctttccctttactctctcctattagactattatccccgtgacggcaaggatatagtgtctaactgattttctcatctctaggtgcctttcatgcttagtagatcaatggtgaattaaaaggtttcaaagttactttatataataatgaaatttagtttcctgcattgtattcatgttcctatttctatctgttagcaatggtgattgcagatcttcagcaatgaagaatgggtggctcattttttttttcttctcgtttttttttttttttttttttttgagacggtgtctcgcactgtcgcacaggctggagtgcagtggtgcaatcttggctcactgcaagctctgcctcccggattcacagtattctcctgcctcagtctcctgagtagctgggactacaggcgcccgccaccacgcccggctaattttttgtatttttagtagagacgggatttcaccgtgttagccaggatggtcttgatctcctgacctcgtgatccacccgcctcggcctcccaaagtgctgggattacatgcgtgagccaccgcgcccggcctcttctttttttttttttgagacagagtcttactctatcgctcatgcgggagcacaatggcgtgatctcagcttactgcaatctctgccttctgggttcaaatgattctcgtgcctcatcctcccgagtagctgagactacaggtgccgcgccaccacacccagctaatttttgtgtttttagtagagatggggtttcgccatgctgcccaggctggtctcaaactcctgagctcaagcaatccgccagtctcggcctcccaaggtgctaggattataggcgtgagccaccgtgcccagcccagctcatattttataaattagctaaacaaataaagctctggacatccgggaacttatgattgaaataaaaaatggcctattatattttgattcaaatttgtttattatatttagatttctattttgtgacatgttttggggttctttttttttctttttttttttttttttgtgagacggaatctcgctctgtcacccaggctggagtgcagtggcgtgatctcggctcactgcaagctccgcctaccgggttcacgccattctcttgcctcagcctccccggagtagctgggactacaggcgcccgccaccacgcctggctaattttttgtatttttagtagagacggggtttcaccgtggtctcgatctcctgacctcgtgatccgcccgcctcggcctcccaaagtgtttttggggttcttaagaagataaggtataagcttttaaaaagttatgaaaaactttaaaaagttataaaaaattttttataaatttatatttattgttacttttaacatactgtgaattttatacccaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaaggtaagtggaaaatgtactttattaattgatatatatataatatagtaattttaaaatatatcttctcagctgggcacagtggctcacgcctataatctcaacactttgggaggctgaggcaggcagatcatctgaggtcatgagttcgaaaccagtctggccaacatggtgaaaccgtgtctctactaaaaatacaaaaattagctgggcatggtggcgtgcgcctgtaatcccagctactcgggaggctgaggcaggagattcgcttgaacctgggaggtggaggttgcagtgagccaagattgtgccactgcactccagcctaggtgaagagtgagacttgtctcaaaaaaaaaaattatatatatatataaaataagatagatagatatatatttttttctctagttttagaatagtggttgattgatagttatgagaaaatggtatctgaacatttccatgcaaataattactgtgactggcacagccaactggctgctctgcccctgttcctcctgcctcctctaagtgactcagctttatttgagaggcagaggggactctgttgactgttgctttaggaatatggttccctaatctctcagtcattactcgcgagggctgtcacagctactgggtccagagtctaatactgtcttggttaagcatttcaaccccatgattggaaaattgcggtaatcccggactgggaaagtgtatcatcccttagtattttcattttcctctggcttttatggtccggacaaggagtttccctattttttacttctcattaaaatgacagaaggtgagagacagaatagcccttcacagcctttcctccattccctattccctgtgacttgcctaagcctgtcacaagctggccgtcctgaatcctgtccctggacctttgctcatgttcttctctctcatgggacactcttctgcctgccccctttggttgtaattcctttactgagcctttcctgatcactctggaactgcctttttctgttctaggcagaagtaccttatttatgtggctatctgcttatcccacccctctaaaacagcaaggaataaggaatgaaacaaaaaaattccttgagagaaataagttcccatatacacagttgtttattgggctcagagaggaatgagtagcccttaaaaggtattgcttccgtggtctgcccaggggctggatgtctgatgcattggtgttttgagtctgtctggttccaatatgtctcttctacaatatctgaagttgttctttgaaggtggaacattgtcagaactatttcaaaaggataaatgtagagttggttatgctttcactttgggataaatcatacatatagttaaataacaaataagcacaattatttctatataaaataatttgcaaataaatgcagaagtgtaggcattaagctcctagtcctcagaatgaattagcaaaattctgactggtgcctacccacttacctgccaactatgccccacaccgtgtgtgccctgtgtcatggactgatcttttcttgtgtctatttgcagagaatttttactctggctgcagttgctcaagggtcagactttattattcttcttaaatttttaatttttatttttttttgagacaaggtcttgctcttttgcccaggctggagtgcagtggcacaatcacggctcattacagccttgacctcctgggctcaagcagtcctcccacctcagcctcccgtatagctgggaccacaggtgtacaccaccacacctggccatttttgtgtgttttttttttgtagagacagggtctcaccatgtttccgaggctggtctcaaacttttagactcaaagtgatcctcctgcctcagcctcccaaagtgctggcattccaggtgtgctccactgcacccggcctcaagctttgatactgagacttctttcatcttctataacttttcaggctctcactactacagttgttgatttctctcctctaagaaaagatacaatgaaggtgtacaattttggggttgtgttttgcaaaatagcagctgtaggtggttttgccagagaatggtctttacctaacacagcccctcttacaaaagtctccaagtgtttaccactttctgttggaatcttaggaactagaccaaaggcgctgggaagggacataggggtttctggagtgagggcttcttgtgcaaggctgcttctctctaaaatgttcagtctcctaaagcccaggctctggtcatcctcagcctgagcatcagtcctgttcctgtgcctcctaggtgaagtttgcatcccttttatatgatctacagccctatattttgtctaatcatattataactgattagacaaaatgtggcattattgtttttatttcttttgtgttttacaaggtctcactctgttgcccaggctggagtgcagttgtatgatctcagctcactgcagcctggacctcctaggctcaagcaatcctcccacctcggccccccacatagctgggactacaggtgcaggctaccaaggcaggctaatttttgacattttgtggagacaggattttgccatgttgccctggttggtctcgaactcctgagctcaagtgatctgccgaccttggcttcccaaagtgttgggattacaggcatgagccaccatacccagcttctttttcttttctttttttcttttttcttttttttttttttttgagacagagtctcctctgttgcccaggctggagtgcagtggagtgatctcggctcactgcagcctctgactcctgggttcacgagattctcctgcgtcagcctctcgagtatctgggattacaggcgcctgccatgatgcccagataattttttgtatttttagtagagacagggtttcaccatgttggcaaggttggccttggactgatgggcccacgctgtctgcccgcttcagcctcccaaagtgctgggattacaggtgtgactcaccacgccctgcccactttttcttttgaatgaactacaaaaagtgatctgatattttcactagatagcctcatccagcttagatatttacacggcttcacaaattcaattttctgtttcttagagtcaggtgatagccttatgtgggactagcagtttcacttgcaatcctgacatattcctacacattgcaacttgaacatagcataggaatgttttctctccacatccactccacatctgtctacagctttccatctgtattactggtgttaggctccaatctgactgttaattgaattctaatccaactgctaattgctgtatgagccgtcatctcaagctggcttctcggaagctcctccttcagccttccctgggcttatggtctcttccctcttaggtccttactaggtaggccctctcataagtgtgttatcccgtagagtctgtgtgtttagcctaagattgtattaaaagtccagccttttcaaaaatagcaaaatattaattttctcatcaactaccttcctgtttttgtggtctttagaatattggtcagtagagctgggtgtggtggcctgtggtcccagctacttgggaggctgaggtgggaggatcgcttgagctgaggaagtcaaggctgcagtgagccatgatcatgccactgaaatccatcctggataacaaaatgagacactgtctcaaaaacaaacaaaaataatattggtcaatacctcctatgggctgggcgtggtggctcatgcctgtaacctcagcactttgggaggctgaggtgagcagattgcttgaggtcaggagtttgagaccaatctggccaacatggtgaaaatctgtctctactaaaaatacaaaaaaattagccaagcgttgtggcacatgcctgtaatcccagctcctcgggaggctgaggcaggagaattgcttgaacccaggaagcagaggttgtggtgagccgagatcatgccactacactccatcctgggtgacagagcgaggctccatcttacaaaacaaaacaaaacaaaacacctcccttaaaaaaaaaaaatctgcttaaagaattgcatggataaaaatatttcagagctagttattagcttccagttaacttggtatgctttcatggtggaagggatgtgtttgttaagaagttgtcagaggcttggagaaaagacccccaagagaaattctgcacaggctaatctgcactattgttgggaatggacccattccgagaatctcaaagttggaagggatcttaaggatgtctgcttcagtccctatcagatcatggactcatatttgcaacatttcctcaagtggttgttcagccctatcttgggatggggaactgtctaactcccattctttggacaacactattaggatattaggatattttaaagctaatctttaggtcatttccaccctatagtcctggatcttttcccttggaccatgcagagtgaatccaccttgcacgtgacagcttttcagatattcgagggcagctgtgcccagagccacctctggtgtcagctaagaaatccttacttctgtccaggcgtggtggctcatgcctgtaatcccagcactttgggaggccaaggtgggtggatcatgaggtcaggagatcgagaccatcctggctaacacggtgaaaccctgtctctactaaaaaaaaaaaaaaaaaaaaaaaaaaaaactagccgggcatggtggcgggtgcctgtagtcccagctactcgggaggctgaggcaggagaatggcatgaacccaggaggcggagcttgcagtgaaccgagatagcaccactgcactccagcttgggtgacagagcgagactccggcccaaaagaaaaaaaaaaaaaaagaaatcctgacttctttcagctggcattttaaagacgagtcatattaaattccctgattttggctacctgtgtaagggtaaaggtcttataaataatataaaaatagtcttttctgtatataattaagacatgtggtaatagtatgttaagttggtacatgtaagttaaatttttttttttcatagccaagtaatatattcttagtagatacaaaacaagtaaagattggagactttggacttgtaacatctctgaaaaatgatggaaagcgaacaaggagtaagggaactttgcgatacatgagcccagaacaggtaaggtctctttcctgtctgtctatattttacttcttttattttgaaaattataaaaagagtagacactacttatataattaaaactgtacagaagtatatactaaaaattttccttaccattcttttctacccctattcttcttatcagtttattctttatccttttagataattttctgagttataaaaacatacaaacacaaatatacacccagattttttttacagaaacatatatatgtgtacattttttcaaggacttattttgttattttgtgactatatagcataatttctccatattagttcaaatagatctgccacattctttttttaacaactgtattatatttcaaaatatggagataccataatttaactatttttttaaatttaatattttttgttgttgttcttattttgttttagagacagggtcttgctctgtcacccaggctggagtgcagtagtatgattattgctcactgcagcctcaaaatcttgggctcaagcaatcttcccacctcagcctcctgagtagctaggactctagaggcacataccactgtgcccagctaattatttttatttttattaattatttatttacttatttattgtagagacaaggtctcactatgtttcccaggttgtatttaactattttcttatcgaagggtatttctttaggttgtttacaacttcatacacttagacattcctccttattttgggtcccaagaacaaataattctgtgataatctgtgttagacttcttgaggtaaagtgattgaatagattgaccagtgcatttcaaacttaattgctgtttaattgtcattctaaaaaaagtgattctaataatactgtcccgtcaaaatgtatgagaatactgcatcatcatactctccagtgatcagttttgggtagtgtgttgaattaggagtatcttgctattttagtttgtattttccagatttttagtaaggtatgccctcttttcatatatttacttaaacattttctgcaaattctctactcatatcctttcccaatttctcataattaagttctcattttcttgtgtatctgtaaggaatcttgatctatattgggtgttgatcccgtatctgttaactatattatagaatttttctccttgattgttacttctttgtttataatgacatttgtggtactgcagctttttttttttttttttttttttgagatggagttttgctcttgtcaccaaggctggagtgcaatggcatgatctcagctcactgcaacaacctctgcctcccgggttcaagcaattctcctgcctcagtctcccaagtagctgggattataggtgcccaccaccatgcccagctaagttttgtatttttagtaaagacgggtttcaccatgctggccaggctggtctcaaactcctgacctcaggtaatccacccaccttggcctcccaaagtgctgggattacagacgtgagccaccaaacccagcactgcagcttttaaattgtcatatttatcaatacggctgctaggtttctcatttttattttggaggcttctattacaagattatgaaaatattttttggttttactaacataaaaattaactgcaatttgaattaacttttgtttatgtatgagaaaggaatataacttgattttccccgtgtgaatatgcagttgcttcatcactacgtgttaagcagttaattatttaaatgctattttaaggaaaattcatagagacagaaagtggaacagaggttatctggaagaagggaggaatgggaacttcttgtttaatgggtatagcttctgtttggggtgatgaaaagttctggaaatagatagtggtgatggttatacaacattgtgaaggtagttaatgccactgaattgtaggcataaaaatggttaaaagggtaaattttatgttatgtctattttaccacaataaaatattattttatcatatataaaattcccacacattcatagatgtgtttctggactttgttctgtttccttaatttattttatatttctctctttaatattatgctatttagattattgtagcattataaactaggctttagtatttgaacagcaggacctgccacattattcttcaatttaaaaatgctctcagctattcacatttacaattccaaatgaactctgtaatcacattgtcatcttccataactggttttgaggttttgatagcaattgcatcaaatttgaggattcaggtgaggaacattgatatcttcatatatttgagacttctccaaaattggtattttctctcacttattcgagtcctccatcagtcagcttttgccagactatgctgtggtaacaaatgaccccagtttcttagtggtgcagaaaataccaagggtctatttcttgctcacatgacaagtcggcagcagtctggctggctgcagttttgctctgagtgtctccttcattccaagacccaggctgtaggaaaaatgctatctgagtcactgccgtcctcaaggcagaaagcaatggcagaaccttgtgatggcttttacatgttctgctcagcagtggcatacatcactaaacatcattgcccagagcaaaatgcatggcccagctcaaggcaatgagggtggagaagagtaatcctctcactaggaggccagtgcagcattgggggcaatcatacaacctacctcagagccacttttatactgttcaaaatctatatatatatatatatagagagagagagagagagatttattatgatatatatatatatatatatatatatatatatattttttttttttttttttgagacagggtcttgcttttcacccaggctggagtacagtggcacaatcatagctcaccactgcgcagcctcgacctccttggctcaggtgatcctcctgcctcagccccctcagtagcaggactacaggctcaaaccaccaacacctggctaatttttttttgtattttttgtagagactgggtttcaccatgttgcctaggctggtctcgaattcctgggcttaagcgatccacctgtcttgacctcccaaagtactaggattacaggaatgagccacggcgcctggtcatattgtttatatttttgaagctttctccagaatctgtattgcattttgctattaaaatgagattccatgcttgaacccgggaggtggaggttgcagtgagctgagatcgcgccattgcactgcagcctggtcaacaggaatgagactccatctgaagaaaaaaaaaaaaaaagaaaagaaattccatatctctaatttgttattagtgtagccgttaattttaaaaatatatctctttatttttaattgtggtaaaatatacaaacataaaatttaccaccttcaccatttttaagtgtatagtttagtggcgttaaatgtgttcacattgttgtgctttcatcaccaccatacatccacagattacttttcattttgcaaaactgaaactttacacccgttaaagaactcctattctcctctccctacagcccaatcaactaccattctactttctgtctgtatatttgactattctagatgcctcatgtaagtggaatcgtacggtatttacccttttgttactggcttattttactcagcataatatcctcaagatatatccatgttgtaacatgtcagaatttctttttaaggctgactaatgaattccattgtatgtatacaccacattttgtttgtccttttatccatcaatggacacttaggttgcttccaccttttgactgtggtgaataatgctgctgatgaacatgggtgtacagctgttgagttttaaatatttgtctcatatatagtctcattatttgaatgtgatttttttttgggttgattgcttttattttttaccttttgggttgtttatcctattttaatttctgatttgtaaatgcccgttaaagattattttgctgacaatacagctttcaaaatatctctactattttgtcatccaagaatagatatactgagctatctgatggtttgagagtctagaatggagaaggcatgtactttttccttttggggagccagttggcataaaaaatatagaacacaataggccagtggctctctttaacttcctgctgctttcagtatctcctgcatcctgtattgctgccctcacactatttggttaaaaacattcatcattgtactttactttttattatgtgtgtgtggtttttttttccatttaaaaaccttttgttggctgggtgcagtggctcatgcctgtaatcccaacactttgggaggctgaggtgggcagatcacctcaggtcaaggggtttgagaccagcctggccaagatgttgaaactccatctccactaaaaaaaaaaaaatacagaaatacaaaactacaaaaatgagccaggcgtggtggcacgtgcctggagtcccagctactctggaggctgaggcaggagaactgcttgaacctgggaggtgggggctgctgtgagccgagaccacgccactgcattccagcctggtgacagcgggactccgtctcaaaaaaaaaaaaggcaacattttgttgaggaacaatttatacagtataaaatgcacagatcttaagtgtatattttttcgttttgacaaatgcatacacctctgtaacttataagactataaagatatagaacattttgctccttcaagctcctttccagtcagtgcctcctccccactgatcagaagaaaccagcactctgagttctatcaccatagcttagttcttcccgtttttgaccttcatatgaatggaatcatacagtaggtactctttgtatttaatttcttcattcaaaataatatcttctggaaaaactttgttgctcataccagcagagaattcctttttattgctgagtcgtagtccattgtatgaatatgccacaacatgtttatccattcttctgttgtggtcctttgagttgtttccagttatggaatattgtgaataaatacgctatgaacagttgcaatgcaagccgcctactgggtgctattttaactgctttacccgctgcatctcactctcacaatcaaactctgtggttgatactgttgttatccttgttttataactgagattattcccatgttgatcgttaatttacacagaggattcagctattcggcggtacagatttgaacctaggcagtcagactccacagattttgctaataaatagacattgttttgtggtgtaagatgttttggtcaaataacttttttgggctttagaaggctggatatttatgtaaggagcataacaaaggtaaatctattttggtctctttagatttcttcgcaagactatggaaaggaagtggacctctacgctttggggctaattcttgctgaacttcttcatgtatgtgacactgcttttgaaacatcaaaggtaaaattatctcaaagaaagaattaaacaagaaaaattactgactaccaccttcagagtgctgctgcagacagttcttgccctcacgtgaggatgggcttgagcatattagtatctgactgcaaatgaaatatgaattttctgtctttcaaggtttggcagagaccaaacactttcttaaagaccaaaaactttgatcttccctggaaggtagtacatctcataagacttgtaagacttgtcagtcagtaacattttattgattgactgctttgtgtaagacactgtgctaagtgctgtaagggttgcaaaaataaacaagccttggctgggcgcggtggctcacccctgtaatcccagctttgagaggccaaggcaggcagatcacttgaagtcaggtgttcgagaccagcctggccaacgtggtgaaatctcatctctactaaaaatacaaaaattagctgggtgtggtggtgcacacctgtaatcccaactactcagggggctgaggcaggagaatcgcttgaacctgggaggcggaggttgcagtgagccaagatcacaccactgcactccagcctgggtgacagagtgacattccatctctaaataaataaatgaataaagccttgttctcaaggagcttattttctaaaagggaagataatataagagaatgccataagcattttaggagaaggcatgaagtctgtggaagcagctgggagggagatctttccagctgtagggacttaggtttcatggagacatctaagctgggctctgaaggatctgttggcttctaatagtccaaaacagaaaagttgattctagcatggaggcgggaatgtacagagtgtatttggggacagcaggcagtgtaagttgtattggagtatataagttacaaggaagtagtggttggtgaggctagaaagataggttgggctaacttgaggaaaaaatgtggaccttcttgcttagacagtggggagtcactaaaggcagtaggcaagtggatatcctactctttttttttttttttttgagatagagtttcacttttattgcccaggctggagtgcaatggcgcgatcttggctcactgtaacttctgcctcccaggttcaagcaattctcctgcctcagcctcccaagtaactgggactacaggcgtgcaccaccatgcctggttaatttttttgtatttagtagagatggggtttcaccatgttggtcaggctggtctcgaactcctgacctctggcaatccacccgcctcggcctcccagagtgttgggattacaggtgtgagccactgcacccagctggatatcctactcttaagctcaggaaagggaactttcctggagtcaataaccttatcctctgtaaaacagttagaagtacctatcacttagggttccaaaatgcatgaagggagattgtaaagatgatgcacttaacacttcatgtcgtaatgcaaggatggttattagattgggggtagtgtaggagagagggaatcctgcttgcttcttggctaaagagactttcccaaaaaatctggaaatatcctacatttcaggtattcctcagcctttagttctgtctttcctcccaagtaaataatttcctaatatacacctatcatttttttttccagtttttcacagacctacgggatggcatcatctcagatatatttgataaaaaagaagtaagcacttgaaaatcatcagaattttatttatttcaatgttttatttcttactattgactctcactgtcattgcagaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaagtgatgtacaaccacttcggaaaacaatttggcattatctagtaaagttgaatccatgtatacccacatagctatcaattctattcctacatacgtgcttacaagaatgtccataaaaccctgtttataatagccaaaagaacagggaacaaccataatgcacatcaaaagaagaatggattaaaaaaattatattcacacacaggagtactatatagtattgaaaacaattgaagtacagctaaatgtaataacgtaacacaatacaactctcagaaacataatgttaagcgaacaaagcaggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacacctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattatacaggggaaaatgtacctttacaatggtcaccacaataaccaagtgattcaatttagcatcacccaaggtggaacaccctaacattatgcccctcctgatgtgacttaagaattttacctatttagttttcttgcacaaagtgttaaactggaatttaatcatgaggaaattattagacaaatcctgaatgtagtcattctataagatgattgacttgggcttctcaaaaagtcagtgtcatgaaaaaaaaaaaaaggggagagacttgtaagatacaatgaccaaatgcaatgtttgaatctttattgtattctggatatttaaaaagacaaaagctggacgcagtagctaatgcctgttatcccagcatttttgggaggtcaaaaggggaggatggc

SEQ ID NO: 12140 - DNA, 68529 bp, Human
  misc_feature (1)...(68529): n = A,T,C or G
ccctttctttcttcttctcttttcttttcttttctttatttgaaacggagtctcgctctgtcgcccaggctggagtgcagtggcgcgatcttggctcactgcaagctctgcctcctgggttcatgccattcttctgcctcagcctcccgattagctgggactacaggcacctgccaccacgcccggctaatcttttgtatttttagtggagacagcgtttcgccatgttgtccaggctggtctcgaacccctgacctcaggtgatccacccacctcggcctcccaaagtgctgggattacaggcgtaagccactgcgtggccttttttttttttttttttttttaattttttagatggagttttgttctcattgcccaggttggagtgcagtggatctcagctcactgcaacttctgcctcctgggtttaagcgattctcctgcctcagcctcatgagtagctgggattacaggcatgtaccaccatgcctggcttatttttatttttatttttttgtatttttagtagagatggggtttcaccatgttggtcaggctggtctcgaactcctggcctcaagtgatctgcccacctcagcctcccaaagtgctaggattacaggcgtgagccactgtgcctggccgtatataatttttatggaggtcacatgtataaatgcatagaaaaagtcttatgttgtccctaccaaactgataagaaccctcacttctggggaggacctgggatcgaggctggtgactttatccttaactatcatgtttcaggtttttttttttttctgagacggagtctcgctctgttgcccaggctggagtacagtggtgcaatcttggctcactgcaacctctgcctcctgagttcaagcgattctcaagcctcagcctctagagtagctgggactataggcagccaccaccacgcccagctcatttttgtatttttagtagagacagatttcacccttttggccaggctggtcttgaactcctgaccttgtgatctgcctgccttggcctcccaaagtgctgggattacaggtctgagccaccgcgcccagccatgtttcaggtttttatagggaggatgtgtttgtgttttacttgtataattaaaatttgagaataatgaaaaagattagcttagtttcagctcattgatgatctacaccagccttcccagaggtcccaggtgaacatacaactgtggaaatgcagtgggcttgctgagaaagggcccccctgcccacagcctgctggattgttgctgttcctcccatctagcatctccattatgtgatgaggacactcagcaatgatgacgactttttttttttgagatggagtcttgctgtgtcgccaggctggaagtgcagtggcacgatctcagctcactgcaacctctgcctcccaggttcacgtcattctcctacctcagcctcccgagtaggtgggactacaggcacgcgccaccatgcccagctattttttgtatttttagtagagacagggtttcaccatgttggccaggatggtcttgatctcttgatctcgtgatctgcctgccttggcttcccaaagtgctaggattacaggtgtgagccaccacatctgaccagcactgatgatttataagccagggacctttttatttttggcccactgccaaaatttgggtgtgaccaaaactgtcatttgggtggtcgcttaagtgtccttcaaggtgattatctagtcagcccgtgttccacttgaggaaaatgaagatgagaggtcagttttagacatgacacagggcagctgaaaggccgggaaaggttttatggtaaacaaggattacaggaaaagctgggtgtagatgggtcatttattctttgtctaaggattaatcagtccttgttctcgctaatggctctgccatttttctgtgtgttaatccaggaggaattttgttgtcagagaataaaaggaggttgtccataattgactttaagcagcaatcagtaaaacattgagctcttcagctccgcctttcttgtaagtttatcatttcttcttagtggttgtgaacatcatgtgataatgtatttccataaatttaggaccctgaaatccaactgaactttctgtttgtccatatatatctaatatttaaaaaatactattaggatggaaactaatttccttcagctgaagtcatttcctttaaaaaaaattcattcaggtatatttcatatcatatggcagtttttaataagtattatatccttctaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagtgagttataattgtaccattaaaatctatattcattatgtgatgctttaaatttgataatcagattagcagttattgttaaatttgaaagcagatattttataattataaaataattatatctttttttcatcatgtatcttttttttcatcatgcaagatgttcatgtagtatgtctcatctgtatatattaagggctattctttttgtaaactatcccatctccctacatattctttcagcagacatttattgagtgccttataagtgccagggattgtgttagatgctatatatatatataattatttgagtataaagcacactggggccgggcgcggtggctcacgcctgtaatcccagcactttgggaggccaaggcgggtgtatcacgaggtcaggagattgagaccatcctagttaacaaggtgaaaccccgcgtctactaaaaatacaaaaaattagttgggcgtggtggcgggcgcctgtagtcccagctacttgggaggctgaggcaggagaatcgcttgaacgcaggagggttgcagtgagctgagattgcaccactgcactccagcctgggcaacagaacgagactctgtctcaaaaaaagaacattaacatgtatattatatgaaataacttatagcttatagtttagtataattttagatatttattaaacaaatattgtacccctactactgtgtactagaccttgatctagatgttggggattatcagtgagtcaagatccatcctttttatgaaatttacattttagtatgggagccaaacagaaatcaagtcaacaaaacaaacaaggtaatttcagatgatgtcaatgctatgaagaaaactgtgtgaaagtaatgatggggcaggttgttctgctttagcatgtgtgctgaagtgcttttaaactgaagggatggtgtgtgagttgagaaacctgaatgagccaccaagtgaaggtctggaggcagaacccccccaagcagaggggacagcagattccaagcctctgcagcatgcaggaggagttcttggtgtgtctcaggaacgtgggctggagtacagagtgtccaaggaagatggctagtgaggcaggcagagcgggactgcatagtccttcctggggagacatggggttggggtgaggggctaggtaatggattgatgtaacaatttaatgttgactttaaattttataagaagaataactttattttattttactcttatcgatttacgagtctccttaaatagtaaagatactgggtttcttctattactttttcagctttttccccctttctcttctctaggcggctaggggtggagatgggcaaagtgcaggtttaccaggaacctaacagaggtgagctatcttgggcatgtggaacattgacctttttgtgaaatgtggcatattggctccgtccttcatcctttactattgaaacgatttgattcagttgtacatttccattagcaagaagtcaggcaggcaaggtagaacagagtggttttttagctctcactaataccagctagatatctaaccctggtgcaagtcatttctggggcttgaactgcagttctgagacttcattcagtaaaagctgcagacatatttgaaccagctggtcaactgaatgaacatgagctcaactgttgcttaaatttatgtcaccttaggaaggatgagtaaatcctgtcaccttagacaggatgactaaatcctgtgtgaccgcagttttagttagtctttatttgcacctaagctgccttgggttagacttcataaaatattgttaagaaatactttttgctaattgatacatgtcattacataattctcccaagttgtaaaaagaagtgttatttaacctttgtaggtccaggtgtgctggctcatgcatctaatgccagcactttgggaggctgaggcaggcagattccttgagctcaggagttgagaccagcctgggcaacacggcaaaaccctgtctctactaaaaatacaaaaattagccaggagtggtggtttgcacttgtagtcccagctactagggaggctgaggtggaaggatcgcttgagcccaggaggtggaggctgcagtgaagtgtgatcataccacagagtgagaccctgtctcaaaaataaataaataaataaatagaaagtgatctttgtaatttctttagcaatggtggatatttgaaattattttaggccaggcgtggtggctcacgcctgtaatcccagcactttgggaggccgaggtgggcggatcacctgaggtcaggagttcgtagaccagcctggccaacatgatgaaaccctgtctctactaaaaatacaaaaatttgctgggcttggtggcaggcgcctataatcccagctcctgggaaggctgaggcaggagaatcgcttgaacccgggcggtggaggttgcagtgagccaagattgtgccattgcactccagcctgggggggaacaagagcgagactttgtctcaggggaaaaaaaaaaaaaaagaaattattttagcaggagcgatggacagcttgcatgggcttgagagttacacaccttatccttgacaagttatttaacctttctaaactataaataaactgtaaattagggctgttttgaggattaagtgggataacttgtgtgcctaccagtttttggcacacagtaggtgctcaatatatacttattcctgttccttttccactagaagatttaaaaaaacattttttttttttttttggtagaacaagggtctcattatgttgcccaggcttatctcaaactctgggcaaaagcagttctcctatttcagccccccaaagtgctaggattacaggtgtgagccaccaggcctggcccctctacaggattttatcaaatatttacatattataaagcctacaggaggctttgataaaaaggcacaagttttgctgttcccatgtttatctccgttcctgcctcttttctgtctcccaagatccctatgtggcgtcagtagggaaaaagtataattaaactctgcaaggagagtttggagaagattcttcctctagaggggattgaatgatgttctttgtctggagtctaggagggaaggtgaaagggagaagcagtggcataagactccaggagactggtccactctccaagtttctgaataaagggagagaaaatacttggtgtttattgggaaggaaggaagtaatatttgtgaatttcttactgttaccagatactgaaaaactgagttcaggagttcagggattgatgttaggtacgaggtccagtttgaatccagatctccctgactctaaagctcattttcttttcttttcttttcttttttttttttttgagacagggtctttctgtgtcactcaggctggggtgtagtggcatgatcagggctcactgcagcctctgcctcctgggctcatgtgcttctcccaccttagcctccccagtagctggtactacaggtgggcaccatgctgccaggctattttttttttttttttaaatatggagtcttgctctgtcacccaggctggagtgcagtggggcaacctcggctcactgccacctccgcctcccaggttcgagtgattctcgtgcctcagcctcccaaagtgctgggattacaggtgtgagctacacacacacacccagccataatttttttttttttttgatacggggctttgccatcttgctcaggctggtaaagctcattttcttaacatcataccacatttcttttgtaaacttggattctgttttttccaacatttttttttctcttatcctcacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaagttaccatgctcggagtggtacagcactcaactgtttgtatatataaggggtgagaattatacatttacttatttcaagtcagaaatgtaattctctcttaaagctgtgttttaaaaagtgattaatggcagtatgtgtattatcccttgtaacatctaaagcctactgagtcttataacagtttgagttgccatattctattacattagggaataatacagatttttttgtgtattttgaaaaatttgaactatatgcctttccctctcttctttttccttttcctgccagaaacaagagtacaaattcaagagtctgtgaggggaaaagatgttttcatcatccaaactgtttcgaagtgagtatccagcaaaagtgttgctttctgggtttcagtttaggcatgagtgtttaaaataatgatagatggctagccaggaagagttataatagtcttaaaattagtatatcttaccaatttagaatttagaaaactaagttttctgacataactgctgacttttacatgttctttcagtgtttttccttctttctttctttttttttttgagacaaagtcccactccttcacccaggctggagtgcagtggtgcaatctcagctcactgtaaccacctcctcccaggttctagtgattctcttgcctcagcctcccgagtagctggtactacagttggcgccaccacgcctggctaatttttgtatttttagtagagacggggtttcaccatgttggccagactggtcttgaactcctgacctcacgcaatctgcccgcctcggcctaccaaagtggtgggattacaggtatgagccaccgtgtccagccactcagtgttcttaacgggtggaaataaccaagtattggagtagaggctctttttttttttttttttttgagacagaatttcactcttgttgcccaggctggagtgcaatgacgcgatctcggcttaccgcaacctcagcttaccgcaacctctgcttcccaggttcaagcaattctgcctcagcctcctgagcagctgggattataggcatgtgtcaccacgcccggttaattttgtgtttctagtagagacagggtttctccatgttggtcaggctggtcttgaactcccgacctcaggtgatccacctgcctcagcctcccaaagtgctgggattacaggcgtgagccactgcgcccagcctggagtagaggctgttaatgataatagtatacattaagtttcctaacaattaacagccagaattttgtaaaacttgcaaggaagcatttctagttccctcctctccccaaaagaaacagaggctaggggaggagacctttcttagttggggttctttaagcttttattgcatataaaagtgatcattatttactgttttattacataaattagctgagaggataaaaaactgtactgaaggaatgtgtattcctgtctggtgtgacctttgacacacctgtgttctggaaattgtttggtcacatatgtttaagctaggtatagaagattcaatgcagcaaggctgtctctggcactctggaagggagggtgatcacctggagccctactttttttttttctttttcttttttctaagaggtagagtcttgctctgttgtccagtctggagtgcagtggtgagatcataactcactacaacttcaaactcctgggctcaaactatcctcctccctcagcctcccaagtagctgggactacaggcatgcaccagcatgctcacctcgttttttcattttttgtagagatggaggtctcactgtattgcccagctggtctcaaacttttggcctcaagtgatcctcctgccttgacctcctatattgctgagattccagcaatatagaaggtgagcctatcacacctggccttaaagccccactttccattgtgtgtttgtccacaaatgtccctaaatgcttctgtgtatgaagttcttcgctcagaacaatttttaatgtctagaaatcagtttgtctagtgcattattttttagcttagagagtctgaaagttgctgcatgcttaatttgtgtatatacatatataaaaccaacgaaagggaaaaagaaggccatttcgggagactttagtcttggaacacacatttttttcacctaaattttgaacattttctctcctggtctttggtttattgggatgaagtcacaaaacccccatctctcctgggaagaggagtggcaggggagacctgtccttgcatcctatagccctggcaaacgggtgtgctctgaaggaggaagggtgtggagggcctttgccacggtgccctagcttcaccttctgctgtgacacccaggattctcagcagagctggaggtgggggcacggagcgccaactgcccctgctgctgctgtcctctttcccctttcccacgtctgccaccaaaccagggtggaagtggaggactcacctgtgcccacatcttaaccctttacctccagcatcggggtagggaaggggcgggcacagaacaacttaaacggcttctggctccttggtttctgtgtctgtggtacttttatgtccttacagacaagtgtgattccattggataaatgcacagaggttgtgtggattacccaaggggatgggtaggcattgagggcacccctggacttagaatttaggacttcagaagggtgactgctgatccttctcattttcaagtccttctggttgtttatttttgtacatttcaatacttatcctgtgcccctgtcttttgtcagtttcatattcctctaatcagaatcactcagcacccctttcattttctctccgtgtctcattttgcattgttccatacctgacataagcttgtgttaactcgggttctcagtcttgtccatgttgcagagtctggacgtcatggtcttctttgtgaaataccatgaaataacatttagtgttgagggccagatgtggtggctcatgcctgtaatcctagcactttgggaggtcgaggtgggcatatcagttgaggccaggagtttgagaccagccaggccaacacggtgaaaccctgtctttactaaaaatacaaaaaattagctgggcatggtcatgagcgcctgtagtcccagctactcaggtggctgaggcacgagaattgcttgaacgcaggaggcagaggttgtagtgagctgagatcacgccactggattccagcctgggtaaaagaacaaggctccatctcgaagtaaaaaaaaaaaaggctgggcgaggtggcttacacctataatcccagagctttgggaggccgaggcgggcagatcaggagttcaagaccagcctggccaacatggtgaaaccctgtctctactgaaaatacaaaaattagctgggcgtggtgatatgcgcttctaattccagctacttgggaggctgaggcatgagaatcgcttgaacccaggagacagagggtgcagtgagccaagatggcgccactatactccaggctgggtgatagagtgagactctgtctcaaaaaaaaaaaaaaaaagcctgtaatcccaccactttgggaggccccaggcgtgcagatcacctgaggtcgggagttcaagaccagcctgaccaacatggagaaacgctctctctgctaaaaatgcaaaattagccgggcatggtggcgcatgcctgtgatctcagctactcgggaggctgagacaggagaattgcttgatcctgggaggcggaggttgcggtgagccgagatcatgccattgcactccagcctgggcaacaagagcagaactccgtctcaaaaacaaacaaacaaaaaaatgatttagtgttgtcagatacatcttatacttcattttactacagattagtgctagcactaaaaataaaagagaaatttaaaattaagaaaattccatccattaactgaagttttcctgtatttcaaacaagactgtccttatctgagttcagtaatggaaagccttgttcctccactcttatccttcccatagaatacttttctgaaaatctttttttttcctaagttaattaacagggtgaaagtctcttttaactcatcagatgtcagacttgttgtatagtgacagagaacctactcacctgaatgttctgtgtttccattcactccttctttcattaacaaatacttattttgaatgtctacaatatgtgaattacagttagttacacgtatgcaggatgcctccatgattaaaacagagaaagtccttgtccttgtggagtttatattccagtggaggaagacataaagtgagcataataaagacatagattatctagaaggtgatgaatggtttggaaaaaaataagacagcatggtgagatgatagtggtgagagggcagagagaggcagacagggtaggcctcattgtggaggtgacatttgaacagagactagagaaggtgagggagagtcaggtgactaggtggggagaaaagcattgcaggcagtgggaacgcctagagcaagccccttagcggtgtgagctgctgtgggaggactgaacagggtcaggtgtggccaggcaggaggggaggggcagatcctcaagtttggactggagttgtaaatttgagagttgccaccatctatgaagctgtgaaattagatgagaagcccaaaggacgagagggaacagaaagagaggacacatgagcaagtcctgggacgtgaggctggggagaagaggaaccagcaaaagaaaccaagggtggaaggaggacaccagagaggggcattctggaagccaagtgaccgtggacatggccgcatggaggccactgatgacctttatgaaaacaaagcttcactggactatttgggagagactgagagtagataaattggagatagtgtaagatgtacagcaaaggggagcagaggggagagtggttatgagtcgtgttaatggaagtaacagaatgtttgtggccgatgggttatcagtggtggaggcaggagaggagagagaattccttacataggtgtgccatttggagggattaattttagggccactggcatggaaatttcctctgactgatgactgagggcaggccgactcctggggcacagatgcacatagtgggagcttgtggacacgctcctctgagagtacttaagtagggtggtcagttgagagcagatgatgggggatcttatggaggcctgagaaaagaggaatttattggttggtttttttctgccttgcaccttaggttgtataaaggcatgagtaacacactgctgacactttttggaacagggaatactgtgttgtagatcccttgatgagatttgctgtgtctttgttacagggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtaagaatggcagatgtttcacaattaattgggggcctgggagttttatttatttattctctcttttttaagacagggtcttgccctgtcacctaggctggagtgtagtggcgtgatcatagctcactgcaacttgaactcctacagtcaagcagtccaccagagcctcccaagtagctaggactataggcacataccaccctgcctgctaatttttaaattttttgtagatactgggtcttactatgttgttcaggctggttttgaactgctggcctcaagggatgtttctgctccagcctcccagggtgctgagattatagtcatgaaccaccataccctgctggagttttatttttaccttagaaatatcaaagtaatggctgggcacagcagctcacgcctgcaatcccaatgctttgggaagctatgtgggatgatctttgaactcctgggctcaagtgatccccctgagtagttggaactatggacatataccaccgtgcctgcctagataggcatatattggaaaagatacatattattctgtgtcaggcattttcaggtaacaacctaagtatttttcctgtgtttctaaataaccttcatagttgttattgggtatttgtgtcaatatatttgtgtttgtgtgtgtgcgcgcttgtataagtgtatatgattttatttatttatttatttattttgagatggagtttcgctcctgttgcccaggctggagtgcaatggcatgatcttcgctcaccacaacctccacctccccggttcaagcgattctcctgcctcagcctcccaagtagctgggattacaggcatgcgccaccacgcccggctaattttgtatttttagtagagacagggtttctccatgttggtcaggctggtctcaaactcccgaccccgcctcagactcccaaagtgctgggattacaggcgtaagccactgcacccggcctatgatttttttattttaatttttattctgtttatttattttttgagacggagtcttgctccgttgcccaggctggagtgcagtggtggcacctcggctcactgcaaccactgtctcctgggttcaagcgatttttgtaccttagcttctctagtagctgggactacaggtgcctgccaccacactcagctaatttttgtatttttagtagagatggggttttgccatgttggccaggctggtctcgaactcctgacctcaagtgatccacctgctttgggctcctaaaattctgggattacagacacaagccaccatagccagcctgaatgtatatgattttagaaggtatgtatcacggagcatttgcacagagtgaatagaataaaagtccccatatcactgcattttaagacaggtacttactgtagaataaacctttttttttgtttgttttttgagacggagtcttgctctgttgcccagtctggagtgcaatgacgtgatcttggctcactgcaacctccaccacccgggttcaagcaattctcctgcctcagcccccagagtagctgggattgcaggcacacaccaacatgcccaactaattattattatttttattttttatttttgagtctcacctgtcatccaggctggagtgcagtagcgtgatctcggctcaccgcaacctccacttcctgggtttaagcgattcacctgcctcagcctcctgagtagctgggattactggcgcccaccaccacgcctggctaatttttgtatttttagtagagacgaggtttcaccatgttggccatgcttgtctcgaactcttgacctcaggtgatccaccttcctcagcctcccaaagtgttgggattacaggcgtgagccaccacgcccagcccagaataaactttctaagatagtttttcagtaaaggcaaacgtaaaacaaacatttaaaaactaggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtcaggctggcgttgaactcctgaccttgtgatccacccacctcgccctcccaaagtgctgggattacaggcgtgagccacagtgcccggctggagagcaattttttaatagtaacttattgtatatagtattttatgtagtacctattttatacagtgcaacttgtttttaaactgtttataggctgggtgcagtggctcatgcctgtattcccagcactttgggaggctgaggcaggaggattacttgaggtcaggagttcgagaccaacctggccaatatgatgaaaccccttctctactaaaaatacagaattatctgggcgtggtggcatgcacctgtattcccagctactttcaaggctgaggtgagaggattgcttcagcctaggagttcaaggctgcagttagctatggtcatgccactgcactccagcctgggtgacagaatgggatcccatcttaaaaaaaaaaaacaaaaacaaaactatttattgcttgtgtctgctttattttcaaaggtctaactcatcttattactatggatttacaccagaaggaaattcagggcttcttcaatattcctgttgacaatttaagagcatctcccttcttattacagtatattcaagaagaggtgagctagctcaaacttttttattttaacattctgattaaggttgaaagatgtatttccatttccttaggatacccctaaaggattaaaacttgatgtattgtacttaaagtaccattatactttatagctataatccaacgcattttagaattctgaatctgcagtttgtttctttagataagctcttaaaattgctttttcttttggacctcaagtacctagaattggactagatatgattgtaatgagtaatttactctcattactagtctatgcttgatcctggttctgttttatgtatccatctatccatcctgtctctctgtccatccagttataatagccagcatccatgatcccacctcccagcaagaaaactagagtcatcatcataacttagagctgctcatgggctccttctctgtcctatccccctgcctccttccaccctagggaaccactgtcctgaagcggtgctgaatctgtcagatgctttttctgtatcagtggagatgatcattttttttccttcattctgttaatgtggtttattaccacccttgaatcctgggataaatcagatgtttaattttaatatagctacatttgtttttctttgatatgagttagcatttttgtgacttactatttaagaaagcttttaaaatgttaatttatactgtacttagctattttgcttttagctgtttttctttcttttttttttttttttggtggggggtgtgatggagtcactcccaggctggagtgtaatggcgcaatctcagcccactgaaacctccacctcccgggttcaagcaattctcgagtagctgggattacaggcatgcgccaacacagctggctaattttttgtatctttagtagagatggggtttcaccatgttggccaggctgatctcgaacgctgacctcgtgatctgcctgcctcggcctcccaaagtgctgggattacaggcatgagccaccgcacctggccttagcggtttttcttatataaattatttctctctttaataacttttctagataacttctttttacagtactgtatttaaaagaagataacttctttttacagtactgtatttaaaagatggcagtttataggtttctgaggaacttctttctggtaagaatacagggcttccccattctccaggaattgttataagtccttatagagaaaatgaatttaagtatttttgaaagagaaaaatgtaaaatattctgctttttttttttctttaaagttacacacaagaaacataaaaactctacgccgggcgccagtggctcacgcctataatcccagcacttttgggagtctgaggcgggtggatcacttgaggtcaggagttcagaccagcctagccaacatggtgaaaccccatctctaccaaaaatacataattagctggatgtggtggcgcgtgcctgtaatcccagttacttgggaggctgaggcaggagaattgcttgaacctgggaggtggaggttacagtgagccaggattgtgccacggcactcctgcctgggtgacagagcgagactatctcaaaaaaacaaaaaagaaaacaaaaatactctaacaaattaaaaaaataatagagactttaattttacctgaaaaattttatgtttttttttgagacagggtctttctctgtcacccaggttggagtgctgtagtgccatgatagctcactgcaaccttgaactcctgggctcaagagatttctcccacctcagccttctgagtagctgagactagaggtgtgccaccacacctagctaatttttaaaaaatatttccagagtcagaatcttgctgtgttacccaggctggtctcaaactcctggcctcaagcgatcctcctgcctcagcctcccaaaacagtgtgattacaggtgtgagccactgtgcctggcctaattttacctgaatattattctcagttgagagagaaggtgagataaaattggcaaatgtcttgatagggaaggatgaagaggtttaggcagagagagagtgagagggtgagcattgaacgtggttcagttagcaaccagccgcatggagaaacctgtcattttggaagaaatagagcagtcgctatagacttatgtgggttgctgtcgacatcttgttgttttaggggatgtttccattcaggacacaggcatgttgtgtgccagtgtctcaaggcacaaatggcaattgcacctcttaagggatgcccggtgggtgagcctaaagaacgaaggctggggcacccttgtgctggttgcaaggtcaggctggaagcctaacgctagtcattgcctgtagtgcaggcttctacctgaggatgacactgccttctacttgaaaaaatccccattttagtttcattgttgagaagaagtcagggctgagtgtggtggcccacacctataatcccagcactttgagaggctgaggaggttggatcagttgagtccaggagtttaagaccatcctcggcaatatggcaaaaccctgtctctacaaaaaatacaaaaattaaccaggtgtggtggtgcattcctgtggtcccacctactcaagaggatgagaagtgggaggattgcttgagcctgggaggttgaagttgcccaggtggtcgaggctgcatcaagccgtgatctgggcgacagagtgagattccatctcacacaaaaaaaaaaaaaaaaaaaaaaaaaattaatatgtgggaactcagtgttaaaaaggaatttttgtgtattgcttttttcttttttttggagacagtctctctctgtcactcaggctggagtgcgattttggcttactgcagcctccgcctcctgggttcaagcaagcatatctggctaatttttgttttttgtttttttttgagatggagtttcgctcttgttgcccaggctggagtgcaatggcatgatctcggctcacagcaacctccacctcccaggttcaagtgattgtcctgcctcagcctcccgagtagctggggttacaggcatgtgccaccacacccggctaattttgtatttttagtagagacagggtttctccttgttggtcaggctggtctcgaactcctgacctcaggtgatctgcccaccttggcctcccaaagtgctgggattacaggtgtgaaccaccgcacttggcctaatttttgtgtttttagtagagatagggtttcaccgtgttggccaggctggtcttgaacttctgaactccagtgatctgcctgcctcagcttcccaaagtcctggtattacaggcatgagctactacacctggcctgtattgcctttttatagtatacgtatcttgtctcttttgttttcgtgtgttagagcctcttaaagcaggggatagatattcatgtttcactgaatctaaggtgctgtcagtccaggcttacattattttacgtcaccaagaaagaagaaaacactgctaattatactgtggcactgtgccttcttgtcacttagtgatcctattctgcaggttttgatgctgacgctttctccatctcttgtgtttgtcactggaatttaagcaccttctgccagagtcagaaggaacattctggtactaggatgctcgttgccttgaaatttttgccatctattcttttttttttttttgagacggagtctcactctgtcgcccaggctggagtgcggtggcgcaatctcagcttactgcaagctccgcctcccgggttcacgccattctcctaggcctcagcctccccagtagctgggactacaggcacctaccaccacgcctggctaatttttttgtagttttagtagagatggggtttcaccgtgttaaccaggatggtctcaatctcctgacctaatgatctgcccgcctcagcctcccaaagtgctgggattacaggtgtgagccaccgcgcccagccaacttttgccatctcttctgagggcgtctgacagtgtctgttgccttccgctgcactgctggggatgtgtcaggcagtccttttcacagtttgacctactggtagggatcttcctttcttaagtttcataaagcatttgattgttgccttgcaagaaaatgtggaattgtatcatttttccagtgatgaatatttgattcatgaatatcaaattatactctgatggtctcttcctgtgtctttctgcatacatgataatttttcttttcttcttttttttttttttttttttttttgagacggagttttgctcttgttgcccaggctggagtgcagtggcgcaatctcagctcatcacaacctccgcctcccaggttcaagcgattctcctgcctcagcctcccgagtagctgggattacaggcatgggcccccatacctggctaattttgtatttttagtagaaagggggttttccatgttggtcaggctggtcttgaactcccaaactcaggttatccacccgcctcaacctcccagagtactgggattacaagcgtgaagccaccgtgcccggcttgataatttttcattttaatgaaaaattttaatgaaaagaatcatagtaattctttctggagacattttaaatgggttcaaacaattctcctgggttcaaacaattctccggcctcaacctcctgagtaactggattacaggtgtgcaccaccacgcctggctaattttgttttgcatttttagcagcgagggggtttcaccatgctggccaggctggtcttggctcagatgttctgcccaccttggcctcccaaagtgctgggattatgggcatgagccaccgtgcctggccatctttgggaattttttttaatctgttaagtatttcatcccttctatttcttttattattttcctttgggaactattgggtcctgaaaattttggatctagtctctataacttttaaaaacttattttactttttgcatacttatatatagcattctggggaaattccttgtcttgatcttccctggtttgttcttaaagttgtgtttattctgctgttaagccagccagctactgggtttctttagaccataataacttcttccccctagatttatttttggttctttttcataataacttgttctttcttgttgtatataatttcccattttaacctccgtagagacaatagacttgtttttgttagagtcctttcttttaggtcctttaattgttattaactgttttcttggttctgtcttttcttggctgggtttggtaatgtttgatgatgtttgatgagacaaggaaatacatgaaaaagtttagaaagactgccagcaaaaataatgaaagtgcccaaatggaaatatattttactgccttacttcctgagagtgttggataaattaggctttcctgtagatacagctgagccatgtgattatgccggaggcaactgtactaaattattcaaattaatcattttttgttcatttgctaagtagttattatttagtgcttgttgtatggtaggcattgttttatacatgttgctaggtgttattaactgctcatattaaaattcattggtgtaattgtgagaaaaaagcaatgagaatatagttaatatatttttttaaaatagtgctgggccgattatcctttaacaaattggttgcttcaacatgttatgactgcgatatgttaaatagccatttgtttggactgcagtaatttggaatttgacagtcagcttgtattcagattgaattggatatccttgtactttgaaattacatgtaattaggattcttgttgacgagatatatagaaacatctttacactgcatcattagtatttgctggcagagataagagctaatcaccaattatccctacttttttcctaaaagaagtctgtgtggctcacaagttagtaatattttttcataggcaggttcctttcttcattttccaaaggagaattttactttgaactttttctttttttggaaaactttcaactagctaagcatttttgggtctgttggaattttcctttttgttgacatgcagtaatacctgacttcttgtctgtcacagatcccagattacaggaatgcagtaatcgtggccaagtctccagcctcggcgaagaggtaggtgggaatctcacaacctctttctggatctgcttctaaggattgtatccgtgatgagttccaggcattctaatttgaacttcagtggttcccagcgatatctcttatttttcttccatggactggtattttaagattgttctgtcaactccatttattaagtaaacattttaatttcctctcttttttttccaatcccactctatgattgccagacatacttccttttttaagttatcttccacttacactttcttttatttttattattattattatttattttattttatttctttattttttgagatggagtttcgctcttgttgcccaagctggagtgcagtggcgcgatctcggctcaccacaacctccacctcctgggttcaagcgattctcctgcctcagcctcccaagtagctgggattacaggcgtgcaccaccatgcctggctaatttttgtatttttagtagagatgaggtttcaccatgttggtcaggctggtctcaaactcctgacttcaggtgatccacctgccttggcctcccaaggtgctgggattacaggcgtgagccaccacactgggccttatttttatttttaatagtagaaacagagttttgccatgttgtccaggcaggtcttgaactactgaggctcaaacgatccacccacccgccttaccctcccaaagtgctgggattacaggcatgagccactgcgcctgacctcaatcatatttcttgaccaaagcaatccagttctggggaatacgatctagtgttttccccagacccagattgacaatcacatgtcagtctttgagtctggcgtttacagtactggcgaatatttacagtactagcagacaacttcatagttgtttactgccccttatttgaggaactcagaaattgattaacagaattttatccagctgagaggccagttatttgtatatgttaaaggtgacattttacaaaattgacacaacctgaggtgtaccaaagggggagccttgagagtcagtagagtgagttacatgtaacctggagtaactgatgtgtcactattgcatacttaaaattatatgtcggttgagaggatttcttatactaccagtgttttgtggagaagccactccactggagagggaaagaacaaaatcacttgtaggaataaagcctttttcctaaaaaagcccttttaaagttattttccagttgaatacctttgatcactggattgttgttgagtcctgtggaatgaaagaaagtgtagggtgcctccaccctgggctcgtgggctggcagtattgaaggatggaggagaacttgcacacagtaagccattgatttcaaaagtatttcacataagtcattgacgttatgaattaagaatagcactttaatatgtagacttagtatattaaataaaataaattggcatttgagataaaaccattacatggctgtgttcttgtggctgactttcccaacccagccgggcctgtgttcacccatgtgtccttcaagaagttgtatcacctgatctcctcttgtccatttgattaaattgtaagaaacagactgaattttagaatgtaaacatttcaaatagcttttccaaacatttcttcaaaggctgaattaattttacttaataatttttctctgatatacatgctttaaaaaaatgtaggtgaaaaatcacataatatacaataattttaaagtatagaattcactggcatttagtgcattcacaatgttgtgtaaccaccacctgtctctgttttcagaacattttcgtcttcccagaagaacatctagtacccattcagcaatcattccttatcccttcaccttctgtccctcggcagccacacagtatgtggccctctgtgtctggtttctttcacttagcagttttcaaggttcatctatggtgtagcatgtagtatctcagtgttttgttgtcgctgttattgttcgagacaaaatcttactctgttgccgaggctggagtgcagtggcacgatctcagctcactgcaacctccgcctcctgggttcaagcaattctcctgcctcatcctcccaggtagctggaattacaggtgcgtgctaccacacctgggtaatttttgtatttctggtagagatgaggtttcaccatgttggtcaggctggtcttaaactcctgaccttgtgatctgcctgcctcggcctcccaaagtgctgggattacaggcgtgagccaccgcacttggccagtacctcagtccttttgatggctgagtaatattgcattgtatgtgtatactagtttgtttatccattcatctgttgatggacactttttttttttaccgtttggctattatgaataggactcctatggtcagtcatggattagtttttgtgttggcataagttttcatttttcctttcttgtggatatatattaggattggaattgctgggtcatatggcagtttcgtttatgttttgaggaactatcagtctcttttccactgcagctgcccattttacattcccaccagcagagtatgagggttccaacttctccacatcttcaccaacacttaattctctgagttttttcattataatcatcctagtgggtgtgaaattctaccttatcgtggttttcatttgcatttccctaatgattgatgatgttgagtatcttttttttttttttaatgagacagggtctcagtatgttgctcaggctgggctcaaactcttgggctcaatcaatccttctgcctcagcctgttgagtgtgtgtgtgtgtgtgtgtgtgtgtgtgtgtgtgtgtgtgtgtgtgtatttatttatttatttatttttttgagacagagtctcgctctgtcacccaggctggagtgcagtggcgcgatctcggctcactgcaacctccgcctcccaggtttaagcgattctcctgcctcagcctcctgagtagctgggattacaggcatgcgccaccatgcctagctgttgagtatatttttatgtgctttttggccatttgtatatatttggagaaatgcctgttcacaccctttgcccatttaataattgggttgtctttttgttgagttataagcactctttatatattctacatactaaaccttgttagatacatgatttgcagatattttctctctttctgcagattgtcttttcactgtcttgatggtgttctttcacacaaaaaggtttcaatgctgataaagttcaatttatctttttttttttttttttttgagacggagtctcagtctgttgcccaggcttgagtgcagtgtctcagctcactgcaacctctgcctcccgggtacaagcgagtctcctgcctcagcctcctgagtagctgggattacaggtgcccgccaccacacccggctaattttttgtattttttagtagagatggagtttcaccatgttggccaggctggtctcgaactcttgacctcgtgatccgcctgccttggcctccccaatcaatttatcttttttgtttgttattgcctctgcttctgatgtcatgtctaagaatccattggccaggtgcagtggctcacttctgtaatctcagcacttcgggaggctgaggcagaaggatcacttgagcccaggaatttgagaccagccagggcaatatagtgagacctcgtttttaagaaaaaaaaaaacattaactggatgtggtggcatttgtctgtggttctagctacttgggtggctgaggtgggaggattgcttgagcccaagaggtcaaggctacagtgagccgtgattgcaccactgcctggctaatttttgtgtttttagtagagacggggtttcgccatgttggccagactggtctccaactcctgacctcaagtgatcttgacctcaaatgatcatcccaaagtattgggattacaggcatgagccaccgcacccagccaccatagctttttaatttttttgagatggagtttcactcttgttgcccgggctgcacaatcttggctcactgcaacctctgcctcccaggctcaagcaattctattgcctcagcctcccaagtagctgggattacaggtgtgcaccacttcacctggctaattagtagagatggggtttcactatgttggtcaggctggtgaccaacctgatctcctgacctcaggtgatccacccacctctgactcccaaagtgctgggattacagacgtgagccaccatgcaggcctctatagcttttttttttcttttgagacggagtttcgctcttgttgcccaggctggggtacaatggcacgatctcagctcaccctgcaacctccacctctcgggttcaagtgattctcctgcctcagtcttctgactagctgggattacaggcatgcgccaccacgcctatctaattttgtatttttagtagagatggggtttctccatgttggtcaggctggtcttgaactccagacctcaggtgatctgcctgcctcggcatcccaaagtgttgggattattggcatgatccaccatgcccggccctctgtagcttttcaatagtctttttttttttttttttttgagacagagtcttgctctgttgcccaggctggagtgcagtggtgcaatcttggctcactgcaccctccgcctcctgggtttaagcaattctctgcctcacctcctgagtagctgggattgcaggcacctgccaccatgcccagctaatttttaatttttgtatttttagtagagatggggtttcaccatcttggccaggccagtcttgaactcctgacctcgtgatccacccacctcagtctcccaaagtgctgggattacaggcgtgagtcaccacgcccagccttaatagtcttcaagttgggtattgtcacacctccaactttgttcttcaatattgtgttggctattttgggtcttttgcctctccatataaacttcagaatcagttttttgaaatacacaaaataacttgttgggatttagattgggatttgcattaaatctgtagatcagattggggagaactggcatcttgacaatattgagtcttcctatccatgaacatgggatatcattttttaaaaattcatctttgatttctgtcatcagagttttgtagttttccccatatagatgtgtactttttttttttttttttttaaagagaaagtcttgctctgtttacccagactggagtgcactggtgccatcacagctcactacagccttgaatttttgggctcatggcaatcctttcatttcagcctcctaagtagctaggactataggtgtgcaccaccatgcctggctaattaaaaatatatatatatattttttgttagagacaggggtctgactgtgttgcctaggctggtctctaactcctaggctcagcctcccagtgttgggattgcaggcatgagccatcacttccagcccatattttgttatatttatgcctaaataaatatttcatttctttgggtatcccttaattttttagacattgttttctttagttctgtgaacatatttatgatagctaatttattgtgtctagttattctgacattgggctttttcagagatcgtttctgttgactgcttttttactgtgtatgggccatgtttttcttttttttaatgtttaaaaaaacttattactttattattttaatttaatttaatttttatttttattttatgacagagtcttgctctgttgcccaggctggagtgcagtggcatgatctcagctcactgtgacctctgcctcctgggttccagcgattctcctgccttagcctcctgagcagctgggattacaggtgtgtgccaccaaacccagctaatttttgtatttttagtagagacgggatttcaccatgttggctgggctggtctcaaaactcctgacctcaggtgatccacccatcttggcctcccaaaatgctgggattacaggtgtgagccaccatgcctggccaaaacttcttactttaaaaaagaatacagaaacaagatcttgctgtgtttctggactggtctcaaactcctggcctcaagcaatcttcctgccttgggcctcctgaagttctagaattaaaagtgtgagccaccatgcccggcccatattttcctttttgtttgcatgccttgtacattttagttaaaaacaacattttaaattatgtaatgtgaaaaatctgagcatcagattctacctccaccaattcccagtgtttgttgttgctgttgtttctgtgatatgtttgtttagtggccaccctgtgccaattctgtaaagtctgtattctttgtagcattcagccactgaagtctctggttggttagcttactggccagctaatgattggacagagatttcctgaaatgccttgaagcaataaatctcccactctcttcaaggtctgtgtgtgtgtgtttgtgcatgtcttcaattctcccagcagcttacaactctgccttagcctttacttcttggttgcacagagccttaaggtcagccaaggttcaaggttaggggcttttcaggtccttcctgggtaagcgcatgttctttacatgcaggaataagcttttcaaggcccatgtggccatctcattccccagattttccttttttttttttttttttttcaggctagccccttgttttactcaactggtattgtcacttcaggcggctgcagtgttaaacagttgctgttgattgctcatctactctggggatgggactattcacacagagtgactctaagtttgatcatattctccagccctgagtctcagcaagctgccagataggcataatagtgatggttacctgagaatgggcttcttgagaagctccaaacctgttcttttcccaccagtggttgctagtcttctgtttctcatggccaccatgattatgaggtttccaatttttgtcttttgcagaactggagagagaggcatgggaataatggaataatgggaatggggcaagttaaaacacacacagtttcttttttttgagacagggtctcactctgatgcccaggctggagtgcagtggcatcattatggtttactgcagcctggacttcctgggctcaggtgatccacctcagcctcccaagtagctgagaccacaggcatgcagcaccatgcctggctaattctcatgttttttttgtagagatggggtctcactatattgcccaggctggtctccaactcgtggcctcaagtgatctgcccatctcagcctcccaaagtgttgggatgatagtcgtgaaccagcatgcccagcccaaagtttgctctttaacaagattcagctgtttttcttaaacactcctcagattgttgcaagctgttggttaacttccacagttatgtaaaagttaatttttgcaaaattttttagagtttttctttctttcatggaggagcagattttttagggtccttattctgccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatttttttgtcaatactttctttgtttagacttcttgttttttatttcacacatgctcataattgctgcttgtagcacttttctgatggctgctctaaaatctttgttatacagtttcagcatgtctgtcatcttggtgttggcatctgttaattgtcttttttcattcatattgagatttcactggcctttagtgtggcgagtggcttctgattggaatctggacttttagatattgtgtgtgagactctgggtctcatttaggccttctgattttgctggcttctcaggactctggcagggaaagtggtggtgttggggctcgtttctgctaggtaagggtagaagtcgagattcaccaccaggccttgtgtggaccacctaaggtggtccttgttactcatgggtggaaatgctccctccatgtcctccgctgacgccaaggaaaagtagcatcattctcattgggtggtggtggaattcctgactccaccaggctgcctctgataccactgcaatggagaggggaggggcacctcttaactgctgagttgggggtagaagtccagatttcactctccactgactctggcagttgctccttactgctgagtgagggtgaaagtcccagctccctgtttggccttctgtgaaaccacccccattgggtttggggtgcctcattatagcctgacaagccaggaagtacaggctcacccctcaaccttcactcatgcggcggaaatgtggcggaaatgtgggctgtggctttcctgcctgtgtggctagagtaaggcagttattgtctaaatattttctcactcactaggttgcccttttcttagtcctttgactagggagagccgacctttgttggagcttttcttgtctttgcccactggcatttttgggtcgcttcttctccagctacaaatctgggataataaggcaaaaggaatgcccaaggaagccaccaccgtgacgttgctcaggtcctgaggtcccttgctagtctgccttctctctaccttttagtgtcttctcatttttttttgagacggaatctcgctctgtcacccaggctggagtgcagtggcacgatcttggctcactgcaaactccgcctcccgggttcatgccattctcctgcctcagcctcccgagtagctgggactacaggcgtctgccactatgcctggctaatttttgtatttttagtggagacagtttcaccatgttagcaaggatggtctctatctcctgacctcgtgatctgcctgcctcagcctcccagagtgctaggattacaggcatgagccactgcgcctggccagagtcttctcatttttgtttgtatgtaacatccaggggttttagttgtgggtggcagaaggagtattaataatccttcctagtggaagcagaagtgacaatgttttgatacttttttttccttgagacaggttcttgctctgtcatccaggctggagtgcagtggtacaaccacggctcactgtagcctccatctcctgggctcaagagatcctcctgccttagtctcctgagtagctgggactgcaggcatgtgccaccatgcccagctggttttttccttatttttgtagcaacgggatctccctatgttgccaggtctggtctctaactctagggtacaagtaatcctcctgccttggcctcctaaagttccgggattacaggcatgagccactgcatctggccttgatacatttttttttctttcccactaaataccagaagaacatgatgaattttctgttgactttcccatctgggtggacttttagtaacctctagagtcctcagtttacttctgtcacccacctgttcacagagggatggatgtagtagccttttgctcagtttctttggcttttgtcagtgatgtttgtcattcatctgttcaaatgtttattgagaacctattttgctggggctgatgaggcctaggaagatgccctgtaggaatgcatgtgtagcgtcagatgttttttatctatgttatgttatttgatctttgcaactttggaagtcagcagttataatctctcatagatgaggaaacagacccacagagatgaaggaaccaaggtagttccaccaaatgttgtttccttgaaggtagtggggcaactatttacttccaagaatgttttctataccagtgattaggggacttgagtgttggccaaatatgattgaaattgggccaggtgcggtgtcacacctgtaatcccagcactttgggaggccgaggggggtggatcacttgaggtcaggagtttgagaccagcctgaccaacttagtgaagccctgtctctactaaaattacaaaattagcggggcatggtggcgcacgcctgtaatcccagctacttgggaggctgaggcaggagaattgcttgaacctgggaggcagaggttgcagttagtcaggattgcgccattgtactccagcctgggtgacaagagcaaaactccatctcaaaaaaaaaaaaaaaaaaaaaagaaattgacttgcccccctccactcagtctttaccgagtacatatttgagtgctgctgtgccagccatcgtggatgtggtggtgaccagtgcaggcagggctgtgttcccatggcacttgcagactgccctcatgtgctctttgactggtaggtcagttgggtagattggaacgaaagacccagtctctttttctcccagtttcagtaattgaatccacatagatcatactacattaaatgaatgttttagaggctgggcgcattggctcacccctgtaatcccagcactttgggaggccgagatgggtggatctcctgaggtcaggagaattgcttgaacccgggaggcggaggttgcggtgagcccagatcgtgccattgcactccagcctaggcaacaagagcaaaactccatcaaataaataaatgaatgaatgaacgtgtgttttagtatggagatgagtgctacaaaaggttcagttttatatggaacaggtagtaaaataacacagtcaaggcttaggagtttggtctgtgagtttaaggtattgtgagtgggctaggctcgatggctcacacctgtaatcccagcactttgggaggctgaggttggaagatcatttgagtccaggagttcaagaacagcctgggcaacatgttgaaaccccatctctaccaaaaatacaaaaattagccgggtgtggtggcgtgtgcctctagtcccagctactcaggaggctgaggtgggaggatcacttcagcccagtaggtggaggttgcagtgaggtgagatcacaccactgcactccagcctgggtgacagccagaccctgtctcaaaaaaacaaagtaaaataaaaaggtattgtgaacaagagctctgtcgacatggcatcaacacagtaaagtcagttctggttgtcttatatcccgtagctatgtggtggtgattttcttgtgttctaatgtcctgataaacacattcacccagacttcgagcaggagatggcactttctggctcagccacatgcaaattctgatcctattatttctagttccctcctccaagtttttcatttggcagccaaccttagaaaatagctgtaatcaatgtagaagtcagactggggctgacttttatcagtcaggaaggtattaaattagcagtccaagacttgggcttccacttgtgccttagccagtctttgtgagaaccttggtcaaggctgtctctccaagcctcagtttcctggggataacacctgcttggcttatcttacagagttaataagcatcaaagaacttactgaaggactttataaattaaataccattatgtagaatggtggtggttagtgcctttatttatttattttttgagacagggtctccctctgtcgcccagtctggagtgcagtggtgtgatctcggctcactacaacctccacctcctggattcaagcgattctcttgcctcagcctcctaagtagctgggattacagacgtgcgccaccatgcccagctaatttttgtatttttggtagacatggggtttcaccatgctggtaaggctcttctcgaactcctgacctcaagtgatctgcctgcctcggcctcccaaagtgttgggataacagacgtgagccactgttgggataacaggcgtgagccactgcgtttagtggttagtgcctttagaatcctgaagttattgatgaataggtcgaagtgcagagctattgttttggagttgtttgacaatgagcagttgttttgactaaaagggatcatcagagaaagtgttgcttttgtaaggaacagaacttgcttgaatgagttgtttgaaattgttttctctgaataactgagtgaataggaaacaaaaggatagctgaggccctgtgtcttgttctttctcacccatgatgtaaattaactcattatcgtacaatcaggatcaagttgctttagaattcctctctgtcagtgcatgaaacaaaatgacacagagaaaccatcctgattgattttggaattagatgggaatgcaaagtatctgattaagttatatggagtatccagaaactcccattgctgtgcaggtaataattttatttatttattattttacttatttatttttttgagacagagtcttgctgttgtcgcctgggctggcatgcaatggcacgatctcggctcactgcaaccttcgcctcccggattttagcaattctcctgccttagcctcccgattagctgagattacaggtgcctgccaccatgcctgggtaatttttttgtatttttagtagagacggggtttcaccacgttggccaggctggtctcaaactcctgacctcaggtgatccacctgccttggcctcccaaagtgctgggattacaagtgtgagccaccgcacccggccatgattttatttatcttaagagcattgtgctttgtagaggttggtataattgaaatattattctaggaattggcaaacctccacagatcccagatggaaaagacttccttagaggataactaacaggtcagtcatttggccaattttgtttgcaaagccaatcttgaatttcaaggaggaactaataatctatgtgatgccaactcttttgaagactctgccccattgttctgtctgaaatttttttctcttgagaattttttttttttttgagacggagtttcgctcttgttgcccaggctagagtgcaatggtgcgatctcggctcaccgcaatctccgcctcccgggttcaagtgattctcccacctcagcctcccaagtagctggggattacaggcatgtgccaccacacccggctaatttgtttgtgtttttagtaaagacagggtttctccatgttggtcaggctggccccaaactcccagcctcaggtgatctgcccgcctcggcctcccaaagtgctgggattacaggcgtgagccactgctcctggccactctcttgataattttttaaaaactattttgattttttttgtaaggatgaattcaaagttatatgaatactaaatcttacatcttgggatatttatcaaatgttattaaaatattctgtgtttatgatgctccctcttttcccttaggacaaatattctgtcttacacacacatagataaatatattttactgacttcactgtttttgacctgaacagtcttgctcctgtgaaggtttatcatcttttccttggaaatataaattacattcctcatagataggaccagaccaataaatgtttacttacgtgtgtctgagattgtttgtttgtttgtttgtttgtttatttgagacagggtctttctctgttgcccaggcaggagtgcagtggtgcaattatagctcagtgcagccttgaccttctgggctcaagtgattctcccacctcagcctcccaagtagctgggactacaggcgcgtgctaccacgcccagctaatttttgtatttttagtagagacagggtttcaccatgttggccaggatagtttcgatctcttgaccttgtgatccacccgcctcagcctcccaaagtgctgggattacaggcgtgagtcactgtgcctgggccagctaatttttttttatttttgtagagacgaggtctccctgtgttgcccaggctggtctcaaacccctgggctcaagccattctcctgccttcgtctcaaagtgctgggattacaggtgtgagccatcacccagctttaaaaagtatattgaaaataggatgatttaagcatgagttttttgtgtgtttgtttgtttgtttgttcgtttttcagtagagatggagtttcaccatgttggccaggctggtcttgaactccttgtcccaagtgatctgcccgccttagcctcccaaagtgctgggattacaggcgtgagctgccgtgcccagccaaatttaaatttcttgaaataattgctaacactgtagcaaagctttcctttgttgtgtagtgcatataggaaaccaggttgatgtgaaatttctaacagctcataagagtctacatactaatagtatttagtactttctagtgccctgctcttcatatgtcatgtaaatgccttggctgtatctagtatagatagtactagtgggattcagtataatccttaattttttgtttgtttttagtaattcttgtaagcagttagttaagaacttgttttgaatttttggtgctggtaagccaagactgcgagaacttgttggattcttaaacacttgaacatttaccatgcattaggtgctgaggatggaaaaaagagtaagactcagcatggcccccaggaatcaggagtggctgtattaatatcagacaaatcaaggcaaataattttgccatggttgaagaaggtcttttcctaatgataaaggggtcagttcttcaagaggacaaaacagttctaaacatttataaactaaatgacagtgtttcaaagtatatgaagcaaacactgataactgcaaggagaaatagatatatccataatgatagtgattccattattcttctcttagtaattgatagaataaggagactgaaaatcattaaggatgcgggagacttgaacaaccccttcagcctgctggatctgactgacagtcatagcacaccatccagagagagcagaatgtagttcttttttagtataaacacaaagatagatcatattcttgtgagccataaaataagccccaaattgataattatgcaagccatacaaaatatattctctgaccacagtggaattaagaataattctaataacagaagtatctttggaaatgtcctgaatatttagtaactaaataacatacttttagataacccataggtcaaagaagaagtcaaaagtgaaattaaaaagtatttagaaccaaatgaaaatgaagacacaggccaggcgcggtggctcatgcctgtattcccaacactttgggatgccaaggccggcagattacctaaggtcaggagttcaagaccagcctggccaatatgatgatgaaaccccatctctacaaaaaatacaaaattagccgagcgtggtggcacaccctgtaatcccagctactcgggaggctgagacaggagaatcacttgatccagaggtggaggctgcagtgagccgagatcatgtgaccgcactagccaagatcacgccactgcactccagcctgggcgacagagcaagactccatctcaacaacagaaaaaagccagatgcggtgggaagaagctcctgcaagaggccacggagccagcgacgggaggccttgaagccagtgacgacccactcagccgagctgccgctttcgcagcacgccaaggacactcatgaggaccatgatacttccactgagaatgcagatgagtccaaccatgaccctcagtttgagccaatagtttctcttcctgagcaagaaattaaaacgctggaggaagatgaagaacttttaaaaatgcagacgaaactgttctgatttgcctcagagaaggatctcccagaatggaaggagtgaggcaccggcaacgtcaagctcctgaaacacaaggagaaagggaccatctgcctcctcatgcggagggacaagaccctgaagatctgtgctaaccactcttcacgctgataatggagctgaagcccaacatgggtagtgaccatgcctgggtctggaacacccacgccgacttcgccaacgagtgccccaagccagagctgctggccatccacttcctgaatattgagaatgcacagaaattcaaaacaaagtttgaagaatgcaagaaagagatcggagagaaaagaaaggatcgggcaaaaacgatcatgccaaaaaagtggcggaaaagctagaagctcttttggtggaggaggaaaccaaggaggatgctgaggagaagcaataaatcatcttattttatttccttttcctccctttcctttccttttcaaattttaccctgcccctccttttcggtttgtttttattctgttttgtttttacaagggatgttatataaagaactgaattcaacattcaaaaaaaaagattaaagcataaatcaatgaaatagaaaacaaaaaccagaaaaaagctaaaaagctgattctttgagaaaatcaatgcaattgataaacctttatccagactggttaggagaaaacaagacacaaattacctaccgtaccaagtgttggtgaagatgtggaggaactggatctctcatgttctgctcatgggactgtaatatggtataaccactttggaaaacagtgtggcctttttttttttttttttttgagatggagtctcgctctgtcgcccaggctggagtgcattggcactatctccactcactgcgagctccgccttccaggttcacgccattctcctgcctcagcctcctgagtagctgggattacaggtgcctgccacccagtccggctaatttttttgtatttttttagtagagacggggtttcaccgtgttagccaggatggtcttgatctcctgacctcatgatccgcccaccttggcctcccaaagtgctgggattacaggcgtgagccactgcgcccggcctatgtggcctttttataaagagttaaatatacacctactatatgatccagccattccactcttaggaatttatcaggagataagaaagcatgtggctggacacgtaattccagcactttgggaggccacggtgggcagatcatctgaggtcaggagttgaagaccagcctggccaacatgacaaaaccccgtctctacaaaaaatacaaaaattagccaggcgtggtggcacgtgcctataatcccagctacttgggaggttgaggcaggagaatagcttgaatctgggaggtggaggttcacaccactgcactccagcctgagcaacagagtgagactctgtctcaaaagaaaaagaaagaaagaaggaaagaaagcatgtgcccatacagagatctgtgtatgaatgttcacagcagctttgtgacagccaaaaactagaaacaaccggaaagctcagcaatacataaatggatacactgtgatatattcacccagcagaatattactcagcaatgaaagggaatgaactattgatatgttattccatggatgaatctccaaaacatgtgctgcgtaaaataagacaaaatggccaggcgcaagtggctcacacctgtaatcccagcactttgggaggtcgaggtgggtggatcatttcaggtcaggagttcgagaccagtctggctaacatggtaaaaccccatctgtactaaaaatacaaaaaagttagccagatgtggtggtgcatgactgtagttctggctatttgagaggctgaggcaggagaatcgcttgaacccgggaggcagaggttgcagtgaactgagaaatcctgccaccacacttcagtctgggcgacagagcaagactccatctcaaaaaaaaatcagacaaaaaaaggcaactttatgatttcacttacgtgaaattctagataggtgaaactatagtgacagaaagcagatcagctgttgcctggggcaacacttagtgaaaaatcactaaggggcataaggagatgcttgtggtgatgacgttccttatcttgattgtgctaatgcttatatgggcacatacagccttcagagctcatgaaattatatactttagatatgcacagtttctcatatctcagttttacctccctaaaactattaagaaatttgtgcttaatactttggtgagcattttatgccctttgccccatgtagttggttctcactggtaggtaggcaggcaggtagaattagcagctttaggtgagacagagctgagcggaggttccttcactcagtcaggctctcccggccagtggcttgcagaccaggccaggctgctgcccttctttggtgctgctgcagagggaagtgtttggcatgtggggtctctacagttagtcctggtttctaagagtctaaggctgttttattctctcttttctttagtcctttgggagacaacattctacttatgttctcttaatgttttgtcccctaggcattagcagaaccaagggctgcatgagttttgagcttgtgtctggtgttttccctcagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccagtaagtgtgctgctgcctctttcccactttcctctgattttaaggctgactacactgttgtctgtgtggtttttttcctcattcttcgttttttttttaagttggcaaaaactcattaacacctttcttggccagatagtagcgaatgcatttctgattaccttgtaaattgtaaggccgtttagaagcagtctgtccttctttgcaagacctgtgaaaatgtttggactattgagacagttgcaatgcttcagggaagtccattcattcattcagcagtatatactagagtgtagtttaacataagcaaaaagctttttatatacaaagttattgactgtgatgtttttaatgcaaaatattagaaaggtttaaatggtttaccagagtgtagggcttggtaaattatactgtgtcagtacagctaattatgcagccctttgaaataatcaagactatctggaaacgagaaaaatatatggaatatatatgaacaaggcagaatataagattgtatacctatttgtcttagttcaggctgctgtgatgaaataccttagactgggtaatataaacaacaaatttattgctcacagttctagaggctgtgaaggtcaagataaaggcgccagcactgaccccgtgatgggccgggcacggtggctcacgcctgtaatcccaacactttgggaggccgaggcgggtgaatcacctgaggtcaggagttcgagaccagcctgatccacatggagaaaccccctctctactaaaaatacaaaattagccaagtgtggtggcgtatgcctgtaatcccagctccttgggaggctgaggcaggagaatcgcttgaacccgggagacagaggttgtggtgagccgagatcgcgccattgcactccagcctgggcaacaagagtgaaactccttctcagaaaaaaaaaaagataaaggcgccagcagatttggtgtctgtcgagggcctgttcctcgtagatggtaccttcttgctgcatcctcatgtggtggagaaaggtggaagactccctcaagcctctctgacaagggcactgacccccttcgtagagcagagtcctaacaaactagtcacctaaaagccctacctcttaataccaccacagtgggttccagcatgaatttggaaggacacaaaaattcagaccatagcattttgccccggcccctcaaaattcatgttcatcttacgtgcaaaatacattcattctatcctaatagcccccaaaatgttaactccgggtaagtcttaacttaatttcagcatcacctcaaaagtctgaagtccaaagtcccatctaaatatcatctaaatcaaatatgggtaagactccagctctgggattcactctgacgcacgtttctctccggctgtgagcctgtgaaatcaaacaggttgtatgcttccaaaatgcaatggtgggacagacattggatagacattcccattccaaaaaggagaagtgaggcccagtgtggtggttcacgcttgtagtcccagcgttttgggtagccaaggtgggagggttgcttgaggccaggagttcgagaccaaaagggagaagtaggaagaaagaaaggagtgacaggtcctgaccaagtctaaaacccaaccagacaaacaacattaaatcttaaggcttaagttgactcaaagccccgccttccacaaaaattggggcaggggttggtcttgcaaagctctggatggccccactcccacagctttgctgggagcagcccatgcagcagctctcagtcactggattctcatgcctgcatctctcaggctggagttgcactctagtggttctaccagtcttgggtcttggggtggtcttgccccacaactccactgggcattgccctagtggggtctctctggtggccctgcccttgtgacagttctctgcttgggccctggcactctttggggcatcctttgaagtctgggtagaggtagatgtgcccccacagctcattcactctgtgcactgtggagatggccctgcacggacaccactgtggtttgttgcctgtgccttccagaggggtggcccgagctatagttggacctgcttgagctatagctggagtgggtaaggagtattctggaatgtgggaagtggagccttgaaatcgttctgcccccaagaccctggcattctaggcttatgatgagatgggcagtcacaaagatctcagaaatgcctttggggtcattgagtcactgtcttgatgaatagcgtctggttcttttttttttttttttttttttttttttgagacaaggtctcactctgtcacccaggctggagtgcagttgtgcgatcatggctcattgcagtctcacctcctgggcccaagcagtcctcccacttcagcctcatgagtagatggaactacaagcacttgccaccgcacctggctaatttttgtattttttgtagagacaaagttttaccatgttgcccaggctggtcttgaactcctgagctcaagtgatccacccgccttaacctcccaaagtgcttacaggtgtgagccaccactcctggccgtctggcttctttctatccatactaatctccttatcaaatgtttgcttggtggctgggcgcggcggctcacacctataatcccagcactttgggaggccgaggcaggtggatcacgaggtcaggagatcaagaccagcctggccaacatgatgaaaccccgtctctacaaaaaatacaaaaattagctgggcatggtggtgcgtgccttaaatcccaactactcgggaggctaaggcaggagaatcacttgaaccagggagttggaggttgcagtgagctgagatccaagactgtgccaccgtactccagcatggcaacagagtgagacatcatctcaaaaaaaaaaagaaaaaagaaaagtttgcttggctacacacttggagttctgtcctgaacatgtttttgctttttttttttttttttttttttttgagacagagtcttgatctgtcttccaggctggagtacagtggtgcgatcagatctcactgcagcctccacctcccgggcccaagccattctcctacctcagcctcccaagtagctgggactatagatgtgtgcaccaggcctggctaatttttttttttttttttggtagagacggggtcttgctttgttgcctaggttggtcacaaactcttgggctcaagcaatcctccctccttggcctcccaaactcttgggcttataggcctgagccattgcatccagccttgcttttacattctttacaagatggccaggctgataattttccaaatatttaagttctacctcccctttgatgataaatctcatctttaattcatcttcttggattttagtataagcagtcaagagcagccatgcaccctcttttgccaaagattctatttcactgcccttttttttttttttgagatggagtctcactctgtcacccaggctggaatgcagtggtgcaatctcggctcactgcaacctccagctcccgggttcaagcaattctcatgcctcggcctcctgagtagctagcactacaggtgcacaccaccacacctggctcatttttgtatttttaatagagatgacattccaccatgttggccaggttggtctcaaaactcctgaactcaagtggtccgcctgcctcagcctcccaaagtgctggggttacagacatgaaccactgcacccgaccttttttttttttttttttgagacagtgttttactctcttgctcaggctggagtgcagtggtgtgatcacagctcacagcagccttgacctcctgggctcaatcgatcctcccacctcagcctcccaagtagctgggactgcaggcatgtgccaccatgtctggctaatttttgtattttatgtagagatggagttttgccatgttgcccaggttggttttgaactcttgggctcaaagcgatccttccacctcagcctcccaaagtgctgaaattacaggtgtgagccaccatgaccagcctactgtctgtttttctactagcattgtgatcatgaccacttagatcatttctaagaagattgaggctttctttacagctgttttcttctgagcctgtcttagtctgttttgtgttgctataacagactatataagactgggtattctataaagaagacactttatttagctcacagttcttcgggctggtaagttaaagagcatagcatcacatctggcagtttctggtgagggccacacactaggttgaaacatggtggagaagaaaagtgagcaggcgggtgcagagaaatcacatggcaagagaggaaacgagagagcctgggaagccaaactcatttttataacaacctgttctcatgggaactaagtgccctgagagcaagaactcactcacccccataggaaggcattaatccattcatgaaggatctgcctctgtgacccaaacatctcccactaggccccacctctcaatagcgcacactggggatcaatttttttttttttttgagacggagtcttgctctgtcgcccaggctggagtgcagtggtacgattttggctcactgcaagctccacctcctgggttcaagcagttctcctgcctcagcctcccgagtagctgggactacaggtgcatgccaccacacccggctaattttttgtattttagtagagatggggtttcaccttgttgcccaggctggttgaactcctgagctcaggcaatctgcctacctcggcctcccaaagtgctgggattacaggcgtgagccactgcgcctggcccaaatttttaacataagttttagtggagacaaactacatccaaaccaaagcagaactctcaccagagctcccctttacggtctgtacatagcaatacagtctttttctagccttttcctcttccagcctctgcccattacccagttccaaagccactcctgcattggtgggtatttaatacagcagcaactcacttctcagtaccaatttctgtcttagtttgttaaggctactataacaaaataccttagacttggtattttttttttttttttgagacggaatttcgctcttgttgcccaggctggagtgcaatgacacgatcttggctcaccgcaacttccacctccacctcccgggttcaagcgattctcctgcctcagcctcctgagtagctgggattacaggcgcgcaccaccacgactggctaatttttgtatttttagtagagacagagtttctccatgatggtcaggctggtcgcgaacccctgacttcaggtgatccgtccacctcagcctcccaaagtactggaattacaggcatgagccactgcacccggccagactgggtaatttataaacaacagaaattcattgctcacagttctggagactgggaagtcctggatcaaggcaccagcagattggtgtctgatgagggctcactctgctcctgaggtggcaccttgttactgtgtcctcagatggtggaaggagcaaggcagctctctgtaagggcactaatcctgttcatgaaggcagaggccttgagccttaatcatttcccaaaggccccactgttaatactatcacattgggtattaagttccaacatagcattttgagaggacaccatcttcagaccacagcactctctttgtctatgcaaagaccaggaggaaataggaagaatgaatgtagttgggttggggtggtagagttatgcatgaatttgtttttgtgtttaagaaacttccccatgccttaataacatcttcttaattaaaaaaaaaaatgccacctttgagttgttggggaagaaccctaaccccctgccctcatagattcagtgtttggtggcatatggactaaactggcaaaagacagatgaggaagaggaaaggcagtttaatcacatacatacagatgtgtgtgattaaactcttttgtgagtcacaaaaatgtgactcgaagtggttacaatttggggcttatatagcatcttaataggggaacaggaggggcagaaaaggcccctgtgggaaaacagatgacttctttttttttttttttgaaacgctcttttgcccagcctggagtgcagtggtgcaatcatggcacactgcaacctcggcctcccaggttcaggcgattctcctgggtagctgggactaccggtacatgccaccatgcccaggtaattttggtattattattattattattattattattattattattattttttttttttttttttttttttttttttagtagagacagggtttcgccatgttggccaggctggcctcgaactgactgcaagtgattcgcccgcctcggcctcccaatgtgctgggattacaggcgcccggccaagatgactccttaataggggaagaggaggagggaggggactgatgggaagtgggcgctgaggagaaaagatgggagagaggctagtttttgacagcgtctgtttaggtgtggtctggacttcttctggtcttaagcgataagagtcagtcttccctggtgttcccagggaggagatttatcacagttgagttctttggagttattttgtgaggctctgcttttcagcatataagggacttcaggaactcaaatgctttcagctcaaaataatttttaggtcacagaggtatattctggactgttaggtttttgccttgcccaggagtttgctcatttataaatagagggaaaaaaaaaccagagaaggaactagtgtggttgggatagccatgcacacagctgggattccagctatactttgtagatcccaactgaggtggaaagggaaggccatctgggcaggggttaaatctcctaaggggtgggggactgagcttgagtttgcatctggctccatcacttatcagctgtgtgttcttgggcctgttgtttttctgaaaaagagcgacagcaagaggccatcctcagagtggacccatgataggccaagatggtggaaagcccaggacgagccctcaggacccagcactgcctgccttatgtgagtgagataggactgcagtggtgagacgttcagtgatgggccatggtgtggccaggaagacactagcctgactaccaggaggcccctggagggaagagatggactaagatagcagtatctgtggggagccaaccaaggaggactttgaataccagtaaatacactcgtgtcctagaaggcagcccacaaaggctctcgatccgggccatttagtgttcagcaggccaggcctgcatctgtgtttgggatagggctgcaagtgcagaggccagatccgggaggctgatgaagttgagcaggcacatgggaggagagcttgatctcttgggctatgctgtccagtcgggtggccactggctacatgtggctcctgcacactgggaacggggtggggagcagtgggagtgtgaaggacacacccctaatctgaaaactttaatgtaagtatctcattagtgaagttttattgactctgtgttaaaatggtaatattttgatatgttgaatcaaatcaaacatgttattaaaattaattttacctttttttgtgcttttgtaatgtggctactagaaaatctgaaattgcatatgtggctttcatttctgttgtgcgttattgctctaggggttggtaacaatgggaatgaaagtgacagagcacattgagaaatgttaaaaagacgatgggagggaggccaggtactttggcgcactcctttaatcccagcactgtggaaggctaaggtggaaggtttgcttgagcccaggagtttgagaccagcctgggcaacatagcacaaccccgtttctacaaaaagtttaaaaattagccaggcggctgggcgcagtggctcacacctgtaatcccagcactttgggaggccgaggtgggtggatcatgaggtcaggagttcaagatcaacctgaccaagatggcgaaacgctgtctctactaaaaaatataaaaattagccaggtgtggtggttcgtgcctgtaatcgcagctactcaggaggctgaggcaggagaatcacttgaacccaggaggcagaggttgcagtgagctgagattgtgccactgcactccagcctgggcaacacagtgagactacctctcaaaaaaaaaaaaattagccaggcatggtggtgtgcctgtaatcccagctacttgagagtgaggtgaaaggatcacttgaacccaggaagtcgaggctgcagtgagccatgatggtgccactgcactccagcctgtgtgacagagtgagaccctgtctctaaaaaagatagcaggagggaatgaacatttttagtgtattagtctccagtacagcccttttaattgagtgatgattttccactttatagataaacaggatcagaaagagaaagcgacttccctgcagtcacatagtgacaagctggacatgtctgactaaaacctgtgctttttccactgtgttcttgggtctcttggacttagtaatggggatttaaggaggaggaaggcagtgagatagagccagggttcaggatttggggctgggagggtgttaataaagcgtttggctcaggacctcaaagccttttgcttgtgtgtgcatttctcacagcctcacgtgcccaggctgttggtgctggggggtaggcctggggctgccgctccctttcagaatccttgcctggcctcagaggggcttgtgtctaggaacctcagcagaaccctgcaagggctggctgggaccattggtgagatgagccatgcccgggagcatggaagaatatatgttcctcttcagtcctgtaagcacatgggctgtgatgaggaacgcgttggcagtctttagatgaacgctgcttctttggaacttgctgggtgttagcttttggtgtggcctttgggagtggactctggactgcagacactgaactacaggtttcccatctggaaatgagttcataggactggatgatctctatgttctttctaatatttctttactcgtgggatctttatgtttcattcataattttaattataatgtttctatgtttatgttttgactcaagtagtgatcactacaggccgtctttgggaatgcagtagaattttagtttcatagatcctaaatatttgattgtttttatacatttgatgattggacaccctacatagaatacttttttaaggtactagcaaataatatatgaagggaaaagaaagcattcttcctgtagcatctcgaatataaagattttgttatttagtattagattttaaaaattattttgtatcctctgatttcttatagatgaaaatatgcctactaaaaaacaatgaaaatactttttcagaatataagcactatatataatatttgaaaatattatccataaaagttagaagaaaataataattagtgcttgatgccactattcaaagacacaccactttaatttggtgagcctctttttggtttttcacccttattttcataaagctgcgatgcatgcttcatacataattgtgcatgttgctgcctccttctcccagctgcccgacgtgtcatctcaggtcaccagaaactttgacaggaaacagcaatttcttttttttttctttgagactgggtctcactttgtcacccaggctggagtgcagtgacaatcacggctcactgcaaccttgacctcccaggctcaagcgatttgtccacctcagcctcttgtaaacagcatttttatggctaataacccatcgtatgaatgtggcttagactgcccaaccacagcctaatttggggtttttatgttttcttctgttctttgcccttataatgtggcaggaaatatatgtggataaaacacttttcccatactttggcttatttcatttcaagcttctaaaagtgagattaatgagtcagaaggtatgaatataaggctttttgtcaaattgatttcctagagggtgattcattatactttttcaccggcattgaggtcaagtgtcctgggagtaggactgttgaaaatgtaaaaagtcacttcagttctggaatttatcttgctttgctttgttttgttacacttttttgccctctcctgatgctcacctggggtcacacattgcctctggttgtcatatgtctttcatctctttcaatctagagcagtggttctcaattagggagtggatattgtctcctagaggtcatttggaaatgtctggagatagttttgattgtcagaatcaagggggtggctactggcatctagtgagtagaggccaaacatgctgctaaacttctcacagtacgtagggtggtcccttgcagcataaacgtgtctggcccaagatctcagcagttgaaaagtcccaatctagaacagtattttaactttttctttttgtgacattgccttaaaagaaaattgaagtcaaagtcacataacatagaattaaccattttaaagtataaaatttactggctttcagtatattcacagttttgtgcagttaccatttctttctagtttcaaaacttctcattaccccggaagaacaccctgcacccattaagtagtttcaccatgcccccatcccccagcccctggcaaccacttacctcttttctgtttctgtggatgtttgcctaatctggacacttcatataaacggaatcatataatatgtgggcttttgtatctggcttctttctttgagcatgtttttgaggttcatccatgtgatagcacttgtcagtacttcattgcttttggtggctggataatatttcattgtcagcatttgaaaggaatttgggttgtttccacttttggctatgctgctctgtatattcatgtatgagttttctgtgtggatagatgattcatttctcatggtctatacctggtatcggaattgctgcgtcacttggtgtatgtttaactttttgaggaactgccagactcttttttcacagcagctgcaccattttatattcctaccagtaatgtacaaagatttcagtttctccacatcctcatcaacacttattttctactttttattgtagccagcccagtgggcataaagtggcatctcattgtgattttgataaacatttccctaatggctaatgacttcatttgtatatcttctttggagaaatatctgttgaaatcctttgcccatttttgaactaggtttgtctttttttgttgaattataaaagttctttatatattttggcatatggcgcatatatatatatataatttttttttttttttttttttttgcgacagggcctcactctctcacccaggctggagtgcagtggtgcagtcgtggctcactggagccttgacctcccgggcccaagtgatcctctcacctcagccccctaagtagctgtgactactgtcatgcaccaccacgccctgctaatttttgtatttttttatagagacagggtttcgccatgttgctcaggctggtctcaaactcctgaactcaggcaggcaatctgtccacctcggcctcccaaagtactgggattacaggcatgagccaccatgcccagcctactttatatattttggatactagactcttaccagatacatgatatgcaaatattttctgccattctgtaggggttttttttacttttttatttttatctatttatttatttttatttatttattttttgagacagagtctcgctctgtcacccaggctagagtgcagtggcatgatctcggctcactgcaagctccacatctcaggttcacgccattctcctgcctcagcctcccaagtagctgggactacaggcgcccaccagcacacttggctaatttttttttttttttttttttttgtatttttagtagagacagggtttcaccatgttagccaggaaggtcccgatctcctgacctcgtgatccgcccgcctcagcctcccaaagggctgggattacaggcgtgagccaccacgcctggcgtggaattgctttctcaattccctcttttgattgttcagtgctgctgtgtagcagctgattttgtgtgttgattttgtacttggcaacttggctgaattcatatattattagctttggtaggtggatttgtggattcttgggtattttcaatatgtaggaacatgtcatctgctaatagagatagttttacttttcctttctgatctggatgcctttcatttcgttttcttgtctaattacccttgctagagtatccagtatgatggtgaatggcagtggtgcagtgggcatccttgtcttgttgctgatcttaggggaaagcttttggccttcggccataaagtatcaagttagctgtgggtttttgtagttgcccttaatcagattgaggaaattcccttgtattcctagttggttgaatgtttttatcttgagatattaacttctttaaagttttgttttactttttaatataaaaattttggtgtgtgtgttttattccaaccagtgctgattcctaaagaaaagcccccaatcacggttgtgggtgatgttggaggaaggattgccatcatcgtggtatgtagacctcttttattattaattctagtatttgccattgttattctgttgattgattgattgattgattttattacagagactcactgtcgcccaggctggagtgcagtggcacaatctcggctcactgcaacttctgcctcccaggttcaaacgattctcctgcctcagcctcccaagtagctggaattacaggtgcctgctaccacgcctggctaatttttgtatttttagtagagatggggtttcaccatgttggccaggctggtctcaagctcctgaacttaagtgatccacctgcctcggcctcccaaagtgttgggattacaggcgtgagccactgcacctggccaatttatttgttaattctgggcatataaaggcctaaggatagtagtatggccagataattcttattaaatttgtgccttgtgctaaatgtttgctttggcccagaaattggaaaatgctattgtttattttaaaattgctaactactggctgggcgcgttggctcatgcctgtaatcccagcactttgggacgccaaggcaggccaatcgcttgggctcaggagttcaagaccagcttggacaacatggtgaaaccctgtctctacaaaaaatacaaaaattagctgaacttggtggcacatacctgcagtcccagctacttgagaggctgaggcgggaggatcacttgagcctggggctcagaggttgcagtgagccgagatcatgccactgcactccagcctgggtgacagggtgaggctgtgtctcaaaaaaaaaaaaaaaaaaagtcatcctgtcataacatgagatattgttctgtgatcaaagtaaagtacaagctgggcacagtggctcatgcctataatcccagcactttgggaggccaaggcaggcagatcacctgaggtcaggagttgaagaccagcctggccaacatggtgaaaccccatctctactgaaaatacaaaaattagctggacatgttggcgcacacctgtaatcccagctacttgggaggctgatcttggagaatcgcttgaatctgggaggcggaggttgcagtgagccaagattgtgccactgcactctagcctgggcgaaagagtgagattccatctcaaaagaaaaaaaaaaagtaaactacaaagttgattataactgtttgaaacatgcatcctttcacacatcataagaccagtgcacaaaaagagtgcacttcatgcctgtatattttaaagaatagaatgaacactgggtacccgctagctcacttgaggcatagatcatcaccaggtacctagaggcctcctctgggcttaccctggtctctttgcctcagaggttgtcactgatgtgaaagctgcccatcttgatcctgtagtcagccatgagggcttgtggccttaaatgctgcctttttttcttgtctttgatgtttatgtaaatgatgtctttgtgtactttgggactttcttgctcaacactgttattgaaatttacctgtgtagtggcaggaagttgtacttcattctttttcactgctatgtgttgtgtctttggtataactgctacacaactgattgaggcaatggtactgctttgaacatcctcgtgcctattttctggtgcaaaagtgtgagagtttcaaggtgcctgggagtggggttgttgggtctgaaggtatgcacatttttaactttacaaggtgctgccaaattgtttccaaagtggtcacacccatttcccaagttccatagtgggtgccccacattatccccagtgcttgataattttgtacgcacccttttcaggttagaaaatctctctggggccgggcacggtggctcacttctgtaatcccagcactttgggaggccgagacgggtgtaggtcaggagatcgagaccatcctggctaacacggtgaaacctcgtctctactaaaaatacaaaaaattagccgggcgtagtggtgggctcctgtagtcccagctactcgggaggctgaggcaggagatggcatgagaggcggagcttgcagtgagccgagatcgtgccactgcactccagcccaggcgactgagcaagactctgtctcaaaaaaaaaataagaaaatctctcacgtcaccctccagggtaatagctgtccattacttattccttagttggcaaagtctatagtaacaaggtgctgtggattcagtagcacctttccccccgttctagtgccactgcattatttatttatttatttatttatttatttatttatttctatttttttttttgagacaaagtctcgctctgtcacccaggctggagtgcagtggcgtgatctcagctcactgcaacctccacctcctgggttccagcaattctcctgcctcagcctcccaagtagctgggactacaggtgcacgccaccacgtccggctaatttttgtattttttttgtagagacggggtttcaccatattcaccaggctggtttcgaactcctgacctcgtgatctgcccgccttggcctcccaaagtgctgggattacaggcgcaagccactgcacccagccgccagtgcattttttaaaaaaacgtttttattttgaagtaattatagatccacaggaagtagggggcaatacacagggacatcctgtgtattcattacccagcatcctccatcttgcttaactatagtacaataacacagactgaaaattctcagtgccacagccacagaggtccttcagacagcaccagttgtgcatgtagtgagtgtgagtgtgtgtgtgtgtgtgtgtgtgtgtttgtgtttgtgaatgcagtcttaccatgggtagctttgtggaaccaccaccacagtcaggacacagaattgctccttcactgcaaggcaccctcatgcttcctttcatagctacactgacatccttcccacccaatctgcaaccccttgtgtctttgtccactttgtgctgctgtaacacctgagactaggttgtttataaagaatagaagaaatttattctctaacagctctagaggctgtaagtccaaatcatggcaccagcatttggtctggtgagggccttcttgctgtgtcctcacatggcataaggcagaaggacaaaaaggaatgaactttccttcagaaggccaggaaagaggttaacccactcccacaagcctttttatagcgacatgaattcattcctgatggtggatccctcacaacctaaacactttcccaaagaccccaccacccaacactgttgcactggggaataagtttccaacacatgaattttggagggacaaaaacattcaagccacagcactggcaaccactgatctgtcccctgtctttctaattattatttcaagaatgtcatataaatggaatctatggtatataaccttttgagttttgtttaacctaccatgattcccctgagatccatccaggttgttttgtatattaatatgttattcctttttattgctgggcagtatcccatggtatagaggtaccagagtttatttgttgaaggacatttggatgatttccaggttggggctattatacataaaactcgctatgtacattcatgtataggtttttgtgtgaacagagttttaatttctctgggataattgcacttacaaatgcagttgttggtttgcatggtagttgcagatatactcttataagagactgtcaaactgttttccaaagtggctgtaccattttactagtaggacttttaaagtagcgtgtgtgtgtgtgtatgtattttttttgaggtatggtctgggtctgctgcccaggttggagtgcagtggcttgatcacagatcactgcaacttctacctcctggctaaagcaatcctcctgcctcagcctcccaagtagctaggactacaggtgcgtacctccatgcatggctaatttttgcttttctgtttttgtagagactgggtttcgtcatgttgctcaggctggtcttgaacccctgagctcaagcaatcctcccacctcagcctcccaaagtgctgggactacaggcatgagccaccacgcctggcctttatatgtatatttttgatcatagtaacatcagtatgcaattaaagagtaataatatgtatgtaaaataaagacacgaatatttattcaactctagacaacgtttgatgccataatgggtttaaaataactctgggagcctgggaatctagtctctagattggaaaccactgaactgggtattttattattaaaaacaataatcattattattttttccattgtaataacatgtaaaaaaacatatttcccatatgctcagtggagaaaatttggaaataaggaaagtagcaagaagaagtggggggaaagaggcacccataattctattacccagagtcaaaaacatcttttaacactttttctgtgcattaaaaacaaaaaaagaaaattatacctccatcatttctggtgtgacctgcattgtgacagcacaatgttggccagttatggtgcagaaaacagtgctacccctgggagcctggagtgtggtgggagatagctccaatagtggcaggtgctgtgcaggaagaggctcgtgtgaaagtactggagggctgccatggggcacggtgatggggacatggggccatgccgtctgcacaaggccaagtggaagagcagatttttcacggtaaatgtaggcagaccctttttttttcctggttgtctaacctattattgtagaagtgctcatatacattcttttccatctgtgctttggcaggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtaacagggtctgggtgtgtgtgggtacagctgcctgggcttttggcacatcttgatctttagttacagagagtcaggacaagactgagatcttttgtggctgagaaacgattcaagggctgggtgcagtggttcacgcctgtaatcccagcactttgggaggccgaggcaggtggattacctgaggtcaggagttggagaccagcctggccaacagggtgaaaccccgtctctactaaaaatacaaaaattagccgggcgtggtggcacacacctgtaatcccagctacttgggaggctgaggcaagagaatcactggaacccagagggcagtggctgcagtgagccgagattgtgccactgcattccagcctgggtgacagaatgagactcttgtctcaaataataataataataataataataataataataatgtgtacaactcattggtttttagaatgttcagagttgtgcagtcattaccatagttggttttagaacattttcttcttcctagaaaggaaccccatacccattagctgtcacttcacattttctctcactgccattagtccctgggaaccactaatctgctttctgtctctctagatttgcctgttctggacatttcatataaatgagattatacaatgtgtggtcttttgtgtctggctgtcttcactcaacataatattttcaaggttcatccatgttggagcatgaatcaatacttcattttatgatcaaataatgctgtgttacatggatagtccacattttgtctctctcttcgtatttcatgttgatagaaaaaattttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcctagtgggtgtgaggttatcaaatcttaacctaagaaacacaggctgggcgcggtggctcacgcctgtaatcccagcactttgggaggccgaggccggtggatcatgaggtcaggaggtcgagaccatcctggctaacgcggtgaaaccccgtctctactaaaaatacaaaaaaattacttgagcgtggtggcgggcgcctgtcgtcccagcttacttgggaggctgaagcaggagaatggcatgaacccaggaggcagagcttgcagtgagctgagatggcatcactgcactccaggctgagcgacagagcaagactccgtctaaaaataaataaataaataaataattgaaacattgacttgagacatagatccactgtgttttcctgtcgtggcaagcctcagatttgagaagctgtcacatttccagatcaaaccatgaagctacttggctttctgatgctgtggttttttttcttttgcttcacaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgttcatcagcttgttttctcttctgcagctttgtgggggatgcagtagcctctcagagatgtgatatcctctgttctgacaatttgtccaaggccctgaaagttcccgatgtgtagtcatttgattgaggagggggaggagctggaatctcagcatgcaaggccacaggcagcagagaagccagtggtcaccatctgccattggtcttggtgtggctttgcctctcttccgtggctggctgttctccatcatgctctagggagatgagatgctgggggatgcatcccaaagggcaagtgacatgacccttgttgctgtcaagggtctaatatcatctgtcttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggcctcatctgtctttagagtttaggaccctgagcttccccagagtccattggagtggcctcccctggagcactggcactggggtttacacacccctgtcctcccactcagcctgacttatggaggaatatgtagacttgctcataaaaactaatttttcttcctccccaaacaccttaaacctttgctttctgcttgtctgtgttagaatctggaataaaatagtttatttagcacaaaattaggatcagtcaccagccacgctggccttctctgtgctccacagagagcagcgtggcccgagggcttgccccagtaggccagggccttgtttgtgcagaagcaccaagggctctgcttctggaagctgcccaagtgttccgtgggctcttgcacactcagcagtgccacccctcacacctagtttacttgaggaaacagctttgagggaaaggtgttcattctctccccaagtttccaaatccagttaatgatagagctatttactttgaagaagtgtccttgctttctgtgaacctgtccctagaaatggggcctctcgatcttcggaatgaattggcttagggcatgggatggtagctggtggcttctttgccagtgcagctctgtcagttgcaggctggagaccacccagtttccacatttggaagaagagctttgggagcaaggtgtcaccacccatgagagtggagcctgcctgtggtgccaggacctcccactgttgctgtgaaatgagctgaagaggcttcagtaaatctcacagctccagcctctgatgggtttgggttttttcttaccttctgccgtttggatgctgcctaaccatttgctactatagatgacggttgaagttgccatgtggtttggctttataacaagtgacaggcacttcctgaacagccatggggcatcccctggggtggctgtgctggcacagtggccctcccatggtttgggaatggtggtgctgcactagcacggaggacaggttctgctctgggttccttggagatgcagtgggctctcaagctccttcagtgggaggtttcctcctgccactgtgtccagtgagctttgacctctggtttttcttggcatgtcatccttcatgaagaaaagtcatatttacagaagtgaatggaaacatgttttatgggagtgttttcctctgggtaatgaacttggctaaagctaggatccttcacacccacagagactcgaaggtctgccctgagttggctctggaagaacatgaagatgagtgctgggaggagccacgggtggggcatgtgccaggggatggctgacagggctg
